ň(12) United States Patent
Cao

(10) Patent No.: US 8,299,321 B2
(45) Date of Patent: Oct. 30, 2012

(54) NUCLEIC ACID MOLECULES AND OTHER MOLECULES ASSOCIATED WITH PLANTS AND USES THEREOF FOR PLANT IMPROVEMENT

(75) Inventor: Yongwei Cao, Chesterfield, MO (US)

(73) Assignee: Monsanto Technology LLC, St. Louis, MO (US)

( * ) Notice: Subject to any disclaimer, the term of this patent is extended or adjusted under 35 U.S.C. 154(b) by 1135 days.

(21) Appl. No.: 11/980,366

(22) Filed: Oct. 31, 2007
(Under 37 CFR 1.47)

(65) Prior Publication Data
US 2009/0217414 A1      Aug. 27, 2009

Related U.S. Application Data

(63) Continuation-in-part of application No. 10/612,783, filed on Jul. 2, 2003, now abandoned, which is a continuation-in-part of application No. 09/371,146, filed on Aug. 9, 1999, now abandoned, which is a continuation-in-part of application No. 09/304,517, filed on May 6, 1999, now abandoned, said application No. 10/612,783 is a continuation-in-part of application No. 09/684,016, filed on Oct. 10, 2000, now abandoned, which is a continuation-in-part of application No. 09/654,617, filed on Sep. 5, 2000, now abandoned, said application No. 10/612,783 is a continuation-in-part of application No. 09/985,678, filed on Nov. 5, 2001, now abandoned, which is a continuation of application No. 09/304,517, filed on May 6, 1999, now abandoned, said application No. 10/612,783 is a continuation-in-part of application No. 09/816,660, filed on Mar. 26, 2001, now abandoned, which is a continuation of application No. 09/733,089, filed on Dec. 11, 2000, now abandoned, said application No. 10/612,783 is a continuation-in-part of application No. 10/155,881, filed on May 22, 2002, now abandoned, and a continuation-in-part of application No. 09/333,535, filed on Jun. 14, 1999, now abandoned, said application No. 10/612,783 is a continuation-in-part of application No. 09/615,606, filed on Jul. 13, 2000, now abandoned, said application No. 10/612,783 is a continuation-in-part of application No. 09/394,745, filed on Sep. 15, 1999, now abandoned, and a continuation-in-part of application No. 09/565,306, filed on May 4, 2000, now abandoned, said application No. 10/612,783 is a continuation-in-part of application No. 09/553,094, filed on Apr. 18, 2000, now abandoned, and a continuation-in-part of application No. 09/440,687, filed on Nov. 16, 1999, now abandoned, and a continuation-in-part of application No. 09/552,086, filed on Apr. 19, 2000, now abandoned, said application No. 10/612,783 is a continuation-in-part of application No. 09/531,113, filed on Mar. 22, 2000, now abandoned, said application No. 10/612,783 is a continuation-in-part of application No. 09/692,257, filed on Oct. 19, 2000, now abandoned, and a continuation-in-part of application No. 09/565,240, filed on May 8, 2000, now abandoned, and a continuation-in-part of application No. 09/619,643, filed on Jul. 19, 2000, now abandoned, and a continuation-in-part of application No. 09/663,423, filed on Sep. 15, 2000, now abandoned, said application No. 10/612,783 is a continuation-in-part of application No. 09/669,817, filed on Sep. 26, 2000, now abandoned, and a continuation-in-part of application No. 09/696,664, filed on Oct. 25, 2000, now abandoned, and a continuation-in-part of application No. 09/837,604, filed on Apr. 18, 2001, now abandoned, said application No. 10/612,783 is a continuation-in-part of application No. 09/849,526, filed on May 7, 2001, now abandoned, said application No. 10/612,783 is a continuation-in-part of application No. 09/874,708, filed on Jun. 5, 2001, now abandoned, said application No. 10/612,783 is a continuation-in-part of application No. 09/873,402, filed on Jun. 5, 2001, now abandoned, said application No. 10/612,783 is a continuation-in-part of application (Continued)

(51) Int. Cl.
| | |
|---|---|
| *C12N 15/00* | (2006.01) |
| *A01H 5/00* | (2006.01) |
| *A01H 1/00* | (2006.01) |
| *C07H 21/04* | (2006.01) |
| *C07K 14/415* | (2006.01) |

(52) U.S. Cl. ......... 800/295; 435/6.1; 435/468; 435/419; 435/320.1; 435/183; 530/370; 536/23.6; 800/278

(58) Field of Classification Search .............. 435/6, 468, 435/419, 320.1, 183, 6.1; 530/370; 536/23.6; 800/278, 295
See application file for complete search history.

(56) References Cited

U.S. PATENT DOCUMENTS

2003/0233670 A1* 12/2003 Edgerton et al. .............. 800/278

OTHER PUBLICATIONS

Degtyarenko et al., "Molecular evolution of P450 superfamily and P450-containing monooxygenase systems," *FEBS*, 332(1,2):1-8 (1993).

(Continued)

*Primary Examiner* — Phuong Bui
(74) *Attorney, Agent, or Firm* — Lawrence M. Lavin, Jr.; Ying-Hong Liu; Arnold & Porter LLP

(57) ABSTRACT

Polynucleotides useful for improvement of plants are provided. In particular, polynucleotide sequences are provided from plant sources. Polypeptides encoded by the polynucleotide sequences are also provided. The disclosed polynucleotides and polypeptides find use in production of transgenic plants to produce plants having improved properties.

8 Claims, No Drawings

Related U.S. Application Data

No. 09/865,419, filed on May 29, 2001, now abandoned, said application No. 10/612,783 is a continuation-in-part of application No. 09/865,439, filed on May 29, 2001, now abandoned, said application No. 10/612,783 is a continuation-in-part of application No. 09/938,294, filed on Aug. 24, 2001, now abandoned, said application No. 10/612,783 is a continuation-in-part of application No. 10/219,999, filed on Aug. 15, 2002, now abandoned.

(60) Provisional application No. 60/089,524, filed on Jun. 16, 1998, provisional application No. 60/144,084, filed on Jul. 16, 1999, provisional application No. 60/132,860, filed on May 7, 1999, provisional application No. 60/130,464, filed on Apr. 22, 1999, provisional application No. 60/141,132, filed on Jun. 28, 1999, provisional application No. 60/141,139, filed on Jun. 28, 1999, provisional application No. 60/141,135, filed on Jun. 28, 1999, provisional application No. 60/130,174, filed on Apr. 20, 1999, provisional application No. 60/125,818, filed on Mar. 23, 1999, provisional application No. 60/141,132, filed on Jun. 28, 1999, provisional application No. 60/141,139, filed on Jun. 28, 1999, provisional application No. 60/141,135, filed on Jun. 28, 1999, provisional application No. 60/125,817, filed on Mar. 23, 1999, provisional application No. 60/130,174, filed on Apr. 20, 1999, provisional application No. 60/154,375, filed on Sep. 17, 1999, provisional application No. 60/197,872, filed on Apr. 19, 2000, provisional application No. 60/202,214, filed on May 8, 2000, provisional application No. 60/211,750, filed on Jun. 15, 2000, provisional application No. 60/209,830, filed on Jun. 6, 2000, provisional application No. 60/208,063, filed on May 31, 2000, provisional application No. 60/207,458, filed on May 30, 2000, provisional application No. 60/228,466, filed on Aug. 29, 2000, provisional application No. 60/312,544, filed on Aug. 15, 2001, provisional application No. 60/324,109, filed on Sep. 21, 2001.

(56) References Cited

OTHER PUBLICATIONS

Werck-Reichhart et al., "Cytochromes P450: a success story," *Genome Biology*, 1(6) (2000).
NCBI Website, BLASTN Accession No. Q05JG2 dated Jul. 1, 2008.
NCBI Website, BLASTN Accession No. NP_001047855 dated Feb. 14, 2008.
NCBI Website, BLASTN Accession No. ABB71585 dated Mar. 5, 2006.
NCBI Website, BLASTN Accession No. NP_567581 dated May 22, 2008.
NCBI Website, BLASTN Accession No. NP_851136 dated May 22, 2008.
NCBI Website, BLASTN Accession No. ABA55732 dated Aug. 4, 2006.
NCBI Website, BLASTN Accession No. CAO63746 dated Oct. 8, 2007.
NCBI Website, BLASTN Accession No. ABC86558 dated Sep. 1, 2006.
NCBI Website, BLASTN Accession No. ABQ65856 dated Jan. 31, 2008.
NCBI Website, BLASTN Accession No. BAG12741 dated Mar. 8, 2008.
NCBI Website, BLASTN Accession No. BAG12743 dated Mar. 8, 2008.
NCBI Website, BLASTN Accession No. CAA16713 dated Nov. 14, 2006.
NCBI Website, BLASTN Accession No. NP_974574 dated May 22, 2008.
NCBI Website, BLASTN Accession No. NP_199347 dated May 22, 2008.
NCBI Website, BLASTN Accession No. CAO61343 dated Oct. 8, 2007.
NCBI Website, BLASTN Accession No. A2Z212 dated Jul. 1, 2008.
NCBI Website, BLASTN Accession No. NP_001063366 dated Feb. 14, 2008.
NCBI Website, BLASTN Accession No. BAG12742 dated Mar. 8, 2008.
NCBI Website, BLASTN Accession No. CAO47816 dated Oct. 8, 2007.
NCBI Website, BLASTN Accession No. CAN79871 dated Feb. 5, 2008.
NCBI Website, BLASTN Accession No. NP_566628 dated May 22, 2008.
NCBI Website, BLASTN Accession No. NP_180473 dated May 22, 2008.
NCBI Website, BLASTN Accession No. ABA55733 dated Aug. 4, 2006.
NCBI Website, BLASTN Accession No. ABX38720 dated Dec. 1, 2007.
NCBI Website, BLASTN Accession No. ABB71586 dated Mar. 5, 2006.
NCBI Website, BLASTN Accession No. AAZ23260 dated Feb. 16, 2006.
NCBI Website, BLASTN Accession No. BAD38475 dated Feb. 16, 2008.
NCBI Website, BLASTN Accession No. ABC86559 dated Sep. 1, 2006.
NCBI Website, BLASTN Accession No. EAZ07320 dated Feb. 9, 2007.
NCBI Website, BLASTN Accession No. Q09J78 dated Jul. 1, 2008.
NCBI Website, BLASTIN Accession No. BAG12744 dated Mar. 8, 2008.
NCBI Website, BLASTN Accession No. NP_001062021 dated Feb. 14, 2008.
NCBI Website, BLASTN Accession No. CAO21623 dated Oct. 8, 2007.
NCBI Website, BLASTN Accession No. ABC59109 dated Jun. 6, 2007.
NCBI Website, BLASTN Accession No. BAB02968 dated Feb. 14, 2004.
NCBI Website, BLASTN Accession No. CAO71844 dated Oct. 8, 2007.
NCBI Website, BLASTN Accession No. ABC86560 dated Sep. 1, 2006.
NCBI Website, BLASTN Accession No. ABW81069 dated Mar. 30, 2008.
NCBI Website, BLASTN Accession No. CAN82146 dated Feb. 5, 2008.
NCBI Website, BLASTN Accession No. CAN71726 dated Feb. 5, 2008.
NCBI Website, BLASTN Accession No. EAZ43058 dated Feb. 12, 2007.
NCBI Website, BLASTN Accession No. ABC68415 dated Aug. 8, 2006.
NCBI Website, BLASTN Accession No. AB277270 dated Feb. 15, 2008.
NCBI Website, BLASTN Accession No. DQ887714 dated Oct. 16, 2006.
NCBI Website, BLASTN Accession No. NM_001054390 dated Feb. 14, 2008.
NCBI Website, BLASTN Accession No. AK067007 dated Feb. 16, 2008.
NCBI Website, BLASTN Accession No. AB239299 dated Aug. 12, 2006.

NCBI Website, BLASTN Accession No. DQ145932 dated Mar. 5, 2006.
NCBI Website, BLASTN Accession No. AP005825 dated Feb. 16, 2008.
NCBI Website, BLASTN Accession No. AP004052 dated Feb. 16, 2008.
NCBI Website, BLASTN Accession No. AK288402 dated Feb. 16, 2008.
NCBI Website, BLASTN Accession No. NM_001069901 dated Feb. 14, 2008.
NCBI Website, BLASTN Accession No. DQ887715 dated Oct. 16, 2006.
NCBI Website, BLASTN Accession No. AP008208 dated May 19, 2007.
NCBI Website, BLASTN Accession No. NM_001068556 dated Feb. 14, 2008.
NCBI Website, BLASTN Accession No. AK120757 dated Feb. 16, 2008.
NCBI Website, BLASTN Accession No. DQ145933 dated Mar. 5, 2006.
NCBI Website, BLASTN Accession No. AB235919 dated Mar. 8, 2008.
NCBI Website, BLASTN Accession No. EF377341 dated Jan. 31, 2008.
NCBI Website, BLASTN Accession No. DQ352541 dated Sep. 1, 2006.
NCBI Website, BLASTN Accession No. NM_118043 dated May 22, 2008.
NCBI Website, BLASTN Accession No. AY091446 dated Sep. 18, 2002.
NCBI Website, BLASTN Accession No. AY050980 dated Sep. 18, 2002.
NCBI Website, BLASTN Accession No. AB122149 dated Apr. 17, 2004.
NCBI Website, BLASTN Accession No. NM_202845 dated May 22, 2008.
NCBI Website, BLASTN Accession No. AY107506 dated Jun. 6, 2008.
NCBI Website, BLASTN Accession No. BX828383 dated Feb. 6, 2004.
NCBI Website, BLASTN Accession No. AP008215 dated May 19, 2007.
NCBI Website, BLASTN Accession No. AP006057 dated Feb. 16, 2008.
NCBI Website, BLASTN Accession No. DQ340252 dated Aug. 8, 2006.
NCBI Website, BLASTN Accession No. AB235917 dated Mar. 8, 2008.
NCBI Website, BLASTN Accession No. AP008214 dated May 19, 2007.
NCBI Website, BLASTN Accession No. AP004457 dated Feb. 16, 2008.
NCBI Website, BLASTN Accession No. NM_123902 dated May 22, 2008.
NCBI Website, BLASTN Accession No. NM_180805 dated May 22, 2008.
NCBI Website, BLASTN Accession No. AY102136 dated May 16, 2002.
NCBI Website, BLASTN Accession No. AY065065 dated Jan. 7, 2002.
NCBI Website, BLASTN Accession No. AB122150 dated Apr. 17, 2004.
NCBI Website, BLASTN Accession No. BX831670 dated Feb. 6, 2004.
Sasaki et al., Accession No. AP004129, GenEmbl Database, 2001, Result 5.
GenBank Accession No. AF296079 (Jan. 24, 2001) (1 page).
Ober et al., Deoxyhypusine Synthase from Tobacco cDNA Isolation, Characterization, and Bacterial Expression of an Enzyme with Extended Substrate Specificity, *The Journal of Biological Chemistry*, 274(45):32040-32047 (1999).

* cited by examiner

NUCLEIC ACID MOLECULES AND OTHER MOLECULES ASSOCIATED WITH PLANTS AND USES THEREOF FOR PLANT IMPROVEMENT

CROSS-REFERENCE TO RELATED APPLICATIONS

This application is a continuation-in-part under 35 U.S.C. §120 of U.S. application Ser. No. 10/612,783, filed on Jul. 2, 2003 (abandoned), which is hereby incorporated by reference in its entirety, including its Sequence Listing and Table 1. U.S. application Ser. No. 10/612,783 claims priority under 35 U.S.C. §120 as a continuation-in-part of U.S. application Ser. No. 09/371,146, filed Aug. 9, 1999 (abandoned), which is a continuation-in-part of U.S. application Ser. No. 09/304,517, filed May 6, 1999, (abandoned). U.S. application Ser. No. 10/612,783 also claims priority under 35 U.S.C. §120 as a continuation-in-part of U.S. application Ser. No. 09/684,016, filed Oct. 10, 2000 (abandoned), which is a continuation-in-part of U.S. application Ser. No. 09/654,617, filed Sep. 5, 2000 (abandoned). U.S. application Ser. No. 10/612,783 also claims priority under 35 U.S.C. §120 as a continuation-in-part of U.S. application Ser. No. 09/985,678, filed Nov. 5, 2001 (abandoned), which is a continuation of U.S. application Ser. No. 09/304,517, filed May 6, 1999, (abandoned). U.S. application Ser. No. 10/612,783 also claims priority under 35 U.S.C. §120 as a continuation-in-part of U.S. application Ser. No. 09/816,660, filed Mar. 26, 2001 (abandoned), which is a continuation of U.S. application Ser. No. 09/733,089, filed Dec. 11, 2000, (abandoned). U.S. application Ser. No. 10/612,783 also claims priority under 35 U.S.C. §120 as a continuation-in-part of U.S. application Ser. No. 10/155,881, filed May 22, 2002 (abandoned). U.S. application Ser. No. 10/612,783 also claims priority under 35 U.S.C. §120 as a continuation-in-part of U.S. application Ser. No. 09/333,535, filed Jun. 14, 1999 (abandoned), which claims the benefit of U.S. Application Ser. No. 60/089,524, filed Jun. 16, 1998. U.S. application Ser. No. 10/612,783 also claims priority under 35 U.S.C. §120 as a continuation-in-part of U.S. application Ser. No. 09/615,606, filed Jul. 13, 2000 (abandoned), which claims the benefit of U.S. Application Ser. No. 60/144,084, filed Jul. 16, 1999. U.S. application Ser. No. 10/612,783 also claims priority under 35 U.S.C. §120 as a continuation-in-part of U.S. application Ser. No. 09/394,745, filed Sep. 15, 1999 (abandoned). U.S. application Ser. No. 10/612,783 also claims priority under 35 U.S.C. §120 as a continuation-in-part of U.S. application Ser. No. 09/565,306, filed May 4, 2000 (abandoned), which claims the benefit of U.S. Application Ser. No. 60/132,860, filed May 7, 1999. U.S. application Ser. No. 10/612,783 also claims priority under 35 U.S.C. §120 as a continuation-in-part of U.S. application Ser. No. 09/553,094, filed Apr. 18, 2000 (abandoned). U.S. application Ser. No. 10/612,783 also claims priority under 35 U.S.C. §120 as a continuation-in-part of U.S. application Ser. No. 09/440,687, filed Nov. 16, 1999 (abandoned). U.S. application Ser. No. 10/612,783 also claims priority under 35 U.S.C. §120 as a continuation-in-part of U.S. application Ser. No. 09/552,086, filed Apr. 19, 2000 (abandoned), which claims the benefit of U.S. Application Ser. No. 60/130,464, filed Apr. 22, 1999, and also the benefit of U.S. Application Ser. No. 60/141,132, filed Jun. 28, 1999, and also the benefit of U.S. Application Ser. No. 60/141,139, filed Jun. 28, 1999, and also the benefit of U.S. Application Ser. No. 60/141,135, filed Jun. 28, 1999, and also the benefit of U.S. Application Ser. No. 60/130,174, filed Apr. 20, 1999. U.S. application Ser. No. 10/612,783 also claims priority under 35 U.S.C. §120 as a continuation-in-part of U.S. application Ser. No. 09/531,113, filed Mar. 22, 2000 (abandoned), which claims the benefit of U.S. Application Ser. No. 60/125,818, filed Mar. 23, 1999, and also the benefit of U.S. Application Ser. No. 60/141,132, filed Jun. 28, 1999, and also the benefit of U.S. Application Ser. No. 60/141,139, filed Jun. 28, 1999, and also the benefit of U.S. Application Ser. No. 60/141,135, filed Jun. 28, 1999, and also the benefit of U.S. Application Ser. No. 60/125,817, filed Mar. 23, 1999, and also the benefit of U.S. Application Ser. No. 60/130,174, filed Apr. 20, 1999. U.S. application Ser. No. 10/612,783 also claims priority under 35 U.S.C. §120 as a continuation-in-part of U.S. application Ser. No. 09/692,257, filed Oct. 19, 2000 (abandoned). U.S. application Ser. No. 10/612,783 also claims priority under 35 U.S.C. §120 as a continuation-in-part of U.S. application Ser. No. 09/565,240, filed May 8, 2000 (abandoned). U.S. application Ser. No. 10/612,783 also claims priority under 35 U.S.C. §120 as a continuation-in-part of U.S. application Ser. No. 09/619,643, filed Jul. 19, 2000 (abandoned). U.S. application Ser. No. 10/612,783 also claims priority under 35 U.S.C. §120 as a continuation-in-part of U.S. application Ser. No. 09/663,423, filed Sep. 15, 2000 (abandoned), which claims the benefit of U.S. Application Ser. No. 60/154,375, filed Sep. 17, 1999. U.S. application Ser. No. 10/612,783 also claims priority under 35 U.S.C. §120 as a continuation-in-part of U.S. application Ser. No. 09/669,817, filed Sep. 26, 2000 (abandoned). U.S. application Ser. No. 10/612,783 also claims priority under 35 U.S.C. §120 as a continuation-in-part of U.S. application Ser. No. 09/696,664, filed Oct. 25, 2000 (abandoned). U.S. application Ser. No. 10/612,783 also claims priority under 35 U.S.C. §120 as a continuation-in-part of U.S. application Ser. No. 09/837,604, filed Apr. 18, 2001 (abandoned), which claims the benefit of U.S. Application Ser. No. 60/197,872, filed Apr. 19, 2000. U.S. application Ser. No. 10/612,783 also claims priority under 35 U.S.C. §120 as a continuation-in-part of U.S. application Ser. No. 09/849,526, filed May 7, 2001 (abandoned), which claims the benefit of U.S. Application Ser. No. 60/202,214, filed May 8, 2000. U.S. application Ser. No. 10/612,783 also claims priority under 35 U.S.C. §120 as a continuation-in-part of U.S. application Ser. No. 09/874,708, filed Jun. 5, 2001 (abandoned), which claims the benefit of U.S. Application Ser. No. 60/211,750, filed Jun. 15, 2000. U.S. application Ser. No. 10/612,783 also claims priority under 35 U.S.C. §120 as a continuation-in-part of U.S. application Ser. No. 09/873,402, filed Jun. 5, 2001 (abandoned), which claims the benefit of U.S. Application Ser. No. 60/209,830, filed Jun. 6, 2000. U.S. application Ser. No. 10/612,783 also claims priority under 35 U.S.C. §120 as a continuation-in-part of U.S. application Ser. No. 09/865,419, filed May 29, 2001 (abandoned), which claims the benefit of U.S. Application Ser. No. 60/208,063, filed May 31, 2000. U.S. application Ser. No. 10/612,783 also claims priority under 35 U.S.C. §120 as a continuation-in-part of U.S. application Ser. No. 09/865,439, filed May 29, 2001 (abandoned), which claims the benefit of U.S. Application Ser. No. 60/207,458, filed May 30, 2000. U.S. application Ser. No. 10/612,783 also claims priority under 35 U.S.C. §120 as a continuation-in-part of U.S. application Ser. No. 09/938,294, filed Aug. 24, 2001 (abandoned), which claims the benefit of U.S. Application Ser. No. 60/228,466, filed Aug. 29, 2000. U.S. application Ser. No. 10/612,783 also claims priority under 35 U.S.C. §120 as a continuation-in-part of U.S. application Ser. No. 10/219,999, filed Aug. 15, 2002 (abandoned), which claims the benefit of U.S. Application Ser. No. 60/312,544, filed Aug. 15, 2001, and also claims the benefit of U.S. Application Ser. No. 60/324,109, filed Sep. 21, 2001. All of the above-referenced applications are hereby incorporated by reference in their entireties, including their respective sequence listings and tables.

INCORPORATION OF SEQUENCE LISTING

Two copies of the sequence listing (Seq. Listing Copy 1 and Seq. Listing Copy 2) and a computer-readable form of the sequence listing, all on CD-Rs, each containing the file named pa_01260.rpt, which is 25,669,717 bytes (measured in MS-DOS) and was created on Oct. 29, 2007, are herein incorporated by reference.

INCORPORATION OF SEQUENCE LISTING

An electronic equivalent of a paper copy of the Sequence Listing containing the file named "53373.CorrSeqlist.pdf", which is 23,229,074 bytes in size (measured in MS-DOS) and which was created on Feb. 26, 2009, and a computer-readable form of the Sequence Listing containing the file named "53373.CorrSeqlist.txt", which is 26,419,279 bytes in size (measured in MS-DOS) and which was created on Feb. 25, 2009, are submitted herewith electronically via EFS web and are herein incorporated by reference.

polynucleotides and polypeptides of this invention are useful for improvement of one or more important properties in plants.

The present invention also provides fragments of the polynucleotides of the present invention for use, for example as probes or molecular markers. Such fragments comprise at least 15 consecutive nucleotides in a sequence selected from the group consisting of SEQ ID NOs: 1-9677 and complements thereof. Polynucleotide fragments of the present invention are useful as primers for PCR amplification and in hybridization assays such as transcription profiling assays or marker assays, e.g. high throughput assays where the oligonucleotides are provided in high-density arrays on a substrate. The present invention also provides homologs of the polynucleotide and polypeptides of the present invention.

This invention also provides DNA constructs comprising polynucleotides provided herein. Of particular interest are recombinant DNA constructs, wherein said constructs comprise a polynucleotide selected from the group consisting of:
(a) a polynucleotide comprising a nucleic acid sequence selected from the group consisting of SEQ ID NOs: 1-9677;

LENGTHY TABLES

The patent contains a lengthy table section. A copy of the table is available in electronic form from the USPTO web site (http://seqdata.uspto.gov/?pageRequest=docDetail&DocID=US08299321B2). An electronic copy of the table will also be available from the USPTO upon request and payment of the fee set forth in 37 CFR 1.19(b)(3).

FIELD OF THE INVENTION

Disclosed herein are inventions in the field of plant biochemistry and genetics. More specifically polynucleotides for use in plant improvement are provided, in particular, sequences from *Zea mays*, *Oryza sativa*, and *Glycine max* and the polypeptides encoded by such cDNAs are disclosed. Methods of using the polynucleotides for production of transgenic plants with improved biological characteristics are disclosed.

BACKGROUND OF THE INVENTION

The ability to develop transgenic plants with improved traits depends in part on the identification of genes that are useful for production of transformed plants for expression of novel polypeptides. In this regard, the discovery of the polynucleotide sequences of such genes, and the polypeptide encoding regions of genes, is needed. Molecules comprising such polynucleotides may be used, for example, in DNA constructs useful for imparting unique genetic properties into transgenic plants.

SUMMARY OF THE INVENTION

This invention provides isolated and purified polynucleotides comprising DNA sequences and the polypeptides encoded by such molecules from *Zea mays*, *Oryza sativa*, and *Glycine max*. Polynucleotide sequences of the present invention are provided in the attached Sequence Listing as SEQ ID NOs: 1-9677. Polypeptides of the present invention are provided as SEQ ID NOs: 9678-12046. Preferred subsets of the (b) a polynucleotide encoding a polypeptide having an amino acid sequence selected from the group consisting of SEQ ID NOs: 9678-12046;
(c) a polynucleotide comprising a nucleic acid sequence complementary to a nucleic acid sequence selected from the group consisting of SEQ ID NOs: 1-9677;
(d) a polynucleotide having at least 70% sequence identity to a polynucleotide of (a), (b) or (c);
(e) a polynucleotide encoding a polypeptide having at least 80% sequence identity to a polypeptide having an amino acid sequence selected from the group consisting of SEQ ID NOs: 9678-12046;
(f) a polynucleotide comprising a promoter functional in a plant cell, operably joined to a coding sequence for a polypeptide having at least 80% sequence identity to a polypeptide having an amino acid sequence selected from the group consisting of SEQ ID NOs: 9678-12046, wherein said encoded polypeptide is a functional homolog of said polypeptide having an amino acid sequence selected from the group consisting of SEQ ID NOs: 9678-12046; and
(g) a polynucleotide comprising a promoter functional in a plant cell, operably joined to a coding sequence for a polypeptide having an amino acid sequence selected from the group consisting of SEQ ID NOs: 9678-12046, wherein transcription of said coding sequence produces an RNA molecule having sufficient complementarity to a polynucleotide encoding said polypeptide to result in decreased expression of said polypeptide when said construct is expressed in a plant cell.

Such constructs are useful for production of transgenic plants having at least one improved property as the result of expression of a polypeptide of this invention. Improved properties of interest include yield, disease resistance, growth rate, stress tolerance and others as set forth in more detail herein.

The present invention also provides a method of modifying plant protein activity by inserting into cells of said plant an antisense construct comprising a promoter which functions in plant cells, a polynucleotide comprising a polypeptide coding sequence operably linked to said promoter, wherein said protein coding sequence is oriented such that transcription from said promoter produces an RNA molecule having sufficient complementarity to a polynucleotide encoding said polypeptide to result in decreased expression of said polypeptide when said construct is expressed in a plant cell.

This invention also provides a transformed organism, particularly a transformed plant, preferably a transformed crop plant, comprising a recombinant DNA construct of the present invention.

DETAILED DESCRIPTION OF THE INVENTION

The present invention provides polynucleotides, or nucleic acid molecules, representing DNA sequences and the polypeptides encoded by such polynucleotides from *Zea mays, Oryza sativa*, and *Glycine max*. The polynucleotides and polypeptides of the present invention find a number of uses, for example in recombinant DNA constructs, in physical arrays of molecules, and for use as plant breeding markers. In addition, the nucleotide and amino acid sequences of the polynucleotides and polypeptides find use in computer based storage and analysis systems.

Depending on the intended use, the polynucleotides of the present invention may be present in the form of DNA, such as cDNA or genomic DNA, or as RNA, for example mRNA. The polynucleotides of the present invention may be single or double stranded and may represent the coding, or sense strand of a gene, or the non-coding, antisense, strand.

The polynucleotides of the present invention find particular use in generation of transgenic plants to provide for increased or decreased expression of the polypeptides encoded by the cDNA polynucleotides provided herein. As a result of such biotechnological applications, plants, particularly crop plants, having improved properties are obtained. Crop plants of interest in the present invention include, but are not limited to soy, cotton, canola, maize, wheat, sunflower, sorghum, alfalfa, barley, millet, rice, tobacco, fruit and vegetable crops, and turf grass. Of particular interest are uses of the disclosed polynucleotides to provide plants having improved yield resulting from improved utilization of key biochemical compounds, such as nitrogen, phosphorous and carbohydrate, or resulting from improved responses to environmental stresses, such as cold, heat, drought, salt, and attack by pests or pathogens. Polynucleotides of the present invention may also be used to provide plants having improved growth and development, and ultimately increased yield, as the result of modified expression of plant growth regulators or modification of cell cycle or photosynthesis pathways. Other traits of interest that may be modified in plants using polynucleotides of the present invention include flavonoid content, seed oil and protein quantity and quality, herbicide tolerance, and rate of homologous recombination.

The term "isolated" is used herein in reference to purified polynucleotide or polypeptide molecules. As used herein, "purified" refers to a polynucleotide or polypeptide molecule separated from substantially all other molecules normally associated with it in its native state. More preferably, a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "isolated" is also used herein in reference to polynucleotide molecules that are separated from nucleic acids which normally flank the polynucleotide in nature. Thus, polynucleotides fused to regulatory or coding sequences with which they are not normally associated, for example as the result of recombinant techniques, are considered isolated herein. Such molecules are considered isolated even when present, for example in the chromosome of a host cell, or in a nucleic acid solution. The terms "isolated" and "purified" as used herein are not intended to encompass molecules present in their native state.

As used herein a "transgenic" organism is one whose genome has been altered by the incorporation of foreign genetic material or additional copies of native genetic material, e.g. by transformation or recombination.

It is understood that the molecules of the invention may be labeled with reagents that facilitate detection of the molecule. As used herein, a label can be any reagent that facilitates detection, including fluorescent labels, chemical labels, or modified bases, including nucleotides with radioactive elements, e.g. $^{32}P$, $^{33}P$, $^{35}S$ or $^{125}I$ such as $^{32}P$ deoxycytidine-5'-triphosphate ($^{32}PdCTP$).

Polynucleotides of the present invention are capable of specifically hybridizing to other polynucleotides under certain circumstances. As used herein, two polynucleotides are said to be capable of specifically hybridizing to one another if the two molecules are capable of forming an anti-parallel, double-stranded nucleic acid structure. A nucleic acid molecule is said to be the "complement" of another nucleic acid molecule if the molecules exhibit complete complementarity. As used herein, molecules are said to exhibit "complete complementarity" when every nucleotide in each of the molecules is complementary to the corresponding nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are known to those skilled in the art and can be found, for example in *Molecular Cloning: A Laboratory Manual*, 3rd edition Volumes 1, 2, and 3. J. F. Sambrook, D. W. Russell, and N. Irwin, Cold Spring Harbor Laboratory Press, 2000.

Departures from complete complementarity are therefore permissible, as long as such departures do not completely preclude the capacity of the molecules to form a double-stranded structure. Thus, in order for a nucleic acid molecule to serve as a primer or probe it need only be sufficiently complementary in sequence to be able to form a stable double-stranded structure under the particular solvent and salt concentrations employed. Appropriate stringency conditions which promote DNA hybridization are, for example, 6.0× sodium chloride/sodium citrate (SSC) at about 45° C., followed by a wash of 2.0×SSC at 50° C. Such conditions are known to those skilled in the art and can be found, for example in *Current Protocols in Molecular Biology*, John Wiley & Sons, N.Y. (1989). Salt concentration and temperature in the wash step can be adjusted to alter hybridization stringency. For example, conditions may vary from low stringency of about 2.0×SSC at 40° C. to moderately stringent conditions of about 2.0×SSC at 50° C. to high stringency conditions of about 0.2×SSC at 50° C.

As used herein "sequence identity" refers to the extent to which two optimally aligned polynucleotide or peptide sequences are invariant throughout a window of alignment of components, e.g. nucleotides or amino acids. An "identity fraction" for aligned segments of a test sequence and a reference sequence is the number of identical components which are shared by the two aligned sequences divided by the total number of components in the reference sequence segment, i.e. the entire reference sequence or a smaller defined part of the reference sequence. "Percent identity" is the identity fraction times 100. Comparison of sequences to determine percent identity can be accomplished by a number of well-known methods, including for example by using mathematical algorithms, such as those in the BLAST suite of sequence analysis programs.

Polynucleotides—This invention provides polynucleotides comprising regions that encode polypeptides. The encoded polypeptides may be the complete protein encoded by the gene represented by the polynucleotide, or may be fragments of the encoded protein. Preferably, polynucleotides provided herein encode polypeptides constituting a substantial portion of the complete protein, and more preferentially, constituting a sufficient portion of the complete protein to provide the relevant biological activity.

Of particular interest are polynucleotides of the present invention that encode polypeptides involved in one or more important biological functions in plants. Such polynucleotides may be expressed in transgenic plants to produce plants having improved phenotypic properties and/or improved response to stressful environmental conditions. See, for example, Table 1 of U.S. application Ser. No. 10/612,783 and Table 2 and Table 3 of the present application for a list of improved plant properties and responses, and the SEQ ID NOs: 1-9677 representing the polynucleotides that may be expressed in transgenic plants to impart such improvements.

Polynucleotides of the present invention are generally used to impart such biological properties by providing for enhanced protein activity in a transgenic organism, preferably a transgenic plant, although in some cases, improved properties are obtained by providing for reduced protein activity in a transgenic plant. Reduced protein activity and enhanced protein activity are measured by reference to a wild type cell or organism and can be determined by direct or indirect measurement. Direct measurement of protein activity might include an analytical assay for the protein, per se, or enzymatic product of protein activity. Indirect assay might include measurement of a property affected by the protein. Enhanced protein activity can be achieved in a number of ways, for example by overproduction of mRNA encoding the protein or by gene shuffling. One skilled in the are will know methods to achieve overproduction of mRNA, for example by providing increased copies of the native gene or by introducing a construct having a heterologous promoter linked to the gene into a target cell or organism. Reduced protein activity can be achieved by a variety of mechanisms including antisense, mutation or knockout. Antisense RNA will reduce the level of expressed protein resulting in reduced protein activity as compared to wild type activity levels. A mutation in the gene encoding a protein may reduce the level of expressed protein and/or interfere with the function of expressed protein to cause reduced protein activity.

The polynucleotides of this invention represent cDNA sequences from species such as Zea mays, Oryza sativa, and Glycine max. Nucleic acid sequences of the polynucleotides of the present invention are provided as SEQ ID NOs: 1-9677 in the sequence listing of the present application and additionally in U.S. application Ser. No. 10/612,783 as SEQ ID NOs: 1-3549, wherein SEQ ID NOs: 1-491 represent sequences derived from Glycine max, SEQ ID NOs: 492-3025 represent sequences derived from Zea mays, and SEQ ID NOs: 3026-3549 represent sequences derived from Oryza sativa.

A subset of the nucleic molecules of this invention includes fragments of the disclosed polynucleotides consisting of oligonucleotides of at least 15, preferably at least 16 or 17, more preferably at least 18 or 19, and even more preferably at least 20 or more, consecutive nucleotides. Such oligonucleotides are fragments of the larger molecules having a sequence selected from the group of polynucleotide sequences consisting of SEQ ID NOs: 1-9677, and find use, for example as probes and primers for detection of the polynucleotides of the present invention.

Also of interest in the present invention are variants of the polynucleotides provided herein. Such variants may be naturally occurring, including homologous polynucleotides from the same or a different species, or may be non-natural variants, for example polynucleotides synthesized using chemical synthesis methods, or generated using recombinant DNA techniques. With respect to nucleotide sequences, degeneracy of the genetic code provides the possibility to substitute at least one base of the protein encoding sequence of a gene with a different base without causing the amino acid sequence of the polypeptide produced from the gene to be changed. Hence, the DNA of the present invention may also have any base sequence that has been changed from SEQ ID NOs: 1-9677 by substitution in accordance with degeneracy of the genetic code. References describing codon usage include: Carels et al., J. Mol. Evol. 46: 45 (1998) and Fennoy et al., Nucl. Acids Res. 21(23): 5294 (1993).

Polynucleotides of the present invention that are variants of the polynucleotides provided herein will generally demonstrate significant identity with the polynucleotides provided herein. Of particular interest are polynucleotide homologs having at least about 60% sequence identity, at least about 70% sequence identity, at least about 80% sequence identity, at least about 85% sequence identity, and more preferably at least about 90%, 95% or even greater, such as 98% or 99% sequence identity with polynucleotide sequences described herein.

Protein and Polypeptide Molecules—This invention also provides polypeptides encoded by polynucleotides of the present invention. Amino acid sequences of the polypeptides of the present invention are provided herein as SEQ ID NOs: 9678-12046 and additionally in U.S. application Ser. No. 10/612,783 as SEQ ID NOs: 3550-7098, wherein SEQ ID NOs: 3550-4040 represent sequences derived from Glycine max, SEQ ID NOs: 4041-6574 represent sequences derived from Zea mays, and SEQ ID NOs: 6575-7098 represent sequences derived from Oryza sativa.

As used herein, the term "polypeptide" means an unbranched chain of amino acid residues that are covalently linked by an amide linkage between the carboxyl group of one amino acid and the amino group of another. The term polypeptide can encompass whole proteins (i.e. a functional protein encoded by a particular gene), as well as fragments of proteins. Of particular interest are polypeptides of the present invention which represent whole proteins or a sufficient portion of the entire protein to impart the relevant biological activity of the protein. The term "protein" also includes molecules consisting of one or more polypeptide chains. Thus, a polypeptide of the present invention may also constitute an entire gene product, but only a portion of a functional oligomeric protein having multiple polypeptide chains.

Of particular interest in the present invention are polypeptides involved in one or more important biological properties in plants. Such polypeptides may be produced in transgenic plants to provide plants having improved phenotypic properties and/or improved response to stressful environmental conditions. In some cases, decreased expression of such polypeptides may be desired, such decreased expression being obtained by use of the polynucleotide sequences provided herein, for example in antisense or cosuppression methods. See, e.g., Table 1 of U.S. application Ser. No. 10/612,783, and Table 2 and Table 3 of the present application for a list of improved plant properties and responses, and SEQ ID NOs: 9678-12046 for the polypeptides whose expression may be altered in transgenic plants to impart such improvements. A summary of such improved properties and polypeptides of interest for increased or decreased expression is provided below.

Yield/Nitrogen: Yield improvement by improved nitrogen flow, sensing, uptake, storage and/or transport. Polypeptides useful for imparting such properties include those involved in aspartate and glutamate biosynthesis, polypeptides involved in aspartate and glutamate transport, polypeptides associated with the TOR (Target of Rapamycin) pathway, nitrate transporters, ammonium transporters, chlorate transporters and polypeptides involved in tetrapyrrole biosynthesis.

Yield/Carbohydrate: Yield improvement by effects on carbohydrate metabolism, for example by increased sucrose production and/or transport. Polypeptides useful for improved yield by effects on carbohydrate metabolism include polypeptides involved in sucrose or starch metabolism, carbon assimilation or carbohydrate transport, including, for example sucrose transporters or glucose/hexose transporters, enzymes involved in glycolysis/gluconeogenesis, the pentose phosphate cycle, or raffinose biosynthesis, and polypeptides involved in glucose signaling, such as SNF1 complex proteins.

Yield/Photosynthesis: Yield improvement resulting from increased photosynthesis. Polypeptides useful for increasing the rate of photosynthesis include phytochrome, photosystem I and II proteins, electron carriers, ATP synthase, NADH dehydrogenase and cytochrome oxidase.

Yield/Phosphorus: Yield improvement resulting from increased phosphorus uptake, transport or utilization. Polypeptides useful for improving yield in this manner include phosphatases and phosphate transporters.

Yield/Stress tolerance: Yield improvement resulting from improved plant growth and development by helping plants to tolerate stressful growth conditions. Polypeptides useful for improved stress tolerance under a variety of stress conditions include polypeptides involved in gene regulation, such as serine/threonine-protein kinases, MAP kinases, MAP kinase kinases, and MAP kinase kinase kinases; polypeptides that act as receptors for signal transduction and regulation, such as receptor protein kinases; intracellular signaling proteins, such as protein phosphatases, GTP binding proteins, and phospholipid signaling proteins; polypeptides involved in arginine biosynthesis; polypeptides involved in ATP metabolism, including for example ATPase, adenylate transporters, and polypeptides involved in ATP synthesis and transport; polypeptides involved in glycine betaine, jasmonic acid, flavonoid or steroid biosynthesis; and hemoglobin. Enhanced or reduced activity of such polypeptides in transgenic plants will provide changes in the ability of a plant to respond to a variety of environmental stresses, such as chemical stress, drought stress and pest stress.

Cold tolerance: Polypeptides of interest for improving plant tolerance to cold or freezing temperatures include polypeptides involved in biosynthesis of trehalose or raffinose, polypeptides encoded by cold induced genes, fatty acyl desaturases and other polypeptides involved in glycerolipid or membrane lipid biosynthesis, which find use in modification of membrane fatty acid composition, alternative oxidase, calcium-dependent protein kinases, LEA proteins and uncoupling protein.

Heat tolerance: Polypeptides of interest for improving plant tolerance to heat include polypeptides involved in biosynthesis of trehalose, polypeptides involved in glycerolipid biosynthesis or membrane lipid metabolism (for altering membrane fatty acid composition), heat shock proteins and mitochondrial NDK.

Osmotic tolerance: Polypeptides of interest for improving plant tolerance to extreme osmotic conditions include polypeptides involved in proline biosynthesis.

Drought tolerance: Polypeptides of interest for improving plant tolerance to drought conditions include aquaporins, polypeptides involved in biosynthesis of trehalose or wax, LEA proteins and invertase.

Pathogen or pest tolerance: Polypeptides of interest for improving plant tolerance to effects of plant pests or pathogens include proteases, polypeptides involved in anthocyanin biosynthesis, polypeptides involved in cell wall metabolism, including cellulases, glucosidases, pectin methylesterase, pectinase, polygalacturonase, chitinase, chitosanase, and cellulose synthase, and polypeptides involved in biosynthesis of terpenoids or indole for production of bioactive metabolites to provide defense against herbivorous insects.

Cell cycle modification: Polypeptides encoding cell cycle enzymes and regulators of the cell cycle pathway are useful for manipulating growth rate in plants to provide early vigor and accelerated maturation leading to improved yield. Improvements in quality traits, such as seed oil content, may also be obtained by expression of cell cycle enzymes and cell cycle regulators. Polypeptides of interest for modification of cell cycle pathway include cyclins and EIF5alpha pathway proteins, polypeptides involved in polyamine metabolism, polypeptides which act as regulators of the cell cycle pathway, including cyclin-dependent kinases (CDKs), CDK-activating kinases, CDK-inhibitors, Rb and Rb-binding proteins, and transcription factors that activate genes involved in cell proliferation and division, such as the E2F family of transcription factors, proteins involved in degradation of cyclins, such as cullins, and plant homologs of tumor suppressor polypeptides.

Seed protein yield/content: Polypeptides useful for providing increased seed protein quantity and/or quality include polypeptides involved in the metabolism of amino acids in plants, particularly polypeptides involved in biosynthesis of methionine/cysteine and lysine, amino acid transporters, amino acid efflux carriers, seed storage proteins, proteases, and polypeptides involved in phytic acid metabolism.

Seed oil yield/content: Polypeptides useful for providing increased seed oil quantity and/or quality include polypeptides involved in fatty acid and glycerolipid biosynthesis, beta-oxidation enzymes, enzymes involved in biosynthesis of nutritional compounds, such as carotenoids and tocopherols, and polypeptides that increase embryo size or number or thickness of aleurone.

Disease response in plants: Polypeptides useful for imparting improved disease responses to plants include polypeptides encoded by cercosporin induced genes, antifungal proteins and proteins encoded by R-genes or SAR genes. Expression of such polypeptides in transgenic plants will provide an increase in disease resistance ability of plants.

Galactomannanan biosynthesis: Polypeptides involved in production of galactomannans are of interest for providing plants having increased and/or modified reserve polysaccharides for use in food, pharmaceutical, cosmetic, paper and paint industries.

Flavonoid/isoflavonoid metabolism in plants: Polypeptides of interest for modification of flavonoid/isoflavonoid metabolism in plants include cinnamate-4-hydroxylase, chalcone synthase and flavonol synthase. Enhanced or reduced activity of such polypeptides in transgenic plants will provide changes in the quantity and/or speed of flavonoid metabolism in plants and may improve disease resistance by enhancing synthesis of protective secondary metabolites or improving signaling pathways governing disease resistance.

Plant growth regulators: Polypeptides involved in production of substances that regulate the growth of various plant tissues are of interest in the present invention and may be used to provide transgenic plants having altered morphologies and improved plant growth and development profiles leading to improvements in yield and stress response. Of particular interest are polypeptides involved in the biosynthesis of plant growth hormones, such as gibberellins, cytokinins, auxins, ethylene and abscisic acid, and other proteins involved in the activity and/or transport of such polypeptides, including for example, cytokinin oxidase, cytokinin/purine permeases, F-box proteins, G-proteins and phytosulfokines.

Herbicide tolerance: Polypeptides of interest for producing plants having tolerance to plant herbicides include polypeptides involved in the shikimate pathway, which are of interest for providing glyphosate tolerant plants. Such polypeptides include polypeptides involved in biosynthesis of chorismate, phenylalanine, tyrosine and tryptophan.

Transcription factors in plants: Transcription factors play a key role in plant growth and development by controlling the expression of one or more genes in temporal, spatial and physiological specific patterns. Enhanced or reduced activity of such polypeptides in transgenic plants will provide significant changes in gene transcription patterns and provide a variety of beneficial effects in plant growth, development and response to environmental conditions. Transcription factors of interest include, but are not limited to myb transcription factors, including helix-turn-helix proteins, homeodomain transcription factors, leucine zipper transcription factors, MADS transcription factors, transcription factors having AP2 domains, zinc finger transcription factors, CCAAT binding transcription factors, ethylene responsive transcription factors, transcription initiation factors and UV damaged DNA binding proteins.

Homologous recombination: Increasing the rate of homologous recombination in plants is useful for accelerating the introgression of transgenes into breeding varieties by backcrossing, and to enhance the conventional breeding process by allowing rare recombinants between closely linked genes in phase repulsion to be identified more easily. Polypeptides useful for expression in plants to provide increased homologous recombination include polypeptides involved in mitosis and/or meiosis, including for example, resolvases and polypeptide members of the RAD52 epistasis group.

Lignin biosynthesis: Polypeptides involved in lignin biosynthesis are of interest for increasing plants' resistance to lodging and for increasing the usefulness of plant materials as biofuels.

The function of polypeptides of the present invention is determined by comparison of the amino acid sequence of the novel polypeptides to amino acid sequences of known polypeptides. A variety of homology based search algorithms are available to compare a query sequence to a protein database, including for example, BLAST, FASTA, and Smith-Waterman. In the present application, BLASTX and BLASTP algorithms are used to provide protein function information. A number of values are examined in order to assess the confidence of the function assignment. Useful measurements include "E-value" (also shown as "hit_p"), "percent identity", "percent query coverage", and "percent hit coverage".

In BLAST, E-value, or expectation value, represents the number of different alignments with scores equivalent to or better than the raw alignment score, S, that are expected to occur in a database search by chance. The lower the E value, the more significant the match. Because database size is an element in E-value calculations, E-values obtained by BLASTing against public databases, such as GenBank, have generally increased over time for any given query/entry match. In setting criteria for confidence of polypeptide function prediction, a "high" BLAST match is considered herein as having an E-value for the top BLAST hit provided in Table 1 of U.S. application Ser. No. 10/612,783 and Table 2 of the present application of less than 1E-30; a medium BLASTX E-value is 1E-30 to 1E-8; and a low BLASTX E-value is greater than 1E-8. The top BLAST hit and corresponding E values are provided in Table 1 of U.S. application Ser. No. 10/612,783 and Table 2 of the present application.

Percent identity refers to the percentage of identically matched amino acid residues that exist along the length of that portion of the sequences which is aligned by the BLAST algorithm. In setting criteria for confidence of polypeptide function prediction, a "high" BLAST match is considered herein as having percent identity for the top BLAST hit provided in Table 1 of U.S. application Ser. No. 10/612,783 and Table 2 of the present application of at least 70%; a medium percent identity value is 35% to 70%; and a low percent identity is less than 35%.

Of particular interest in protein function assignment in the present invention is the use of combinations of E-values, percent identity, query coverage and hit coverage. Query coverage refers to the percent of the query sequence that is represented in the BLAST alignment. Hit coverage refers to the percent of the database entry that is represented in the BLAST alignment. In the present invention, function of a query polypeptide is inferred from function of a protein homolog where either (1) hit_p<1e-30 or % identity>35% AND query_coverage>50% AND hit_coverage>50%, or (2) hit_p<1e-8 AND query_coverage>70% AND hit_coverage>70%.

A further aspect of the invention comprises functional homologs which differ in one or more amino acids from those of a polypeptide provided herein as the result of one or more conservative amino acid substitutions. It is well known in the art that one or more amino acids in a native sequence can be substituted with at least one other amino acid, the charge and polarity of which are similar to that of the native amino acid, resulting in a silent change. For instance, valine is a conservative substitute for alanine and threonine is a conservative substitute for serine. Conservative substitutions for an amino acid within the native polypeptide sequence can be selected from other members of the class to which the naturally occurring amino acid belongs. Amino acids can be divided into the following four groups: (1) acidic amino acids, (2) basic amino acids, (3) neutral polar amino acids, and (4) neutral nonpolar amino acids. Representative amino acids within these various groups include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. A further aspect of the invention comprises polypeptides which differ in one or more amino acids from those of a soy protein sequence as the result of deletion or insertion of one or more amino acids in a native sequence.

Also of interest in the present invention are functional homologs of the polypeptides provided herein which have the same function as a polypeptide provided herein, but with increased or decreased activity or altered specificity. Such variations in protein activity may exist naturally in polypeptides encoded by related genes, for example in a related polypeptide encodes by a different allele or in a different species, or can be achieved by mutagenesis. Naturally occurring variant polypeptides may be obtained by well known nucleic acid or protein screening methods using DNA or antibody probes, for example by screening libraries for genes encoding related polypeptides, or in the case of expression libraries, by screening directly for variant polypeptides. Screening methods for obtaining a modified protein or enzymatic activity of interest by mutagenesis are disclosed in U.S. Pat. No. 5,939,250. An alternative approach to the generation of variants uses random recombination techniques such as "DNA shuffling" as disclosed in U.S. Pat. Nos. 5,605,793; 5,811,238; 5,830,721 and 5,837,458; and International Applications WO 98/31837 and WO 99/65927, all of which are incorporated herein by reference. An alternative method of molecular evolution involves a staggered extension process (StEP) for in vitro mutagenesis and recombination of nucleic acid molecule sequences, as disclosed in U.S. Pat. No. 5,965,408 and International Application WO 98/42832, both of which are incorporated herein by reference.

Polypeptides of the present invention that are variants of the polypeptides provided herein will generally demonstrate significant identity with the polypeptides provided herein. Of particular interest are polypeptides having at least about 35% sequence identity, at least about 50% sequence identity, at least about 60% sequence identity, at least about 70% sequence identity, at least about 80% sequence identity, and more preferably at least about 85%, 90%, 95% or even greater, sequence identity with polypeptide sequences described herein. Of particular interest in the present invention are polypeptides having amino acid sequences provided herein (reference polypeptides) and functional homologs of such reference polypeptides, wherein such functional homologs comprises at least 50 consecutive amino acids having at least 90% identity to a 50 amino acid polypeptide fragment of said reference polypeptide.

Recombinant DNA Constructs—The present invention also encompasses the use of polynucleotides of the present invention in recombinant constructs, i.e. constructs comprising polynucleotides that are constructed or modified outside of cells and that join nucleic acids that are not found joined in nature. Using methods known to those of ordinary skill in the art, polypeptide encoding sequences of this invention can be inserted into recombinant DNA constructs that can be introduced into a host cell of choice for expression of the encoded protein, or to provide for reduction of expression of the encoded protein, for example by antisense or cosuppression methods. Potential host cells include both prokaryotic and eukaryotic cells. Of particular interest in the present invention is the use of the polynucleotides of the present invention for preparation of constructs for use in plant transformation.

In plant transformation, exogenous genetic material is transferred into a plant cell. By "exogenous" it is meant that a nucleic acid molecule, for example a recombinant DNA construct comprising a polynucleotide of the present invention, is produced outside the organism, e.g. plant, into which it is introduced. An exogenous nucleic acid molecule can have a naturally occurring or non-naturally occurring nucleotide sequence. One skilled in the art recognizes that an exogenous nucleic acid molecule can be derived from the same species into which it is introduced or from a different species. Such exogenous genetic material may be transferred into either monocot or dicot plants including, but not limited to, soy, cotton, canola, maize, teosinte, wheat, rice and *Arabidopsis* plants. Transformed plant cells comprising such exogenous genetic material may be regenerated to produce whole transformed plants.

Exogenous genetic material may be transferred into a plant cell by the use of a DNA vector or construct designed for such a purpose. A construct can comprise a number of sequence elements, including promoters, encoding regions, and selectable markers. Vectors are available which have been designed to replicate in both *E. coli* and *A. tumefaciens* and have all of the features required for transferring large inserts of DNA into plant chromosomes. Design of such vectors is generally within the skill of the art.

A construct will generally include a plant promoter to direct transcription of the protein-encoding region or the antisense sequence of choice. Numerous promoters, which are active in plant cells, have been described in the literature. These include the nopaline synthase (NOS) promoter and octopine synthase (OCS) promoters carried on tumor-inducing plasmids of *Agrobacterium tumefaciens* or caulimovirus promoters such as the Cauliflower Mosaic Virus (CaMV) 19S or 35S promoter (U.S. Pat. No. 5,352,605), and the Figwort Mosaic Virus (FMV) 35S-promoter (U.S. Pat. No. 5,378, 619). These promoters and numerous others have been used to create recombinant vectors for expression in plants. Any promoter known or found to cause transcription of DNA in plant cells can be used in the present invention. Other useful promoters are described, for example, in U.S. Pat. Nos. 5,378, 619; 5,391,725; 5,428,147; 5,447,858; 5,608,144; 5,614,399; 5,633,441; and 5,633,435, all of which are incorporated herein by reference.

In addition, promoter enhancers, such as the CaMV 35S enhancer or a tissue specific enhancer, may be used to enhance gene transcription levels. Enhancers often are found 5' to the start of transcription in a promoter that functions in eukaryotic cells, but can often be inserted in the forward or reverse orientation 5' or 3' to the coding sequence. In some instances, these 5' enhancing elements are introns. Deemed to be particularly useful as enhancers are the 5' introns of the rice actin 1 and rice actin 2 genes. Examples of other enhancers which could be used in accordance with the invention include elements from octopine synthase genes, the maize alcohol dehydrogenase gene intron 1, elements from the maize shrunken 1 gene, the sucrose synthase intron, the TMV omega element, and promoters from non-plant eukaryotes.

DNA constructs can also contain one or more 5' non-translated leader sequences which serve to enhance polypeptide production from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al. (1996) Plant Mol. Biol. 32:393-405).

Constructs and vectors may also include, with the coding region of interest, a nucleic acid sequence that acts, in whole or in part, to terminate transcription of that region. One type of 3' untranslated sequence which may be used is a 3' UTR from the nopaline synthase gene (nos 3') of Agrobacterium tumefaciens. Other 3' termination regions of interest include those from a gene encoding the small subunit of a ribulose-1,5-bisphosphate carboxylase-oxygenase (rbcS), and more specifically, from a rice rbcS gene (U.S. Pat. No. 6,426,446), the 3' UTR for the T7 transcript of Agrobacterium tumefaciens, the 3' end of the protease inhibitor I or II genes from potato or tomato, and the 3' region isolated from Cauliflower Mosaic Virus. Alternatively, one also could use a gamma coixin, oleosin 3 or other 3' UTRs from the genus Coix (PCT Publication WO 99/58659).

Constructs and vectors may also include a selectable marker. Selectable markers may be used to select for plants or plant cells that contain the exogenous genetic material. Useful selectable marker genes include those conferring resistance to antibiotics such as kanamycin (nptII), hygromycin B (aph IV) and gentamycin (aac3 and aacC4) or resistance to herbicides such as glufosinate (bar or pat) and glyphosate (EPSPS). Examples of such selectable markers are illustrated in U.S. Pat. Nos. 5,550,318; 5,633,435; 5,780,708 and 6,118,047, all of which are incorporated herein by reference.

Constructs and vectors may also include a screenable marker. Screenable markers may be used to monitor transformation. Exemplary screenable markers include genes expressing a colored or fluorescent protein such as a luciferase or green fluorescent protein (GFP), a β-glucuronidase or uidA gene (GUS) which encodes an enzyme for which various chromogenic substrates are known or an R-locus gene, which encodes a product that regulates the production of anthocyanin pigments (red color) in plant tissues. Other possible selectable and/or screenable marker genes will be apparent to those of skill in the art.

Constructs and vectors may also include a transit peptide for targeting of a gene target to a plant organelle, particularly to a chloroplast, leucoplast or other plastid organelle (U.S. Pat. No. 5,188,642).

For use in Agrobacterium mediated transformation methods, constructs of the present invention will also include T-DNA border regions flanking the DNA to be inserted into the plant genome to provide for transfer of the DNA into the plant host chromosome as discussed in more detail below. An exemplary plasmid that finds use in such transformation methods is pMON18365, a T-DNA vector that can be used to clone exogenous genes and transfer them into plants using Agrobacterium-mediated transformation. See US Patent Application 20030024014, herein incorporated by reference. This vector contains the left border and right border sequences necessary for Agrobacterium transformation. The plasmid also has origins of replication for maintaining the plasmid in both E. coli and Agrobacterium tumefaciens strains.

A candidate gene is prepared for insertion into the T-DNA vector, for example using well-known gene cloning techniques such as PCR. Restriction sites may be introduced onto each end of the gene to facilitate cloning. For example, candidate genes may be amplified by PCR techniques using a set of primers. Both the amplified DNA and the cloning vector are cut with the same restriction enzymes, for example, NotI and PstI. The resulting fragments are gel-purified, ligated together, and transformed into E. coli. Plasmid DNA containing the vector with inserted gene may be isolated from E. coli cells selected for spectinomycin resistance, and the presence of the desired insert verified by digestion with the appropriate restriction enzymes. Undigested plasmid may then be transformed into Agrobacterium tumefaciens using techniques well known to those in the art, and transformed Agrobacterium cells containing the vector of interest selected based on spectinomycin resistance. These and other similar constructs useful for plant transformation may be readily prepared by one skilled in the art.

Transformation Methods and Transgenic Plants—Methods and compositions for transforming bacteria and other microorganisms are known in the art. See for example Molecular Cloning: A Laboratory Manual, $3^{rd}$ edition Volumes 1, 2, and 3. J. F. Sambrook, D. W. Russell, and N. Irwin, Cold Spring Harbor Laboratory Press, 2000.

Technology for introduction of DNA into cells is well known to those of skill in the art. Methods and materials for transforming plants by introducing a transgenic DNA construct into a plant genome in the practice of this invention can include any of the well-known and demonstrated methods including electroporation as illustrated in U.S. Pat. No. 5,384,253, microprojectile bombardment as illustrated in U.S. Pat. Nos. 5,015,580; 5,550,318; 5,538,880; 6,160,208; 6,399,861 and 6,403,865, Agrobacterium-mediated transformation as illustrated in U.S. Pat. Nos. 5,635,055; 5,824,877; 5,591,616; 5,981,840 and 6,384,301, and protoplast transformation as illustrated in U.S. Pat. No. 5,508,184, all of which are incorporated herein by reference.

Any of the polynucleotides of the present invention may be introduced into a plant cell in a permanent or transient manner in combination with other genetic elements such as vectors, promoters enhancers etc. Further any of the polynucleotides of the present invention may be introduced into a plant cell in a manner that allows for production of the polypeptide or fragment thereof encoded by the polynucleotide in the plant cell, or in a manner that provides for decreased expression of an endogenous gene and concomitant decreased production of protein.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and out-crossing with a non-transgenic plant are also contemplated, as is vegetative propagation.

Expression of the polynucleotides of the present invention and the concomitant production of polypeptides encoded by the polynucleotides is of interest for production of transgenic plants having improved properties, particularly, improved properties which result in crop plant yield improvement. Expression of polypeptides of the present invention in plant cells may be evaluated by specifically identifying the protein products of the introduced genes or evaluating the phenotypic changes brought about by their expression. It is noted that when the polypeptide being produced in a transgenic plant is native to the target plant species, quantitative analyses comparing the transformed plant to wild type plants may be required to demonstrate increased expression of the polypeptide of this invention.

Assays for the production and identification of specific proteins make use of various physical-chemical, structural, functional, or other properties of the proteins. Unique physical-chemical or structural properties allow the proteins to be separated and identified by electrophoretic procedures, such as native or denaturing gel electrophoresis or isoelectric focusing, or by chromatographic techniques such as ion exchange or gel exclusion chromatography. The unique structures of individual proteins offer opportunities for use of specific antibodies to detect their presence in formats such as an ELISA assay. Combinations of approaches may be employed with even greater specificity such as western blotting in which antibodies are used to locate individual gene products that have been separated by electrophoretic techniques. Additional techniques may be employed to absolutely confirm the identity of the product of interest such as evaluation by amino acid sequencing following purification. Although these are among the most commonly employed, other procedures may be additionally used.

Assay procedures may also be used to identify the expression of proteins by their functionality, particularly where the expressed protein is an enzyme capable of catalyzing chemical reactions involving specific substrates and products. These reactions may be measured, for example in plant extracts, by providing and quantifying the loss of substrates or the generation of products of the reactions by physical and/or chemical procedures.

In many cases, the expression of a gene product is determined by evaluating the phenotypic results of its expression. Such evaluations may be simply as visual observations, or may involve assays. Such assays may take many forms including but not limited to analyzing changes in the chemical composition, morphology, or physiological properties of the plant. Chemical composition may be altered by expression of genes encoding enzymes or storage proteins which change amino acid composition and may be detected by amino acid analysis, or by enzymes which change starch quantity which may be analyzed by near infrared reflectance spectrometry. Morphological changes may include greater stature or thicker stalks.

Plants with decreased expression of a gene of interest can also be achieved through the use of polynucleotides of the present invention, for example by expression of antisense nucleic acids, or by identification of plants transformed with sense expression constructs that exhibit cosuppression effects.

Antisense approaches are a way of preventing or reducing gene function by targeting the genetic material as disclosed in U.S. Pat. Nos. 4,801,540; 5,107,065; 5,759,829; 5,910,444; 6,184,439; and 6,198,026, all of which are incorporated herein by reference. The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes.

The principle of regulation by antisense RNA is that RNA that is complementary to the target mRNA is introduced into cells, resulting in specific RNA:RNA duplexes being formed by base pairing between the antisense substrate and the target. Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression. An antisense vector is constructed by standard procedures and introduced into cells by transformation, transfection, electroporation, microinjection, infection, etc. The type of transformation and choice of vector will determine whether expression is transient or stable. The promoter used for the antisense gene may influence the level, timing, tissue, specificity, or inducibility of the antisense inhibition.

As used herein "gene suppression" means any of the well-known methods for suppressing expression of protein from a gene including sense suppression, anti-sense suppression and RNAi suppression. In suppressing genes to provide plants with a desirable phenotype, anti-sense and RNAi gene suppression methods are preferred. More particularly, for a description of anti-sense regulation of gene expression in plant cells see U.S. Pat. No. 5,107,065 and for a description of RNAi gene suppression in plants by transcription of a dsRNA see U.S. Pat. No. 6,506,559, U.S. Patent Application Publication No. 2002/0168707 A1, and U.S. patent application Ser. Nos. 09/423,143 (see WO 98/53083), 09/127,735 (see WO 99/53050) and 09/084,942 (see WO 99/61631), all of which are incorporated herein by reference. Suppression of an gene by RNAi can be achieved using a recombinant DNA construct having a promoter operably linked to a DNA element comprising a sense and anti-sense element of a segment of genomic DNA of the gene, e.g., a segment of at least about 23 nucleotides, more preferably about 50 to 200 nucleotides where the sense and anti-sense DNA components can be directly linked or joined by an intron or artificial DNA segment that can form a loop when the transcribed RNA hybridizes to form a hairpin structure. For example, genomic DNA from a polymorphic locus of SEQ ID NOs: 1-9677 can be used in a recombinant construct for suppression of a cognate gene by RNAi suppression.

Insertion mutations created by transposable elements may also prevent gene function. For example, in many dicot plants, transformation with the T-DNA of *Agrobacterium* may be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants may be screened with polynucleotides encoding the polypeptide of interest to detect mutated plants having an insertion in the gene encoding the polypeptide of interest.

Polynucleotides of the present invention may be used in site-directed mutagenesis. Site-directed mutagenesis may be utilized to modify nucleic acid sequences, particularly as it is a technique that allows one or more of the amino acids encoded by a nucleic acid molecule to be altered (e.g., a threonine to be replaced by a methionine). Three basic methods for site-directed mutagenesis are often employed. These are cassette mutagenesis, primer extension, and methods based upon PCR.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones.

Arrays—The polynucleotide or polypeptide molecules of this invention may also be used to prepare arrays of target molecules arranged on a surface of a substrate. The target molecules are preferably known molecules, e.g. polynucleotides (including oligonucleotides) or polypeptides, which are capable of binding to specific probes, such as complementary nucleic acids or specific antibodies. The target molecules are preferably immobilized, e.g. by covalent or non-covalent bonding, to the surface in small amounts of substantially purified and isolated molecules in a grid pattern. By immobilized is meant that the target molecules maintain their position relative to the solid support under hybridization and washing conditions. Target molecules are deposited in small footprint, isolated quantities of "spotted elements" of preferably single-stranded polynucleotide preferably arranged in rectangular grids in a density of about 30 to 100 or more, e.g. up to about 1000, spotted elements per square centimeter. In addition in preferred embodiments arrays comprise at least about 100 or more, e.g. at least about 1000 to 5000, distinct target polynucleotides per unit substrate. Where detection of transcription for a large number of genes is desired, the economics of arrays favors a high density design criteria provided that the target molecules are sufficiently separated so that the intensity of the indicia of a binding event associated with highly expressed probe molecules does not overwhelm and mask the indicia of neighboring binding events. For high-density microarrays each spotted element may contain up to about $10^7$ or more copies of the target molecule, e.g. single stranded cDNA, on glass substrates or nylon substrates.

Arrays of this invention can be prepared with molecules from a single species, preferably a plant species, or with molecules from other species, particularly other plant species. Arrays with target molecules from a single species can be used with probe molecules from the same species or a different species due to the ability of cross species homologous genes to hybridize. It is generally preferred for high stringency hybridization that the target and probe molecules are from the same species.

In preferred aspects of this invention the organism of interest is a plant and the target molecules are polynucleotides or oligonucleotides with nucleic acid sequences having at least 80 percent sequence identity to a corresponding sequence of the same length in a polynucleotide having a sequence selected from the group consisting of SEQ ID NOs: 1-9677 or complements thereof. In other preferred aspects of the invention at least 10% of the target molecules on an array have at least 15, more preferably at least 20, consecutive nucleotides of sequence having at least 80%, more preferably up to 100%, identity with a corresponding sequence of the same length in a polynucleotide having a sequence selected from the group consisting of SEQ ID NOs: 1-9677 or complements or fragments thereof.

Such arrays are useful in a variety of applications, including gene discovery, genomic research, molecular breeding and bioactive compound screening. One important use of arrays is in the analysis of differential gene transcription, e.g. transcription profiling where the production of mRNA in different cells, normally a cell of interest and a control, is compared and discrepancies in gene expression are identified. In such assays, the presence of discrepancies indicates a difference in gene expression levels in the cells being compared. Such information is useful for the identification of the types of genes expressed in a particular cell or tissue type in a known environment. Such applications generally involve the following steps: (a) preparation of probe, e.g. attaching a label to a plurality of expressed molecules; (b) contact of probe with the array under conditions sufficient for probe to bind with corresponding target, e.g. by hybridization or specific binding; (c) removal of unbound probe from the array; and (d) detection of bound probe.

A probe may be prepared with RNA extracted from a given cell line or tissue. The probe may be produced by reverse transcription of mRNA or total RNA and labeled with radioactive or fluorescent labeling. A probe is typically a mixture containing many different sequences in various amounts, corresponding to the numbers of copies of the original mRNA species extracted from the sample.

The initial RNA sample for probe preparation will typically be derived from a physiological source. The physiological source may be selected from a variety of organisms, with physiological sources of interest including single celled organisms such as yeast and multicellular organisms, including plants and animals, particularly plants, where the physiological sources from multicellular organisms may be derived from particular organs or tissues of the multicellular organism, or from isolated cells derived from an organ, or tissue of the organism. The physiological sources may also be multicellular organisms at different developmental stages (e.g., 10-day-old seedlings), or organisms grown under different environmental conditions (e.g., drought-stressed plants) or treated with chemicals.

In preparing the RNA probe, the physiological source may be subjected to a number of different processing steps, where such processing steps might include tissue homogenation, cell isolation and cytoplasmic extraction, nucleic acid extraction and the like, where such processing steps are known to the those of skill in the art. Methods of isolating RNA from cells, tissues, organs or whole organisms are known to those of skill in the art.

Computer Based Systems and Methods—The sequence of the molecules of this invention can be provided in a variety of media to facilitate use thereof. Such media can also provide a subset thereof in a form that allows a skilled artisan to examine the sequences. In a preferred embodiment, 20, preferably 50, more preferably 100, even more preferably 200 or more of the polynucleotide and/or the polypeptide sequences of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable media can be used to create a manufacture comprising a computer readable medium having recorded thereon a nucleotide sequence of the present invention.

As used herein, "recorded" refers to a process for storing information on computer readable media. A skilled artisan can readily adopt any of the presently known methods for recording information on computer readable media to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable media. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g., text file or database) in order to obtain a computer readable medium having recorded thereon the nucleotide sequence information of the present invention.

By providing one or more of polynucleotide or polypeptide sequences of the present invention in a computer readable medium, a skilled artisan can routinely access the sequence information for a variety of purposes. The examples which follow demonstrate how software which implements the BLAST and BLAZE search algorithms on a Sybase system can be used to identify open reading frames (ORFs) within the genome that contain homology to ORFs or polypeptides from other organisms. Such ORFs are polypeptide encoding fragments within the sequences of the present invention and are useful in producing commercially important polypeptides such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware, software, and memory used to analyze the sequence information of the present invention. A skilled artisan can readily appreciate that any one of the currently available computer-based systems are suitable for use in the present invention.

As indicated above, the computer-based systems of the present invention comprise a database having stored therein a nucleotide sequence of the present invention and the necessary hardware and software for supporting and implementing a homology search. As used herein, "database" refers to memory system that can store searchable nucleotide sequence information. As used herein "query sequence" is a nucleic acid sequence, or an amino acid sequence, or a nucleic acid sequence corresponding to an amino acid sequence, or an amino acid sequence corresponding to a nucleic acid sequence, that is used to query a collection of nucleic acid or amino acid sequences. As used herein, "homology search" refers to one or more programs which are implemented on the computer-based system to compare a query sequence, i.e., gene or peptide or a conserved region (motif), with the sequence information stored within the database. Homology searches are used to identify segments and/or regions of the sequence of the present invention that match a particular query sequence. A variety of known searching algorithms are incorporated into commercially available software for conducting homology searches of databases and computer readable media comprising sequences of molecules of the present invention.

Commonly preferred sequence length of a query sequence is from about 10 to 100 or more amino acids or from about 20 to 300 or more nucleotide residues. There are a variety of motifs known in the art. Protein motifs include, but are not limited to, enzymatic active sites and signal sequences. An amino acid query is converted to all of the nucleic acid sequences that encode that amino acid sequence by a software program, such as TBLASTN, which is then used to search the database. Nucleic acid query sequences that are motifs include, but are not limited to, promoter sequences, cis elements, hairpin structures and inducible expression elements (protein binding sequences).

Thus, the present invention further provides an input device for receiving a query sequence, a memory for storing sequences (the query sequences of the present invention and sequences identified using a homology search as described above) and an output device for outputting the identified homologous sequences. A variety of structural formats for the input and output presentations can be used to input and output information in the computer-based systems of the present invention. A preferred format for an output presentation ranks fragments of the sequence of the present invention by varying degrees of homology to the query sequence. Such presentation provides a skilled artisan with a ranking of sequences that contain various amounts of the query sequence and identifies the degree of homology contained in the identified fragment.

Having now generally described the invention, the same will be more readily understood through reference to the following examples which are provided by way of illustration, and are not intended to be limiting of the present invention, unless specified.

EXAMPLE 1

A cDNA library is generated from *Zea mays*, *Oryza sativa*, or *Glycine max* tissue. Tissue is harvested and immediately frozen in liquid nitrogen. The harvested tissue is stored at −80° C. until preparation of total RNA. The total RNA is purified using Trizol reagent from Invitrogen Corporation (Invitrogen Corporation, Carlsbad, Calif., U.S.A.), essentially as recommended by the manufacturer. Poly A+ RNA (mRNA) is purified using magnetic oligo dT beads essentially as recommended by the manufacturer (Dynabeads, Dynal Biotech, Oslow, Norway).

Construction of plant cDNA libraries is well known in the art and a number of cloning strategies exist. A number of cDNA library construction kits are commercially available cDNA libraries are prepared using the Superscript™ Plasmid System for cDNA synthesis and Plasmid Cloning (Invitrogen Corporation, Carlsbad, Calif., U.S.A.), as described in the Superscript II cDNA library synthesis protocol. The cDNA libraries are quality controlled for a good insert:vector ratio.

The cDNA libraries are plated on LB agar containing the appropriate antibiotics for selection and incubated at 37° for a sufficient time to allow the growth of individual colonies. Single colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Valencia, Calif. U.S.A.).

The template plasmid DNA clones are used for subsequent sequencing. Sequences of polynucleotides may be obtained by a number of sequencing techniques known in the art, including fluorescence-based sequencing methodologies.

These methods have the detection, automation, and instrumentation capability necessary for the analysis of large volumes of sequence data. With these types of automated systems, fluorescent dye-labeled sequence reaction products are detected and data entered directly into the computer, producing a chromatogram that is subsequently viewed, stored, and analyzed using the corresponding software programs. These methods are known to those of skill in the art and have been described and reviewed.

EXAMPLE 2

The open reading frame in each polynucleotide sequence is identified by a combination of predictive and homology based methods. The longest open reading frame (ORF) is determined, and the top BLAST match is identified by BLASTX against NCBI. The top BLAST hit is then compared to the predicted ORF, with the BLAST hit given precedence in the case of discrepancies.

Functions of polypeptides encoded by the polynucleotide sequences of the present invention are determined using a hierarchical classification tool, termed FunCAT, for Functional Categories Annotation Tool. Most categories collected in FunCAT are classified by function, although other criteria are used, for example, cellular localization or temporal process. The assignment of a functional category to a query sequence is based on BLASTX sequence search results, which compare two protein sequences. FunCAT assigns categories by iteratively scanning through all blast hits, starting with the most significant match, and reporting the first category assignment for each FunCAT source classification scheme. In the present invention, function of a query polypeptide is inferred from the function of a protein homolog where either (1) hit_p<1e-30 or % identity>35% AND query_coverage>50% AND hit_coverage>50%, or (2) hit_p<1 e-8 AND query_coverage>70% AND hit_coverage>70%.

Functional assignments from five public classification schemes, GO_BP, GO_CC, GO_MF, KEGG, and EC, and one internal Monsanto classification scheme, POI, are provided in Table 1 of U.S. application Ser. No. 10/612,783 and Table 2 of the present application. The column under the heading "CAT_TYPE" indicates the source of the classification. GO_BP=Gene Ontology Consortium–biological process; GO_CC=Gene Ontology Consortium–cellular component; GO_MF=Gene Ontology Consortium–molecular function; KEGG=KEGG functional hierarchy; EC=Enzyme Classification from ENZYME data bank release 25.0; POI=Pathways of Interest. The column under the heading "CAT_DESC" provides the name of the subcategory into which the query sequence was classified. The column under the heading "PRODUCT_HIT_DESC" provides a description of the BLAST hit to the query sequences that led to the specific classification. The column under the heading "HIT_E" provides the e-value for the BLAST hit. It is noted that the e-value in the HIT_E column may differ from the e-value based on the top BLAST hit provided in the E_VALUE column since these calculations were done on different days, and database size is an element in E-value calculations. E-values obtained by BLASTing against public databases, such as GenBank, will generally increase over time for any given query/entry match.

Sequences useful for producing transgenic plants having improved biological properties are identified from their FunCAT annotations and are also provided in Table 1 of U.S. application Ser. No. 10/612,783. A biological property of particular interest is plant yield. Plant yield may be improved by alteration of a variety of plant pathways, including those involving nitrogen, carbohydrate, or phosphorus utilization and/or uptake. Plant yield may also be improved by alteration of a plant's photosynthetic capacity or by improving a plant's ability to tolerate a variety of environmental stresses, including cold, heat, drought and osmotic stresses. Other biological properties of interest that may be improved using sequences of the present invention include pathogen or pest tolerance, herbicide tolerance, disease resistance, growth rate (for example by modification of cell cycle, by expression of transcription factors, or expression of growth regulators), seed oil and/or protein yield and quality, rate and control of recombination, and lignin content.

Polynucleotide sequences are provided herein as SEQ ID NOs: 1-9677, and the translated polypeptide sequences for these polynucleotide sequences are provided as SEQ ID NOs: 9678-12046. Descriptions of each of these polynucleotide and polypeptide sequences are provided in Table 1 of U.S. application Ser. No. 10/612,783, and in Table 2 and Table 3 of the present application. The polynucleotide sequences of Table 1 of U.S. application Ser. No. 10/612,783 correspond to the SEQ ID NOs provided in the sequence listing filed in U.S. application Ser. No. 10/612,783. The polynucleotide sequences of Table 2 and Table 3 correspond to the SEQ ID NOs provided in the sequence listing of the present application.

Table 1 and Table 2 Column Descriptions

SEQ_NUM provides the SEQ ID NOs for the listed polynucleotide sequences.

CONTIG_ID provides an arbitrary sequence name taken from the name of the clone from which the cDNA sequence was obtained.

PROTEIN_NUM or PEP_NUM provides the SEQ ID NOs for the translated polypeptide sequence NCBI_GI provides the GenBank ID number for the top BLAST hit for the sequence. The top BLAST hit is indicated by the National Center for Biotechnology Information GenBank Identifier number.

SPECIES provides the name of the species from which the sequence was isolated.

NCBI_GI_DESCRIPTION refers to the description of the GenBank top BLAST hit for the sequence.

E_VALUE provides the expectation value for the top BLAST match.

MATCH_LENGTH provides the length of the sequence which is aligned in the top BLAST match TOP_HIT_PCT_IDENT/% IDENTITY refers to the percentage of identically matched nucleotides (or residues) that exist along the length of that portion of the sequences which is aligned in the top BLAST match.

CAT_TYPE indicates the classification scheme used to classify the sequence. GO_BP=Gene Ontology Consortium–biological process; GO_CC=Gene Ontology Consortium–cellular component; GO_MF=Gene Ontology Consortium–molecular function; KEGG=KEGG functional hierarchy (KEGG=Kyoto Encyclopedia of Genes and Genomes); EC=Enzyme Classification from ENZYME data bank release 25.0; POI=Pathways of Interest.

CAT_DESC provides the classification scheme subcategory to which the query sequence was assigned.

PRODUCT_CAT_DESC provides the FunCAT annotation category to which the query sequence was assigned.

PRODUCT_HIT_DESC provides the description of the BLAST hit which resulted in assignment of the sequence to the function category provided in the cat_desc column.

HIT_E/HIT_P provides the E value for the BLAST hit in the hit_desc column.

PCT_IDENT refers to the percentage of identically matched nucleotides (or residues) that exist along the length of that portion of the sequences which is aligned in the BLAST match provided in hit_desc.

QRY_RANGE lists the range of the query sequence aligned with the hit.

HIT_RANGE lists the range of the hit sequence aligned with the query.

QRY_CVRG provides the percent of query sequence length that matches to the hit (NCBI) sequence in the BLAST match (% qry cvrg=(match length/query total length)× 100).

HIT_CVRG provides the percent of hit sequence length that matches to the query sequence in the match generated using BLAST (% hit cvrg=(match length/hit total length)× 100).

All publications and patent applications cited herein are incorporated by reference in their entirely to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (12046 sequences)

SEQ ID NO: 1 - DNA, 442 bp, Glycine max
  Clone ID: PAT_MRT3847_100307C.1
cttgatttcgtacttgacaaagtctgctggaacaggcattggtattgagtttcgagagtcaggtttgaatattaatgctaaaaatgagcagctagtaaaagaaggcatggtctttaatgtgtcccttgggtttcagaacgttcaaagagaaagttccaagtctaagaacaagcacttctccttgttgcttgctgacacagttatcataaacaaagataaaactgaagttgtgacctctatgagctcaaaggctctaaaagatgttgcatattctttcaatgaggatgaggaagaggaaaatcccagggctaaagctgacaccaatggtgctgagcccttgatgtctaagacaactctaaggtcagacaatcatgagatgtcaaaggaggaacttcgaaggcagcaccaggccgaacttgctcgtcagaaaaatgaagaaact

SEQ ID NO: 2 - DNA, 1620 bp, Glycine max
  Clone ID: PAT_MRT3847_100511C.1
cccacgcgtccgagcaaattgggcgttctcatggctccactgcttgtcgagttgtgagtatttggccacacggaaagatcaggctttgctttgctttgtgtgagatctgaagaagagaggtatggcaaaaagggtcttcttgtacaaggatttggttccttttggggccatggtgaccatggaatgcctcaacgtagccttgaatactctgttcaaagcagctaccttgagagggatgagttaccatgtctttgttgtttatgcttatgctgttgctgctattgttctcattcctggaccctttatctcccaaaggtgcagatcaagagtgcttcctccgctcagtttccccctactacgcaaaattggtcttctcgggctaatagggtgtgcttctcagatcgtgggatacacaggcatcagtttcagttcccccactctctcctcggcgataagcaacttggtgcccgcttttacttttttgcttgccatcattttcaggatggaaaaggtgattgtaagaaatacaacttgtcaagccaaggtattgggtaccatagtatcaataactggagcattcgtagtgaccttctacaaaggaccaccaatcatcattgttcatacaccttccttgtcacttcatcaaccaattaacactctgaattcggtagatcgaagttgggcaattggtggccttctactgacagcagagtatattctggttccattatggtacattgtacaggtgcaaatcatgaaggtgtaccccaatgaactaactgtgatcttcttttacaatttatgtgtaagcatcatggctgcaattgtagctatatttacagagacaaatgcaggagcttggaaaataggactagatacagcattggcttcaatagtttgctctggaatttttggttcatttgtgaacaacgcagttcacacatgggtactacgtataaagggtcctgtctatgtggcaatgttcaagccactctcaattgccatagctgttgccttgggagtcatgttcctgggtgatacactccaccttggaagtctagtgggagccacagtaatatcgatcggattttatacagtaatgtggggaaaagcaaccgaagagaatgtggacgaagatgtccctggccagcaatcaccaccaaccacagagaatgttcctctcttgcaaagctataaaactgatacagctgaaaagaaaatgcatggaagtgtataaatgacaaacaaaactgttgataaatcttaacattattgaaattacacgaatagcaaagcaaatacatggttttgttttcgcccaagctaaccctgtaacgccaatagcaattagcaaagtaggtacccacgcctttagagtgtagaggacatcatatgtaagaaatagttcaagggttcaactgatctcctttcgccaaggaacataaacgaatctttatacaaattagggagcaacctatctacaagtttgtgtacgaacactcacagatgaaaacggagcaacttcgttatctgtcttcccttttcctgtctcttgtaacaagtcatccatattatgatttatagaagctgcgtgattctttaacattaaaaatattatga

SEQ ID NO: 3 - DNA, 582 bp, Glycine max
  Clone ID: PAT_MRT3847_101219C.1
gagtgttttgttaagagagaaaaaatgaagagtatggaaaatgatgacaatgctgaccttaataatcaaaacaattggttgggtttctcactctctcctcaaatgcataatataggagtttcttcacactcacaaccttcctctgctgctgaagtggttcctacaagcttttaccaccacactgctccacttagtagctatggtttctactatggacttgaagctgaaaatgttggattgtattcagctttgccaatcatgcccctcaaatctgatggctctctctatggattggaaactttaagcaggtcacaagcacaagcaatggctactacttcaacaccaaaactggagaacttcttaggtggggaagccatggggacccctcatcactacgaatgtagtgccacagaaacaatgcctctgagcttagacagtgttttttacatccaaccctcacgccgtgacccaaataataaccaaacctaccaaaaccatgttcaacacattagcaccaaccaacaacaacaacagcaagagcttcaagcatattactctaccttgagaaaccatgatatgata

SEQ ID NO: 4 - DNA, 228 bp, Glycine max
  Clone ID: PAT_MRT3847_101254C.1
tccagatcttgcaaaaaaaaaaaaaacacaatggcagggagcgctcccactccacgcgaagagttcgtgtacatggcgaagctggcggagcaggccgagcgctacgaggagatggtggagttcatggagaaggactacgcctacgcctagagctaggagctgaccgtggaagagcgcatcctcctctgcgtaaactacttgaacgccttcagggctcgtagcgccttc

SEQ ID NO: 5 - DNA, 608 bp, Glycine max
  Clone ID: PAT_MRT3847_101657C.1
gatcacatttaaaatcaaaacaacaaattttcagactcaacaagcttcgaaccaaatcttattgagaaaatgtctggtcgtggaaagggtggaaagggtttgggaaagggaagtgccaagaggcacaggaaggttcttcgtgacaacatccagggcatcacgaaacctgcgattcgtaggttagcgagaagaggtggcgtgaagagaaccagtggtttgatctacgaggaaaccaaaggagttctgaagatattcttgaagaacgtgattcccgatgctgtgacctacactgagcacgctaggaggaaacctgttactgctatggatgtcgtttatgctcccaaaagacagggaaggaccctctatggctttggaggctaaagaatagaatctttaggtttaatgactgtgttgcaggataaaacattggttcttttgaatttgcgtgaagtttagtttaggttttggtttgttctgtaacatacgaagctatgtttgctcagaaaatgtaaaacttcaattgaaccctaaatgaaggagtgttgttttcgtggccccaaaaaaaaaaaaaaaaaaaaaaaaaaaaagcggccgctctagaggatcca

SEQ ID NO: 6 - DNA, 889 bp, Glycine max
  Clone ID: PAT_MRT3847_101658C.1
cttccagcgccctgaggctgcgacagctactgccaaggtggacccggaggagcagcgcaggcgtgaattattcgcgacccagtacctgaccggcgctagaaaacggcgacgagagacaggatgtggaattcaaaccaaaatcccaaatcctcaaattcgattcgtaccaaattttcttcacaaaatgtctggtcgtggaaaaggtggcaagggtttgggaaagggaggtgccaagaggcacagaaaggttcttcgtgacaacattcaaggtatcacgaaacctgcgattcgtaggttagcgagaagaggtggcgtgaagaggatcagtggtttgatctacgaggaaaccagaggagttctgaagatattcttggagaacgtgattcgcgatgctgtgacctacaccgagcacgctaggaggaagacggtgactgccatggatgtggtttatgctctcaagaggcagggaaggaccctctatggtttcggaggctgaatggattgattcttagtattattaaattatgttgcaggatataatattatgcctgttcttctgaaattcggtgtgatgtttagtttagattcgttctgtaacatatgaatcttcaaaggttctgttcggcacagaaaatgtactactttaattgaaattaaaatgaaggagcagcgttttcgtggtgccttatacatttttttccacggttatgaagattttttcgctgtggttcttaggttattgcattgtgtggattaatttgggggtaatcgaaaactgtgtttaggttctgtttttaatgtagtttttgattgtaaaggagtgatatgttacgcattaagtaactgacaaattttcaattggaaatgctaggatattagttggaattgt

SEQ ID NO: 7 - DNA, 645 bp, Glycine max
  UNSURE (1)..(645): unsure at all n locations
  Clone ID: PAT_MRT3847_101659C.1
  unsure (1)..(645): unsure at all n locations
gcttcgaggcncgggccgggtcgcggaaaaatcgcaaatcctcaaattcgatttcctaccaatttctctcgagaaaatgtctggtcgtggaaaaggtggcaagggtttgggcaagggaggcgccaagaggcacaggaaagttcttcgcgataacattcagggtatcacgaaacctgcgttcggtaggttagcgagaagaggtggtgtgaagagaatcagtggtttgatctacgaggaaaccaggggggttctgaagattttcttggagaacgtgattcgagatgctgtgacctacaccgagcacgctaggaggaagacggtgactgccatggatgtggtttatgcgctcaagaggcagggaaggaccctctacggttttggaggctaaagaatttaacccttcttttctgggttgcaggataagacattggttcttttgaatttgcgtggtgttttagtttaggtttgttatgtatcatacgaatctctggtttgcatagaaaatatttcatttgaaatttaaatggagtatcgtttctgttaggcatattatttcggctaaattagtttttttttcttctattctattttattatttaggtgtaatttgtttttttttatgttttgagattcaaatgatgattt

SEQ ID NO: 8 - DNA, 667 bp, Glycine max
  Clone ID: PAT_MRT3847_101660C.1
cggctgcgagaagacgacagaagggtacggctgcgagaagacgacagaagggtacggctgcgagaagacgacagaaggggatccaaattcaagttcgcaccaaattttcctcccaaaatgtcaggccgtggaaaaggtgggaagggtttgggaaagggaggagctaagaggcacagaaaggttcttcgtgacaacattcaaggaatcacgaaacctgcgattcgtaggttagcgagaagaggtggcgtgaagaggatcagtggtttgatttacgaggaaaccagaggagttctgaagatattcttggagaacgtgattcgcgatgctgtaacctacactgagcacgctaggaggaaaactgttactgctatggatgtcgtttatgctctcaagagacagggaaggaccctctatggctttggaggctaaagaatagaatctttaggtttaatgactgtgttgcaggataaaacattggttcttttgaatttgcgtgaagtttagtttaggttttggtttgttctgtaacatacgaagctatgtttgctcagaaaatgtaaaacttcaattgaaatctaaatgaaggagtgttgttttcgtggcgcatattttctcacgatgatttgttctattcattgttaatatgtcgtcaaggtttttgcatttg

SEQ ID NO: 9 - DNA, 996 bp, Glycine max
  UNSURE (1)..(996): unsure at all n locations
  Clone ID: PAT_MRT3847_101661C.1
  unsure (1)..(996): unsure at all n locations
ccacgcgtccgtacggctgcgagaagacgacagaaggggatcccatttgaaatcaaaatcaaaaacaccaaatcctctaattcaagtttgcaccaagttttcctgagaaaatgtctggtcgtggaaagggtggaaagggtttgggaaagggaggtgccaagaggcacaggaaggttcttcgcgacaacattcagggcattacgaaacctgcgattcgtaggttagcgagaagaggtggcgtgaagaggatcagtggtttgatctacgaggaaaccagaggggttctgaagatattcttggagaacgtgattcgcgatgctgtgacttataccgagcacgctaggaggaagacggttactgccatggatgttgtttatgctctcaagagacagggaaggaccctctatggctttggaggctaaagagttgtttttcttgttgtcccatgtgctcattttcttggatgctgaagatgtttaggttcattttgtaacataggatgcttgttcagtttaattttggatgtaaaatgttgaactatgattgaaattatatggactaattttttgttggtggaagtatagcttggaatggcctcacattgtttgtttgatattaggaaaatattgcagtgaattatgaaatgttttgacatggaaaaaaaaaaaaaaaaagggcggccgcccgcgatctagtgaaattaccagttactatactctctctttctgaaacaatttgcccaattgtttgagatgttcaatatgagatttgtatctcaagattgggtggtttcatgtgcactaatacttctggtgtcatgcacaacatactcatcagcttctttggggaaacctgagaacaacatanaaacatctgtttttaaatcacccaagattgagctaggtccagggttagtttcaacaaattttattttgatgttgactttccaagaggccatattgcactcaagagtttcaatgctgaattgggtgatga

SEQ ID NO: 10 - DNA, 584 bp, Glycine max
  Clone ID: PAT_MRT3847_101662C.1
tcttttgcgagaagacgacagaaggatacggctgcgtgaagacgcccacgcgtgcgcccaattcaaacagaaaacctaatttctcaaatttgatttcgcaccaaattttcctcactaaaatgtctggtcgtggaaagggtggcaagggtttgggaaagggaggtgccaagaggcacaggaaggttctgcgcgataacattcaaggaatcacgaaacctgcgattcgtaggttagcgagaagaggtggcgtgaaaaggatcagtggtttgatctacgaggaaaccagaggagttctgaagatattcttggagaacgtgattcgtgatgctgtgacctacactgagcacgctaggaggaagacagtgactgctatggacgtggtttatgctcttaagaggcagggaaggaccctctacggttttggaggctgaacaattctttttttggctgtgctcctatgtgcttgttctcttggatgctggtgatgtttaggttcatcctgtaacataggcttattcagctctagatgtaaaacgttgaaccgtaattggaattatatgaattagtacttttttgttggtggc

SEQ ID NO: 11 - DNA, 621 bp, Glycine max
  Clone ID: PAT_MRT3847_101663C.1
ccgggaattcaaaccaaaatcccaaatcctcaaattcgatttgtaccaaattttcttcacaaaatgtctggtcgtgggaaaggtggcaagggtttgggaaagggaggtgccaagaggcacagaaaagttcttcgtgataacattcaaggtatcacgaaacctgcgattcgtaggttagcgagaagaggtggcgtgaagaggatcagtggtttgatctatgaggaaaccagaggagttctgaagattttcttggagaacgtgattcgagatgctgtgacctacactgagcacgctaggaggaagacggtgactgccatggatgtggtttatgcgctcaagaggcagggaaggaccctctatggtttcggaggctgaatgattgattcttagtattattaaattatgttgcaggatataatattatgcctgttcttctgaaattcggtgtgatgtttagtttaaattcgttctgtaacatatgaatctttaaaggttctgttcggacagaaaatgtactactttaattgaaattaaaatgaaggagcagcgttttcgtggtgcattttatagcttaagctttttttctcttatgaaattgaagctcctgttgactttttctta

SEQ ID NO: 12 - DNA, 240 bp, Glycine max
  Clone ID: PAT_MRT3847_101916C.1
ccacagtccattgctgtggctccctctagtactactactactactactaattatggctatgaatatggtggccatttgcaagatcaagcttactacactcaacaacaaaccactaatgctacattgcttcctcagcaccaatccatgaccccagctgcagctgctgcagcactatcagatgctccaaaacagtatcctgcacacaacattcagcagtcaaatacagcatcacaaccagta

SEQ ID NO: 13 - DNA, 1158 bp, Glycine max
  UNSURE (1)..(1158): unsure at all n locations
  Clone ID: PAT_MRT3847_102149C.1
  unsure (1)..(1158): unsure at all n locations
cgtgctagggaaaaaagccttgactaatagtccataccataattttcctctttcctctgtgcctcgcttcttcttgaatccatgcgcatgagtttgaagaattgtgttagcggtgaggtgagatatttcaatatttgataattgatagtatatatatggggaggggaagagtggatttgaagaggatcgagaacaagatcaataggcaagtgacgttctcaaagagaaggtctggtttgctgaagaaagcgcgcgagatctctgtgctgtgcgatgctgatgtggctctcatcgtcttctccaccaaaggcaagcttttggactactccaaccaaccttgtacggaaagaattcttgaacggtatgagaggtattcgtatgcggagaggcaacttgttggagatgatcaaccaccaaatgaaaactgggttatagaacatgaaaagctcaaggctagggtggaggtactacagagaaatcaaaggaattttatgggagaagatctggacagcttaaatcttagaggacttcagagtttggagcaacaacttgattccgctctcaaacacattagatcacgaaagaaccaagccatgaatgaatctatttctgagcttcagaaaaaggataggtcactccgtgaacacaacaacttgctctccaagaagataaaggaaaaagagaaggagctgaccccacaagagcaagaaggactgcaaaataacatggatgtgacctctgtccttgtaactcaaccaccggagtccctgacaattggaggcttcccagaagccaaatgtaatgaagaaactccaacctcatgtcgacctaaaaccattcttcccccttggatgcctcttcctacaaatgaatagaagcctattcttgttaaatacgaataccacttgtacaaaggctagctatatacatcatcaggggcatttgatggtgactataccacctggattgtaatctctgtgtgacgtttctgactgcattttaatgcagctgcaaggtatattaaatgtactacatataaatataaatgatactgatataaaattgagtttgaaaaaaggttgaagttttgacttanaaaaaaaaaaaaaaaaaaaaaaaaaaaaaaaaaaaaaaaaaaaaaaaaaaaaaaaaaaaaaa

SEQ ID NO: 14 - DNA, 1147 bp, Glycine max
  Clone ID: PAT_MRT3847_102150C.1
cccacgcgtccgatgtaatacatgctaaaaaaagccttgacttcatagtccttaccctaatattcctctttcctcttcttcttcttctttctttcttccgccactgccgcagagcgtagaaggaaatcaaacagcagagagagggtaaagcatacgtgggttaaatccatgcgcatgagtcggaagaatttgtgttagcggtgaggagatatattgagaattaatatttgatagtgtatatatggggaggggaagagtggagtttaaaaggatcgagaacaagatcaataggcaagtgacgttctcaaagagaaggtctggtttgctgaagaaagcgcgcgagatctctgtgctgtgcgatgctgatgtggcttttatcgcattctacaccaaaggcaagcttttggactactccaaccaaccttgttctgaaagaattcttgaaccgtgtgagagggattcctatgccgagagggaacttgttggagatgatcaaccaccaaatgaaaactgggttatagaacatgaaaagctcaggctagggtggaggtactacagcagaaatcaaaggaatttgatgggagaagatctggacagattaaatcttacaggacttcagaggtgggagcaccaacttgattccgctctcaaacacattagatcacgaaagaaccaagccatgaatgaatctatttctgagcttcagaaaaaggataggacactccgtgaacacaacagcttgctctccaagaagataaaggaaaaagagaaggagctgaccccacaagagcaagaaggactgcaaaataacatggatgtgagctctgtccttgtaactcaaccactggagtccctgactattggaggctccccagaagtcaaatctaataaagaaactcccccctcatgtcgacctaaaaccattcttccccctttgatgcctcttcctacaaatgaatagaagcctattcttgttaaatacgaataccccttgcacaaaggctagctatatacatcatcagaggcatttgccggtgactatcccacctggattgtatttaatgctgctaggtatattaaatgatctacatataaaatgatactgatataaaattgagtttgaataaaggttgaagttttgacttaa

SEQ ID NO: 15 - DNA, 962 bp, Glycine max
  Clone ID: PAT_MRT3847_102634C.1
ccacgcgtccgcagtcatcatcaccaaagataagacagaaattgtgactgctacgagctcaaaagctctgaaggatgtagcatattctttcaatgaggatgaggaagaggaaaggccaagcacaaaaccagatgccaagaaagctgagccctttatgtctaagacaactcttaggtcagacaatcatgaagtttcaaaggaggagcttcgcaggcagcatcaggcagaacttgctcgtcagaaaaatgaagaaactgcgaggcgtcttgctggtggtggaagtgaaacaggagagtcccgttcctctgcgaggacttcagcagaactcatggcctacaagaacataaatgaccttccccctcccagagagatgatgattcagattgatcagaagaatgaagcagttctcttgcctataaatggaagcatggtaccttttcatgtggctttcattcgaactgtttccagccagcaggacaccaaccgcaattgctatgtcagaattatttttaatgttcctgggactcctttcagtcctcatgatgcaaactcaatgaagttccctggatctatatatttgaaggaggcgtcattccgctccaaggattcaaggcacataagtgaggttgtgcagtccattaaaacactcaggcgtcaagttgtagcaagggagtctgagagagctgagagggcaaccttggttactcaagagaaactgcaacttgctaataatagatttaagccaatacgattgtccgacctttggatccgtcctgcttttggtgggcgtggaaggaagatacctggtacacttgaggctcatgtgaatggatttcgttattctaccactaggcaagatgagcgtgtagacataatgtttcccaacattaagcatgcatttttccaacccgctgagaatgaaatgatcactctcctacacttgcatctggacaaccatatta

SEQ ID NO: 16 - DNA, 1929 bp, Glycine max
  Clone ID: PAT_MRT3847_103232C.1
agcacattgaagcagattgtcatttcttatgtatagggaaaccacttgcttcagcatggcttaaggaaccttgtgttgaaggaagttgcctcgtgggtttggaggaagagcttgaacaactcaggggtggaggcaacgacggttggcatggagccgaaggagagagagaataagaggccaagatcttggatagtaattaacctcactcaaactcgggatcacagaaaccaacaacagctcttgcactgaggtttcacgatgttgctggaacttgcacttggtttgtgtgtgttagcttggtttctgcacttgcgtcccacaccaagtgcaaaatcaaaagcacttcgccacctcccaaaccctccaagcccaaagcctcgtcctcccttcattgggcaccttcacctcttaaaagataaacttctccactatgcactcatcgatctctccaaaaagcatggccccttattctctctctccttcggtaccatggcaaccgtcgggggctccacccctgagttgttcaagctcttcctccaaacccacgagggaacttccttcaacacaaggttccaaacctctgccataagacgcctcacttacgacaactctgtggccatggttccattcggaccttactggaagttcgtgaggaagctcatcatgaacgaccttctcaacgccaccaccgacaacaagctcaggcctttgaggacccaacagatccgcaagttccttagggttatggcccaaagcgcagaggcccagaagccccttgacgtcaccgaggagcttctcaaatggaccaacagcaccatctccatgatgatgctcggcgaggctgagatgatcagagacatcgctcgcgaggttcttaagatcttcggcgaatacagcctcactgacttcatctggcctttgaagtatctcaaggttggaaagtatgagaagaggattgatgacatcttgaacaagttcgaccctgtcgttgaaagggtcatcaagaagcgccgtgagatcgtcagaaggagaaagaacggagaagttgttgagggcgaggccagcggcgtcttcctcgacactttgcttgaattcgctgaggacgagaccatggagatcaaaattaccaaggagcaaatcaagggccttgttgtcgactttttctctgcagggacagattccacagcggtggcaacagagtgggcattggcagagctcgtgaggaggtctacagctgttgtgggcaaagatagactcgttgacgaagttgacactcaaaaccttccttacattagggccattgtgaaggagacattccgaatgcacccaccactcccagtggtcaaaagaaagtgcacagaagagtgtgagattaatgggtatgtgatcccagagggagcattggttcttttcaatgtttggcaagtaggaagggaccccaaatactgggacagaccatcagaattccgtcccgagaggttcttagaaactggtgctgaaggggaagcagggcctcttgatcttaggggccagcatttccaactcctcccatttgggtctgggaggagaatgtgccctggcgtcaatttggctacttcaggaatggcaacacttcttgcatctcttatccaatgctttgacctgcaagtgctgggccctcaaggacaaatattgaaaggtgatgatcccaaagttagcatggaagagagagctggcctcacagttccaagggcacatagtctcgtttgtgttccacttgcaaggatcggcgttgcatctaaactcctttcttaattaagataatcatcatatacaatagtagtgtcttgccatcgcagttgctttttatgtattcataatcatcatttcaataaggtgtgactggtacttaatcaagtaattaaggttacataaaaaaaaaaaaaaaaa

SEQ ID NO: 17 - DNA, 2049 bp, Glycine max
  Clone ID: PAT_MRT3847_103233C.1
gataaaaagggtggtaggcccacaagaattgaattgaatacaacaacaaaattccccataagtagagtatggtggagtagatgcttataaattggaatcttagaaggttgtttcctcaggccaagagcttggaaaattagcctcacaaaagcaaagatcaaacaaaccaaggacgagaacacgatgttgcttgaacttgcacttggtttattggttttggctctgtttctgcacttgcgtcccacacccactgcaaaatcaaaagcacttcgccatctcccaaacccaccaagcccaaagcctcgtcttcccttcataggacaccttcatctcttaaaagacaaacttctccactacgcactcatcgacctctccaaaaaacatggtcccttattctctctctactttggctccatgccaaccgttgttgcctccacaccagaattgttcaagctcttcctccaaacgcacgaggcaacttccttcaacacaaggttccaaacctcagccataagacgcctcacctatgatagctcagtggccatggttcccttcggaccttactggaagttcgtgaggaagctcatcatgaacgaccttctcaacgccaccactgtaaacaagttgaggcctttgaggacccaacagatccgcaagttccttagggttatggcccaaggcgcagaggcacagaagccccttgacttgaccgaggagcttctgaaatggaccaacagcaccatctccatgatgatgctcggcgaggctgaggagatcagagacatcgctcgcgaggttcttaagatctttggcgaatacagcctcactgacttcatctggccattgaagcatctcaaggttggaaagtatgagaagaggatcgacgacatcttgaacaagttcgaccctgtcgttgaaagggtcatcaagaagcgccgtgagatcgtgaggaggagaaagaacggagaggttgttgagggtgaggtcagcggggttttccttgacactttgcttgaattcgctgaggatgagaccatggagatcaaaatcaccaaggaccacatcaagggtcttgttgtcgactttttctcggcaggaacagactccacagcggtggcaacagagtgggcattggcagaactcatcaacaatcctaaggtgttggaaaaggctcgtgaggaggtctacagtgttgtgggaaaggacagacttgtggacgaagttgacactcaaaaccttccttacattagagcaatcgtgaaggagacattccgcatgcacccgccactcccagtggtcaaaagaaagtgcacagaagagtgtgagattaatggatatgtgatcccagagggagcattgattctcttcaatgtatggcaagtaggaagagaccccaaatactgggacagaccatcggagttccgtcctgagaggttcctagagacaggggctgaaggggaagcagggcctcttgatcttaggggacaacattttcaacttctcccatttgggtctgggaggagaatgtgccctggagtcaatctggctacttcgggaatggcaacacttcttgcatctcttattcagtgcttcgacttgcaagtgctgggtccacaaggacagatattgaagggtggtgacgccaaagttagcatggaagagagagccggcctcactgttccaagggcacatagtcttgtctgtgttccacttgcaaggatcggcgttgcatctaaactcctttcttaattaagatcatcgtcatcatcatcatatgtaatatttactttttgtgtgttgataatcatcatttcaataaggtctcattcatctactttttatgaagtatataagcccttccatgcacattgtatcatctcccatttgtcttcgtttgctacctaaggcaatctttttttttttttgaatcacatcatctactataaactatcaatccttatattaattttgagttgccacatcatttatcccaatttcaatatttcattttcaatttaaaggggggggggggggggggggggggggagg

SEQ ID NO: 18 - DNA, 1889 bp, Glycine max
  Clone ID: PAT_MRT3847_103235C.1
cccgtacagagtcgtccactatgtggctataaaatggaagcattgaaggttgtttcctcaggccaagatcttggatagtaattaacctcactcaaactcgggatcacagaaaccaacaacagttcttgcactgaggtttcacgatgttgctggaacttgcacttggtttgtttgtgttagctttgtttctgcacttgcgtcccacaccaagtgcaaaatcaaaagcacttcgccacctcccaaaccctccaagcccaaagcctcgtcttcccttcattggccaccttcacctcttaaaagataaacttctccactatgcactcatcgatctctccaaaaagcatggccccttattctctctctccttcggctccatgccaaccgtcgttgcctccacccctgagttgttcaagctcttcctccaaacccacgaggcaacttccttcaacacaaggttccaaacctctgccataagacgcctcacttacgacaactctgtggccatggttccattcggaccttactggaagttcgtgaggaagctcatcatgaacgaccttctcaacgccaccaccgtcaacaagctcaggcctttgaggacccaacagatccgcaagttccttagggttatggcccaaagcgcagaggcccagaagccccttgacgtcaccgaggagcttctcaaatggaccaacagcaccatctccatgatgatgctcggcgaggctgaggagatcagagacatcgctcgcgaggttcttaagatcttcggcgaatacagcctcactgacttcatctggcctttgaagtatctcaaggttggaaagtatgagaagaggattgatgacatcttgaacaagttcgaccctgtcgttgaaagggtcatcaagaagcgccgtgagatcgtcagaaggagaaagaacggagaagttgttgagggcgaggccagcggcgtcttcctcgacactttgcttgaattcgctgaggacgagaccatggagatcaaaattaccaaggagcaaatcaagggccttgttgtcgactttttctctgcagggacagattccacagcggtggcaacagagtgggcattggcagagctcatcaacaatcccagggtgttgcaaaaggctcgtgaggaggtctacagtgttgtgggcaaagatagactcgttgacgaagttgacactcaaaaccttccttacattagggccattgtgaaggagacattccgaatgcacccaccactcccagtggtcaaaagaaagtgcacagaagagtgtgagattaatgggtatgtgatcccagagggagcattggttcttttcaatgtttggcaagtaggaagggaccccaaatactgggacagaccatcagaattccgtcccgagaggttcttagaaactggtgctgaaggggaagcagggcctcttgatcttaggggccagcatttccaactcctcccatttgggtctgggaggagaatgtgccctggtgtcaatttggctacttcaggaatggcaacacttcttgcatctcttatccaatgctttgacctgcaagtgctgggccctcaaggacaaatattgaaaggtgatgatgccaaagttagcatggaagagagagctggcctcacagttccaagggcacatagtctcgtttgtgttccacttgcaaggatcggcgttgcatctaaactcctttcttaattaagataatcatcatatacaatagtagtgtcttgccatcgcagttgctttttatgtattcataatcatcatttcaataaggtgtgactggtacttaatcaagtaattaaggttacatacatgcacatgtatcatctcccatttgtctttgtttcgtacgtaagacaatttttttttccc

SEQ ID NO: 19 - DNA, 2621 bp, Glycine max
  Clone ID: PAT_MRT3847_103671C.1
ctcttcatagatcaactctgccgcggttcgaggtaccggttgaaggcggtttgaaaattgccaaattctctctctctctctcagcttccactcaatttagccaacttttcagatattttcactgctcaacttaagactaagcatgagcagcagcagcagcagcagcagattgtttgagaatgggtgaagtgccggctgtgatgcaggcgacgcagggggaacagagcaacaatgcctccgctgttcattgggagcgctttctgcctcggatggtgcttcgggtcttgcttgtcgaagctgatgattctactcgacagatcattgctgcacttctccgtaaatgcggttacaaagttgttgcattttgtgatggcttaaaggcatgggagacattgaagaacaaagcatttgacttagatctcatattaacagaagtggatttgccatcaatatctggattttcacttcttactttaatcatggagcatgacatttgcaaaaacattcctgtcataatgatgtcttctcatgattcagtaagcatggtgtttaaatgcatgttaaaaggtgcagctgattttcttataaaacctgttcgcaagaatgagctaagaaacttgtggcagcatgtatggagaaggcacgccataagcaggcctcctcaaaatttaacactgccggagattgaacttggttttgctgcagaaaaccatgctgcaagcaatgactctagtggttctgtggcttctacaccaaaagatgatgaatgcagtgagaaaacaagtgaggctcatagcacttgcccatcgccatttttggaagctgagagtacctacatggaaaatatgcaggatatattgcagctgaagagctcttcaaatttgagcaatattgacacagtgaagcatgaaaactctaccaaatgtgaaagggagtcagataagcataatgatgaagctggagagaaatcactgtttatattggaagatgcaaggtgcaacaaaacttttaaaccaacaggtttaaggctaggtcaaagctatgagtgccatgaaacgagaaatcaagatgaagttctaagaatagagttgataaaatccaatcctgaaattaatacagatattcatagatgcagtgatgaactggtagatccttctactggcgccattgacttgattgctacattcaagaatcttccaaagagcactgatgaaaaatgtagtttcagtagtggtaacactgccaagtttgattttgatacacaattggaactttctttaagaagagattttcctggaagctcatgtaaagctgcattcaaggaaaggcaaatattgaaccattcaaatgcttctgccttttctaggtatagtaatagtaagttgttgcagcccctttttccaacaccatcaactatctctgctaaattaaccaatgccagtcagaattctcatgaatcccttaaattatcaaaaaatacatctacttctcatcaatatagtgaaaaaagtcaaaatcaggaggagaaaatcatcacttcagtcattggtcagtctggacaagttgatccaaaattaccaaacagtcaacttggattgtttcctgctacaggggttacttctgatcacaagtctaaaggaaatggaaatgtcttcccttctaagctttatgcaaaatcaggtgtccatcccatatcgactccaaaatcagtgtgccagaaagagagttctccatttcccacaagcacttcctcccagtccaatcctcaaagtcacaactcagaacgtcatcactggttggaagatgcaacccatgcttctgatcaaaatgtaaatgatcaaagcaatttggaatgtgagacacatgactctcctgctgctagtcagagtgctggtcctagttttttccatgacacagcaaatcataatagtagtggtgtatacagaagtgatggaaatgctacttcagctaaggtagccaaggagagccatgaaatttttattgatagtggtcaacgcagttatgatggattcatagggacagattctcatcgcactagccaacgagaagcagctctaacaaagtttcgactgaagcggaaagacagatgctatgagaaaaaggtgcgatatcaaagccggaagagattggcagagcagcgccctcgcgtgaaagggcaatttgttcgccaagtacacgatgatcatccagtagcagatgtgggtggtggttcctgaaattgttttgttaccatcatcattgaattacagtctgacttccaaaactgatttgcctctcttgacaaggattaactgtaggatctagtttgtctggtgaaattatgtttcttcttagcattgttagtattttcttctggtttgttatattggctgtctcttagaatgtaggattgtaattatttagtaggattgatttgaagttttgattttacctagagtatttgttttcttgattgaatactaatatagggctatcgttgtataggcagtatgcgtctgtcttgaaagattcaaataccttttatatatatatatatatatctcggcaagcatctctggtttgcaatcattaaacaaaaaaaaaaaaaaaaaaaagggcga

SEQ ID NO: 20 - DNA, 2785 bp, Glycine max
  Clone ID: PAT_MRT3847_103672C.1
actcaattcagccaacttttcagatattttcactgctcaacttaagactaagcatgagccgcaacttgtttgaaaatgggtctagtggcggctgacaagggttcgatgcagacccaagaggaacagagcgacaatgcctccgctgttcagtgggaacgctttctgcctcggatggtgcttcgggtcttgcttgtcgaagctgatgattctactcgacagatcatttctgcacttctccataaatgcagttacaaagttgtcgcattttgtgacggcttaaaggcatgggagacattgaagaacaaaccatctgacatagatctcatattaacagaagtggatttgccatcaatatctggattctcacttcttactttaatcatggagcatgacatttgcaaaaacattcccgtcataatgatgtcttctcatgattccgttagcatggtactcaaatgcatgtttaaaggtgcagctgattttcttataaaacctgttcgcaggaatgagctaagaaacttgtggcagcatgtatggagaaggcacgccataagcaggcctcctcaaaattttacactaccagagattgaaattggttttgctgcagaaaaccatgctgcaagcaatgactctagtggttctgtggcttctacagcaaaaaatggtgaatgcagcgagaaaacaagtgaggctcaagatatatcgcagctgaagaggtcttcaaatttgagcaatattgacacggtgaagcatgaaaattctaccaaatgtgaaagggaatcagataagcataatgatgaagctggagagaaatcactgtttgtatcagaagattcaaggtgcaacaaaacttttaaaccaacaggtttaaggctaggtcaaggctatgaatgctgtgaaacgagaaatcaagatgtagttctaaaaatagagttgatcaaatccaatcctgaaattaatacagatattcatggatgcagtgatgaactggtagatccttatactggggccattgacttgattgctacattcaagaatcttccaaagagcactgatgaaaaatgtagtttcagtagtggtaacactgccaagtttgattttgatacacaattggaactttctttaagaagaagagattttcctggaagctcatgtaaagctgcatctgaggaaaggcaattattgaaccattcaaatgcttctgccttttctaggtatagtagtagtaagttgttgcagcccctttttccaacaccatcaactatctctgctaaattaacaaattccagtctgagttctcatgaatcccataaattctcagaaaatgcatctacttctcatcaatatggtggaaaaaatcaaaatcaggagaaaattatcactccagtcattggtcagtctggacaagttgatccaaaattaccaaacagtcaacttggatattttcctgctacaggggttacttctgatcacaagtctacaggaaatggaaatgtcttcccttctatgctttatgcagaatcaggtgtccatcccatatggactccaaaatcagtgtgccagaaagaaagttctccatttcccacaatcacttcatcccagtccaatcctcaaagtcacaactcagaatgtcatctctggtcggaagattcaacccatgcttctgataaaaatttaaatgatcaaattaatttggattgtgagacacatgactctcctgatgctagtcagagtgctggtactagttttttccacgacacagcaaatcataatagtagcggtgtatacagaagcatgggctgcagaagtgatggaaatgctacttcagctaaggtagccaaggagagccatggaagttttattgatagtggtcactgcagttatgatggattcatagggacagattctcatcgcacaagccaccgagaagcagctctgacaaagtttcgactgaagcggaaagacagatgctatgagaaaaaggtgcgatatcaaagccggaagagattggcagagcagcgcccccgggtgaaagggcagtttgttcgccaagtacaagatgatcatccagtagcagatgtgggtggtggttcctgaaattgttttgtttcaagttaccttcatcattgaattacagtctgacttccaaatctgatttgcctttctcgacaaggattaactgtagggtctagtttgtctggtgaaattatgtttcctcttagcgttgttagtattttcttctggcttgttatattggctgtttcttagaatgtaggattgtaagtattttgtaggtttgttttgaagttttgattttacctcgtgtatatgctttcttgattgaatactaatatagggctactatcgttatataggcagtatgcttgtgtcttgaaagattgaatttttatttttttttatctcggcaagcatctctggtttgcaagcaaaactgatttgcctctcttgccaaggattacctggaggatatagtttgtctggccaaattatgtttaataaaggcattgttagcattttcatgtggtttgtacaccgcgctgtctcttagaatgtaggattgtatttgtcactaggattgatttgaagttttggttcaacccagagaatttgttttcttgataaaatactaatatgggggtaatcgccgcatagacagtatgggtatgtcttccaagcttcaaaaaccatttatataaaaaaaaaaaaatcacaacaagcaaaaaaaaaaaaaaagggcgacggccggccaccggctagtagctcg

SEQ ID NO: 21 - DNA, 1068 bp, Glycine max
  Clone ID: PAT_MRT3847_104342C.1
tgtgggaatacgtgttgaaatcgttttgcggtccttaatggtgcatgaaaaataaagcaaatcgcaaagccagagaagaataaaaagcctttctcccgggaccaatcaagttcattgtagcgagcagaaaccaacaccaaaccttaaaattattttgcccctctgcttctctctctgtctttctcagaagacaactcaaaaaaaccatggacgtgggtcagatgcagagacagtggatcgactacaccaaatccctcttccttgagggcttcctggatggtcagtttctgcaacttcagcagcttcaagatgagaacaaccctgactttgtggtcgaagttgtctctctcttctttgaagattctgaaaggcttctcaaagatctcacctttgccctagatcagaatggtgttgacttcaaaaaagttgatgctcatgtgcaccagttaaagggtagcagttcaagcataggcgcgcaaagggtgaaaaatgcctgcattgctttccgcaacttctgtgaggagcagaacacagatgcgtgcctcagatgtctgcaacaagtgaaacaagagtactgcattgtcaagaataagcttgaaacaatgttcaggcttgagcaacagattgtggcagctggtggatcaatccctacggaactgagtttcattgggtgactgagagggtttgtagagatgcttgtattatgatcctctttgttaaagattatcctttatcttattaagtccatggtgaatgtatgggtttttataaaatagaagttttccatccaatgtacctttttcttcaccaaaaagctcttcataatttgtaatcttttgcatgctttaatgaaggatgatagcaccattaattgaactttcctcttttatctctcttccaaacaaggaagcagaactgagtttcagtggatgatgggtgggtttgtagaaatgcttgtaaaaaaaaaaacttctttgttaaagattatcctttatcttatttagtccatggtgaatgtatgggtttttatgaagatagaagttttccatccaatgtacctttttcttc

SEQ ID NO: 22 - DNA, 832 bp, Glycine max
  Clone ID: PAT_MRT3847_104343C.1
ctcgagccgattcggctcgaggttgttttgtgtgacagacaacagaggaacactcccaaacaaaccatggacgtgggtcagatgcagagacagtggatcgactacaccaaatccctcttcctcgagggcttcctggatggtcagtttctgcaacttcagcagcttcaggatgagaacaaccctgactttgtggtcgaagttgtctctctcttctttgaagattctgaaaggcttctcaaagatctcacctttgccctagatcagaatggtgttgacttcaaaaaagttgatgctcatgtgcaccagttaaagggtagcagttcaagcataggcgcgcaaagggtgaaaaatgcctgcattgctttccgcaacttctgtgaggagcagaacacagatgcgtgcctcagatgtctgcaacaagtgaaacaagagtactgcatagtcaagaataagcttgaaacaatgttcaggcttgagcaacagattgtggcagctggtggatcaatcccttgggtgactgagagggtttattatgatcctcgtttgttaaagattatcctttatcttattaagtccatggtgaatgtatgggtttttataaagatagaagttttccatccaatgtacctttttcttcaccaaaaagctctccacgcgtccgatttgtaatctcttgcatgctttaatgaaggatgatagcaccattaattgaactttcctcttttatctctcttccaaacaaggaagaaaattagtggtgacaacacaatacaatcctttcaacaccaaatagtctaaatgaacatctgaattatgaataccttagttggat

SEQ ID NO: 23 - DNA, 1286 bp, Glycine max
  Clone ID: PAT_MRT3847_104344C.1
ccggaattaccgcgtctacccacgcgtccgcggaacagtgggcgaacgcgtggggaaaaataatttgcttctctctctgtctttctcacaagacaacagaggaacactcccaaacaaaccatggacgtgggtcagatgcagagacagtggatcgactacaccaaatccctcttcctcgagggcttcctggatggtcagtttctgcaacttcagcagcttcaggatgagaacaaccctgactttgtggtcgaagttgtctctctcttctttgaagattctgaaaggcttctcaaagatctcacctttgccctagatcagaatggcgttgacttcaaaaaagttgatgctcatgtgcaccagttaaagggtagcagttcaagcataggtgcacaaagggtgaaaaatgcctgcattgctttccgcaacttctgtgaggagcagaacacagatgcgtgcgtcagatgtctgcaacaagtgaaacaagagtactgccttgtcaagaataagcttgaaacaatgttcaggcttgagcaacagattgtggcagctggtgggtcaatccctacggaactgagtttcagtggatgatgggtgggtttgtagagatgcttgtattatgatcctcttctttgttaaagattatcctttatcttattaagtccatggtgaatgtatgggtttttataaagatagaagttttccatccaatgtacctttttcttcaccaaaaagctcttcataatttgtaatctcttgcatgctttaatgaaggatgatagcaccattaattgaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggacccaattttattaccccgggcttgcaaaaaaaaaaatttttttaagggggcccctaaataaaaaaaagggcccccgttttaaaaaccggggagggggaaaaaccttggggttcccaaatttaaatgctttggggaaattcccctttttcccaagggggaaaaaaacgaaaaaggccccaaccaatgcccctttccaaaaattgcccatacttaaaggggaaaaggaaccccctttttctgggacatttaatccgggggggtgggggggttaccccaagagggacccttccctttgtaagggcccttaaacccccggcttttggttttttcccttccttttaaccc

SEQ ID NO: 24 - DNA, 1973 bp, Glycine max
  Clone ID: PAT_MRT3847_104458C.1
gaaaagggacaaactccgcagcacgacctttactaaaagatgagaagaaaatcaaatctgttttggtactatagtaaaagttgaagttggggaagtataaagtgaagtgtggtgttatttcgaactgaacatcagcctccacagcactactggtatatatggattcgctgcttcttcgatctttccctaatattaataacgcctcttctctcaccaccactggttcttatttgccaaatgcttaatggcacaatatgaaaatccaaaaataatatacttttttgagcttcgatggtcatatttgccaaacactacatagcattatagagaaattccaaacactgggatgcaaatttctccaggactaaatctttcgcgtttattttgagaagtgagcattggtgatggtagtctcaatcagttgaatctcttgtgtctttctcaagataatttgcctgagctcaacatttgatgccctaagttcttatttgccaaatgcttcatggcacaataggaaaatccaaaaagaatataattttttgaggtttcggtggccaagtttgaaccaccattacaaaagcattgaaggagcgtgtacatgtaaaaaatgtaatataaaatttgttgtgaaagcgacctctgaaaaatcttttgagtctgaacctcaagcttttgatccaaaaagcattttggactctgtcaagaattccttggatgctttctacaggttttccagacctcacacagttattggcacagcattaagcataatttctgtgtcccttcttgctgttgagaaaatatcagatatatctccattattttttactggtgtgttggaggctgtggttgctgccctgtttatgaatatttatattgttggtttgaatcaattgtctgatgttgaaatagacaagataaacaagccgtatcttccattagcatctggggaatattcctttgaaactggtgtcactattgttgcatctttttcaattctgagtttttggcttggctgggttgtaggttcatggccattattttgggccctttttgtaagctttgtgctaggaactgcttattcaatcaatgtgcctctgttgagatggaagaggtttgcagtgcttgcagcgatgtgcattctagctgttcgggcagtaatagttcaacttgcatttttccttcacatccagactcatgtatacaagaggccacctgtcttttcaagatcattgatttttgctactgcattcatgagcttcttctctgtagttatagcactgtttaaggatatacctgacattgaaggagataaagtatttggcatccaatctttttcagtgcgtttaggtcagaagccggtattctggacttgtgttatccttcttgaaatagcttatggagtcgccctcctggtgggagctgcatctccttgtctttggagcaaaattgtcacgggtctgggacacgctgttctggcttcaattctctggtttcatgccaaatctgtagatttgaaaagcaaagcttcgataacatccttctatatgtttatttggaagctattttatgcagaatacttactcattccttttgttagatgaggatgcagcggcaatattgacttgagaattagttttgtttaaatggtgctgcctttgtcacaggccggcttggagtcgctacattagttttaagtttttaattgctaatttaaatgaagatatatttcttttgggatgaaattttgtttactgctttgttttcagtggtttctccaatgattttttcaaacaattactattttaaaaaaaaaaaacactaacaaactaatggttcaagcatcattattacttctaagataatttcatttttaacagattatgtgttttgagaaaacaatactagatacaataactttgaatatttataatatggactttatataggagaattattatgtaatcagtgat

SEQ ID NO: 25 - DNA, 492 bp, Glycine max
  Clone ID: PAT_MRT3847_104508C.1
gggaaagaggaggagatgacaggctcagcagatccattggtgatatcattcggtgagatgctcatcgactttgttcctgacacatctggtgtctccttggctgagtcttgtgccttcatcaaagcccctggaggtgcccctgccaatgttgcttgtgccatatccaaactgggcggcaatgctgccttcgtcggcaagatgggagatgatgagtttggaaggatgctagttgacattttgagaaaaaatggggtgaacacagatggtgtttgctttgatacggaggcaagaactgcattggcttttgtgacattgaggaaggatggagagagggagttcatgttctatagaaaccccagtgcagatatgttgctgaaagagtctgaattgaatatgggtttgattaagcaggctaaggtatttcactatggatctattagcctgatatcagagccatgcagatcagctcacttggctgccatgaaagttgct

SEQ ID NO: 26 - DNA, 594 bp, Glycine max
  Clone ID: PAT_MRT3847_10478C.1
ctcgaggattgaagccgtggtcattgccaccggcgttcataccttctttgggaaagctgctcaccttgttgataccactaatcaagttgggcactttcaaaaggtgttgactgcaattggaaacttctgcatatgttcaattgctgtggggatggttattgagattattgttatgtatcccattcaagatcgagaatatcgccctggaatcgataaccttcttgtgcttcttattggtggaattccaattgccatgcccactgtcctctcagtgactatggccattggttctcacaggctatcacagcagggggctatcacaaagagaatgacagctattgaagagatggcaggcatggatgtgctttgcagtgataagactgggaccctaacactaaataagcttactgttgacaaaaatcttatagaggtttttgcaaaaggagtggatgcggatactgttgttttgatggcagctcaagcttcaagacttgagaatcaagatgcaatagacactgccatagttggaatgttggctgatcccaaagaggctcggcttggtatccaagaagtacattttcttcctttcaatcc

SEQ ID NO: 27 - DNA, 1636 bp, Glycine max
  Clone ID: PAT_MRT3847_105008C.1
ccacgcgtccgcaactacacttcagatctggcaccatcaccccaaacctaaaaaacaaaacatcatcgtactatttcccatttggcggcgcggcgatggtggaggcgcagacatggacgacgcggcgaatgagcaaccctcggctggacaccagcacgacggaccaagtactggacattccccccacacccccgggggagctccgcaacagcttcggatcgaaccctaacaacctctccccgaccctgttaactgctctcatcatttcatcttggtacctctcgaacatcggagttcttctcttaaacaagtacctcctcagcttctacggctaccgcttccctatcttcctcacaatgctccacatgctatcatgcgccgcttattcctacgcctccatcaacttccttgaactcgttcctctccagcacatccactccaagaagcagttcctcaagatcttcgctctcagcgccatcttctgcttctccgtcgtctgcggcaacacctccctccgctacctccccgtctccttcaaccaggccatcggcgcaacgaccccgttcttcacagcgattttcgcgtttttgatcacatgcaagaaggagaccggggaggtttacctcgccctgttgccggtggtgttcggtatcgtcgtggcgagcaacagtgaacccctttttcatttgtttgggtttttggtctgtgtcggttccaccgctggtcgcgctttgaagtctgtggttcaggggattttgttgacttctgaagcggagaagcttcactccatgaacttgcttctctacatggcacccttggcggcgatgattttgttgccgttcacgctctacattgaaggaaatgtgctggctttgactattgagaaggcgaaaggtgacccctttattgtgttcttgctgcttgggaatgccaccgtggcttatttggtgaacttgacgaatttcttggtgacgaagcacacgagtgctttgacgctgcaggtgttggggaatgccaaggcggcggtggcggcggtggtttcggttttgatcttcaggaatccggtgacggttatgggaatggccgggttcggaatcaccataatgggggtggtgctttacagtgaggccaagaagaggtccaaagttacgactcattgattcattcgcacgcacgccgttttggtttcttttttggcttttatcataacaccttattcttcgggtatttttctttctttctttgtttttattgatattgcacaatttagtttgatttaattttatcattatatttccgtggaattgggtcgaattaattacagcaattggactgtataggaaggaaggaaggagaagcagaaaatggggtgggagtgggagggattattattacttggtgttgttgttgggtttctgttggccgttgtgtaagcttatatatgaaacgctctatgccctttggcaacatacataaaaacgttcaaagaacgaaaaaccttatgtgtatttggctagggaggaaaattctccctccctgcattttgttgatcacatcatcatccatttttttttggcttttttgtcatttggtgttttgttagctttaattttgattcgtttgtgaggttcgagct

SEQ ID NO: 28 - DNA, 3861 bp, Glycine max
  Clone ID: PAT_MRT3847_105313C.1
ggcgtgataccatttaatttgacagcgattaattatttatagttaagtgtggagtgcagtgcaggtcaaggcctgagattcggtcgcacccggggtgcccccccatatccccggcccaccacgcttgacagagaactggtgacccacattggttggggtggcctctttctttgcttcttcttcccaattgattgaagcaaatccatctatcggagtctgcatgattgctttagcattttttaaaaaaattcttctgcaatctgcttaagaattcaagtgaatatctgaggagatttctttttgtagttttaagtatataatccttttatcaatctctacaatactttggttagagagtttttctctctttttttcttttgttttctagtaaaaccaaaaaaatccacatgtttgtgtttgttaaggaattaggaaaacacacaaacatgataacacaagccaacaaaacaacaattaaaacacacccagagagagagaggtacagagtgacacaacacactttaaggctttgctttaactactgagctactacagaagtggccatccttttttttttttttttcttttcatttgtagttttgtaccttcctttcttttttgtttcttctcccttaccatttttttctctcgtctctcaagcataataggttaggtgattgattctgttttcttcatagcaggatttttcactaatcttttttcttcttcctttgttgcctttgaaattattctctagtccttctggccaaaccaaaccatattacaaattgatgtctaatttgtacaatcagatttccttaccttcaccccaaggagccaattcaccaaacataaacatgagaggcaattttgatgttgatagtcagtacttaacggagctgctagcagaaactgcgacgacagaagcttggacctttcatgcaagttctacccttatgtaccagactccttaatcaagagattttaagggttaccggaaagaatgaattattgcagaaccaaggatttagtgactttgatagaatgcgattcataaatctgagtcatatggcttctccaaactcaacaccaaacttcactggctggaacagcctgtcacatgaactggtgtgcagggactaaacatggattggcaaacttcaccagttgttccaagttctcccattgtgaagaagatattgcgcttggatattcctaaggatagctatccaaattttaattttgttggccggcttcttggccctaggggcaattcactgaagcgagtgggagctactacaggttgccgtgtatttatcagagggaaaggttcaattaaagacttagacaaggaagaaatgctacgaggaaggcctggctatgagcacctgaatgatccacttcacattataattgaagctgaactacctgccaatgttgttgatgtaagattgatgcaagcacaagaaatcatacaagagctacttaaacccatggatgagtcacaggatcttccacaaaaggcaacaactaagagaacttgctatgctgaattccaattttagagaagatagccctcaactcagtggtagtccctctacattcaactccaattaaatgaagcgggccaaaactgaccaatagctgtgtctacattgagaatcgtagtgatgtcagtttccagtaattaaatttcaaaggggttactcttaggtactaaaatagagactgtatttatcctgagggaaattgaggcggttctttacttgttgggttgttctgatcttctctcatagcaatcaaatcacactcccatcttttttttttttaagtgtggagtgctgtgcagatcaaggcccttttacttgttcgtccggttgttcccatcttctctctcgtaccaatcaaatcacacttttgtgttgtgttgggaaaccctaaaccccgttttcggtgagatcgagatcgatcgaacatggatgaggagtacgatgtgatcgtgttgggcacgggtctcaaggagtgcattctcagcggtcttctctccgtcgatggcctcaaggttctgcatatggataggaacgactattacggaggagaatccacttcgctcaatcttattcagctttggaagagattcaggggagatgacaagcctcctccacatttgggcgctagcagggactacaacatcgatatgaaccccaagtttattatggctaatggcaatttggtgcgggttctcatacataccgatgttactaagtatctctatttcaaagctgtggatgggagctatgtgtttaataaaggaaaggttcataaggtgcctgcaaacgacatggaggccttgaagtccccacttatggggctatttgaaaaacgccgggcacgcaagtttttcatttatgtgcaaaactacaacgagagcgatcccaagacccacgaggggatggacttgacaagagtgactactaaagagttgatagcaaaatacggccttgatgataacactatagacttcattggtcatgctttggcgcttcatagcgatgatcgctacttggctgagccagcactggacaccgtgaagagaatgaagttatatgcagagtctcttgcacgctttcaaggagggtcaccttacatatatcctttgtatggtttaggagagcttccccaggcatttgcacggcttagtgctgtttatggtggaacatatatgttgaataagcctgagtgcaaggtagaatttgatgaggaaggaaaggttgttggtgttacatctgaaggggaaactgcaaagtgtaaaaaagttgtttgtgatccatcatatttgcctggcaaggtgaggaaggttggtagggttgcaagggcgatagccatcatgagccacccaatccccagcactgatgattcccattcagtgcaaattattttaccacagaaacagttgggtcggaagtcagacatgtacctattttgttgttcgtatactcacaatgttgctccaaagggaaaatttattgcatttgtatcaactgaggcagagacagatcagccggcaattgaactgaaacctggaattgaccttctaggacctgttgatgagatattttttgatatctatgacagatatgaaccagtcaacgaacccactttggacaactgctttatatcaacaagttatgatgctactactcactttgagtcgactgtggatgacgttctcaacatgtatacattgataactggaaaggttattgacctcagtgtggatcttagtgctgctagtgctgcagaagagtaaagaaaactcggtgatgatctgttgctgatgggttccgtgatgatggacttgacaacgaatgttattaacgttttataataaatattttctttttttaaaacaagatttgtgtggctggggaactttttcccgtccagaagctctgttgtgtgttcacatacattgccttctgcagtggttttagtttggtaatgtagtgttattttcatattgttaaatgttaattgcacgtctctccaaccatttcatacccctggcaatttgtgtttggatacttttatctttcattagttgaaactcatgtgggttgtattaatcttcattttaattcaaaaataaaaaaaattataaaaaaaaagggaaaaaaaacgggagggggggcagatattcattgcccccatcaattgtatcaatagacttgtaaaactaggagaatttcattattattatattttgaccgattgattagtatatatatttgtagtgtctgctgggacttacaaactgattattgttggttattactgaatggaaaaaagtgtttgatgtgt

SEQ ID NO: 29 - DNA, 1182 bp, Glycine max
  Clone ID: PAT_MRT3847_105406C.1
cggcaccagggctgagtagaaaattgcaatccctgggtttggaaatggcagcggcaggttgtcagaagcttctggaattgagcacgaagatcgtcgctgttggcagaaactacgctgctcatgccaaagaactaggcaacgccgttcccaaggagccggtgttgtttctgaaaccgacgtcgtcttacttgagtaacggcggaaccattcaaatcccacacaacgagggctctctgcatcacgaggttgagctcgctgtggtcatctccaagaaagcccgtgacgtctccgaatcctctgccatggattacgtcgccggttatgcactggctctggatatgactgctagggaccttcaagctgctgctaagtctgcaggtcttccatggagtttggcaaaaggccaggacactttcacccctattagctctattttgccaaagactacagtgccgaatcccgatgatctagaattatggttaaaggttgacgaggaaattcggcaaaagggctcaaccaaggacatgatatttaagatcccatttctgattagctacgtaagctctgtcatgacattgtttgaaggagatgtcatactaactggtactcccccgggtgttggccctgtgaaagagggtcaaacaattactgctggtattacaggccttgtggacgtacagtttaatgttgaaaaaagagcaaggcctgttctttcttgataactcctcgagggtacttcagttatacatcaaatatcttgccaaaaggaaacttgtggacacaataaaaattcagttatatggacttcagagtctatacgatatttaacagtttttttttaatggtcattgaatcagtaccatacacttgccaaaaggaaaacattggacttaattaaaattcagttatatggacttgagagtctacgatatttaacagtttatttttttgtaatggtcgtcgaatccgtactatagatcttttggagtgctattttagacttttgtcatgaaaatgattatgatgatgggcgactttctatttatggtggatgtgcttttttatactgtggacaataaggattataatggagcgcatatggattccttttaaaaaaaaaaaaaaaaaaaaaaaaaaacaaaaaaaaaaaaaaaaaaaaaaaaaaaaaaaaaaaaaaaaaaa

SEQ ID NO: 30 - DNA, 2929 bp, Glycine max
  Clone ID: PAT_MRT3847_105522C.1
cgtcgaatgcttctggcacaggcactgtggcggtggcagcggctgcagctgccgctgccccaacgatgagcttcagctatccaaatatgcctggcaatgaaactccgtacttggccattttgcagaataatgcttactcatttccaataccagcacatgttggtggtccacctggctaccgtggaaccccccatgcccaggcttttccattcttcaatggctccttctattcttctcaaatgctgcatccttcacagattcagcagcagcaacttcctgctcagtcacagcagcagagccaacagggccatcaaaatgcaagtatgtctagtggatcatccacctctcagaagcagcatgctcaaaaccaacaacaaaagcctaataataatgctactgggtccaatgggggtggaagcttgcaaggctttcctgtcaccaaaaacccaccatcactgccactgcagttgcaacagcaacagccgcagcagaggcagaatcatcacccttctcatccagctcgccaggttgagtctgagatgggtggtgaagacagtccatctactgctgatagtcgcctcgctcgcgctaccatgaatatttatggccaaaattttgcaatgcctatgcagtcgcctaactttgctttgatgacacctgcctcaattagtgcagcaggctctaacggaggtcacggtgaaaagaaacaaccccagcagcaccctggtccaaatgatgccgtacgtggaaaaagcaagcaaactggagtaggtcacggccaacgaagatagagatgatttggattcctcaattttggatgggaaatcgaccagaccaagaacattgatgtgcctgaattgtgtttagttatttgtttgtaccctggtgtttataaatctgacaaggttgatcctgaagtctaatcaaaattcgattggttttttcagaaggatgtggtggggaaaaaaagatggaggaaaggaagggaaagaaccatcttttcttcttttggggatgtaatggagtttacctacatgttctttctcctcatcttttctttttagttattttattttgtcttctagggctacttgggcagcagtaacctggttctgcttcttctcgggcttctacttctgttatgcctgctggcatcagcactaatccagccagttctcagcaacaaatgcagcgaaatcagcagcagcagcaaattcttcagcatcagaagcagaatcaatttgcagctgcagctgccgccgctgctcgcaacaagaccccatcaacaagcaatggcagtgtttactctgataacctcccctctacatcttcaatggctaataagtttcccagtgccgtatccgcatttcctcaaagccttgtacagagcagtaacaccgttgctcagtcacctcagtggaagaactctgtaagggcaacgaccacttcacagtcgcccccatccatggcttcaacaacaccgccctcatcagtcaaaaaccttccacagcagcaggctcgttcccagcaacctcacacccaaatatctttcgcgacaaatccaaaatcatcagcagcacaagtgcaaccttcaagttcgacccagtccccatctcccccagtcatggttggctcaccaacgacttcatcaatgtcgaaaaatactggtagcccaaggacaacatcagcttcaacaaccaacaataagataagccaaagttcttccttatcctctcagcaagccaagaactcttctgctgtgccggcccgtaaatcgtctcctgttggcagcaggaatgtgccatcaatactcaatgttcctcagctaactccctcttccagcactgggagtaaatctcaattgccacagaagcagcagccgcagcagcaaataccaaagcaagcattacaacaggcccagcttttgttctctagtccttacgtgcatccgcaatccaacagtaccacatccaccaccacagttccaagtggttattaccttcaacatcaacaacggcgtggccctgagcagatgcagcgaccgggctcttcccctgccgtaaacaatgtgaaaggcagcagtgccttacctacacagggtcttttgcatcctgcacaggttgctgcaatgcaaccctctgggagccaccctcagtttgttcctactggcttttcttatgcttcttatcatgttcattctgtgccctcagttcaagtgaagccagcggagcagaaacaacctgcgggtgagtagaatgatataatatcctttatttgctgcacccctgtgcttgcggttatcaaagaagaaaggtatatagcttgagtgaagcatgtgaattggcatgggattttgaagtgcaagatggggtccctctcaaatggtgggggtaaaatgtcatgttgttatgttgatgatggaatgccgtatgtggaaaaagcaagcaagctggatggagtaggtcacggccaacgaagatagagatgatttggattcctcaattttggaagagaaatcgaccagaccattgatgtgcctgaattgtgtttactaatttgtttgtacccttgtgtttataatctgacaaagttgatcctgaagtctaaacaaattcgattggtttttttagaaggatgtggtgggaaaaaaaaggataaagaaaagatggaggaaaggaagggaaagaaccaccttttcttcttttggggatgtaaaagagtttacctacatgttctttctcctctcatttcttttctcttttatttattttgtcttctagggctactagagcggtaaacaaacatctttttgacaaagtctatgtggctaatcatatattatagtaaccctcaatttttacgtgtcttctagggctactagagcagtaaacaaacatctttttgacaaaaaaaaaaaaaaaaaaactcg

SEQ ID NO: 31 - DNA, 1510 bp, Glycine max
  Clone ID: PAT_MRT3847_105727C.1
ccaacttcaatccacgatgggtacactctcactcttcttgcagcatctctctccattaccttcataactcaatctcccattattattagagatgacggttgaaaaggaagatttgggtttgagtctaagcttgagcttccctcagaaccccccaactcatcttcatctcaatctcgtttcctcttctccttccagccacaaccctcagaaaccctcttggaacgaccctttcacttcttcagctggatcatcattccttcgaggaatcgatgtgaaccgtttaccttctgtggttgattgcgaagaggaagcaggtgtttcatctccaaacagcacggtttctagcgtcagtggaaagcgtagcgagagggaagaagccaatggtgaagaaaacgacacagacagagcttgttccagaggcatcatcagcgacgaagaagatgctgaaacctctagaaagaaacttagactctccaaagaccaatcaattatcctcgaagagagcttcaaagaacacaacactctcaaccccaaacaaaagttggcgctggcgaaacagctgggtcttcgagcgagacaagtggaggtgtggatccagaacagaagggcaaggaccaagctgaagcgaacggaagttgactgtgagtttttgaaaaggtgctgcgagaatctgaccgtggagaacaggaggttgcagaaggaagtgcaagagcttagagcactgaaactttccccgcagttctacatgcacatgaccccacccaccactctcaccatgtgcccctcgtgtgagcgtgtcgcggttcccccctcctccgccgttgatcctgccatgcgtcaccatcacgtgcctcctacacaacctcgggccttccccattggcccatgggccaccgctgccgccactatcccgcacaggcccttcgatgccctccgtcgcagatcttgactcgtcgaaacaaaatgacaaaatttgaaaaaaagaaaacggttgtaatagtaggaagccatgaattatgtgttcaaagtgtggtctaagatatggtggttaggaaaactgattttgtgggtctctaatgttttgtactagtttgacccttcgtctttgttttgggtttcggagcatgacctggtttagttagttagaggtttttttagtttgtaatacttactgcgttactctcatttctcatgattaaatcggagattctgtaaagttcagtagtcttaataaatattatatattacatataggttactctcgtaagtaaagattaaacccaaaaatataaataaagtttaatggtcttaatcccccgtttccccttttgcggtcttgtgtgaccccccctaattgcccgtattttacaaacgacgcgattggaaaacccttgggtttcccaaattaattggcttggcagcaaatcccctttttcccagttggggaaaaagaaaaaaggcccggccggatcgcctttccaacaatttgcgaaccctgaatggaaaatgg

SEQ ID NO: 32 - DNA, 315 bp, Glycine max
  Clone ID: PAT_MRT3847_106565C.1
gggaacatgaatttgttccttaccaactagacctattttggtataaaaaaaacattttttttttttaaataaaagtaaaacagaggggaaaaaatgaaaatttgattttaattcccctagatttaggggcttttacttcattttttccatttggaataagggggcaaaacgagcttgagagtaacagatcccccgtaaaaagaaggggaacccccagggctgttgggccttaaacaaacaagatccccatttttccttggctttataagaatttgaccaaaaaatgaaattgggtttttgaaatctttatcaatg

SEQ ID NO: 33 - DNA, 950 bp, Glycine max
  Clone ID: PAT_MRT3847_10661C.1
ccacgcgtccggactagttctagatcgcacatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcccttcttcccccatacctctcaccagcggtgtcttcagtatgtgaaaacccaattcttcaaccctacaggatccaacaggcaatcgcagcaggcatcttacctttatcacccttgttcctccaacaatcatcagccctattacagcagttacctttggtgcatttattggcacaaaacatcaaggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacccaacagcattctaccaacaacccatcattggtggtgccctcttttagatttcttatgagttatagttcaataataaagttttttgtctgatgtttgtggcttcccagaaataagaaagtacatttctagattcttaccaacagcccatcattggtggtgccctcttttagatttcttatgagttatagttcaataataaagttttttgtctg

SEQ ID NO: 34 - DNA, 309 bp, Glycine max
  Clone ID: PAT_MRT3847_106796C.1
aatacggtacacatttttacacgacatgtttcgtgagctgcaaaatgagaaataaacttacactttaggctcaccgttggagggataaaaaaatgatatgcaaaaaccaaaggtagcctttatgttactgcatatttcaaacctcaagtctaagttttcccttccaaacgaattctctaacaaccttgctctacaccttgattgctgattgctccaaccctatttcgcttggcctacatggaacatctttcgtagggtttaaaacctgttccatgagtcataagctattcttgtacaagccatatggtt

SEQ ID NO: 35 - DNA, 2057 bp, Glycine max
  Clone ID: PAT_MRT3847_106878C.1
agtgatttgatttgcatcaatatggatcactaaccttgctggtggctggtgcatacaatagtatttgtaccaaacctcttttttcttttgggcacgtgtattgttttttatttatgaacccaactccatccatcattgttgggacgaactcaacaagctagatcagtagtatatatcatcaaattcaatagtctcttctccatttaatagatggttgaaaaatcttccagaaccaaccttggccaccatcaagattttggcatggaggcttactccatagatggtgtttcttcacaaagtgagtccaaattctacgatgatgatggtcatgttaaacgaacagggaacgtttggactacaagctcgcacataataacagcagtggtgggttctggggtgctgtctttggcatgggccatggctcaaatgggttgggttgctgggcctgtagttatgatcttcttcagtgctgttacgttgtatacgatgtagtttctggctgattgctgtcgtcacgttgttaccgttacgcggaagagaaactatactttcatggatgcagttcaatccattctaggcgggtattatgatacgttttgtggggtagatcagtactctgttctttacggaaccgctgtaggatacacaattgcagcttctattagcatgatggcgataaaaatccagattttcatgaaatctggtggctctccatagttgcagcaatcatgtctttagtctatcccacaatggggctccataatccaaattttattttctcaaattccagattttcataaaacaggctcgctctccatagttgcagcaatcatgtcttttgtctattccacaattgggctcgctcttggcattgctaaagttgcagaaatgggtactttcaagggtagtctcacaggagtaaggattggaactgtgaccgaggccacaaaagtatggggggttttccaaggtcttggtgacatagccttcgcctattcatattctcaaattctcattgaaattcaggacaccataaaatctccaccatcggaagcaaagacaatgaagaagtctgctaagataagtattggagtaaccacaacattttatatgctttgtggcttcatgggctatgctgcttttggagattcagctcctgggaacctgctcacaggatttggtttttttaacccatattggctcatagatattgctaatgctgctatcgtaattcaccttgtgggagcataccaagtttatgcccacccatttagattagtttggagaacagtgtttgttatcataaccacttttgtagcaatgttgattccattcttcaatgacgttttgggacttcttggagcactggggttttggcctttaagtgtttttctcccagtgcagatgagtatcaaacaaaagaggaccccaaggtggagtggtagatggattggtatgcaaatcttaagtgttgtttgtttcatagtatcagttgcggctgctgttggctcagttgccagtatcgtgcttgacctacagaaatacaaaccgtttcatgtaaaatattaaactccatccaccctctcctagcaaaggctgtagactgagttgccaggatcttgcttgacgtacagtattacgaaccgtttcatgtagactattaaaccccatccacgccctccctagcaaagggtaaaaactgatgtgggcaatgatggttgtttgtatatcttttgtttagatctgagattggagccgaaggtattccaaaaaacagaaaccatgggactaatctcctgaaaaagtaaagtattaattaagggacaatatctttaccttacaggtgctgctctatgcacataatcattgatcaaacccctatcatcacatggttaaagaacccaaactatttgtcacttgtgacacaccttatgattgtttgtatatcttttatttcatgagcaatgttatttcagtgccacccttattacaatcttcaagcattgaattgaaattaaaaaaaaaaaaaaaaaaaaaaaaaaaaaaaaaaaaaaaaa

SEQ ID NO: 36 - DNA, 1268 bp, Glycine max
  Clone ID: PAT_MRT3847_106879C.1
tttggttggcaagtgtgttcaaaatttgaccaaactcactctcactccccaaattaaactagcagcagcagcaacaacaacaacaacaacaaaccttctctttaatttgggttccacaatcaaaaccaatcttagccaccatcaagactttggcatggagccttactccattgatggtgtttcttcacaaactaactccaaattctacgatgatgatggccatgttaaacgaacagggaccgtttggacaacaagctcgcacataataacagcagtggtgggttctggggtgctgtctttggcatgggccatggctcaaatgggttgggttgctgggcctgcagttatgatcttcttcagtgttgttacgttgtatacgacgtcgcttctggctgattgttatcgctgtggtgaccctgttaccgggaagagaaactatactttcatggatgcagttctatccattctcggtgggtattatgatgcattttgtggggtagttcagtactcaaatctttacggaaccgccgtaggatacacaattgcagcttctattagcatgatggcaataaaaaggtccaactgtttccattcttcaggcggaaaaagtccatgtcaggtttcaagcaacccatacatgatcggttttggcataatccaaattttattttctcaaattccagattttcatgaaacatggtggctctccatagttgcagcaatcatgtcttttgtctattccacaattgggctcgctcttggcattgccaaagttgcagaaatgggtactttcaagggtagtctcacaggagtaaggattggaactgtgaccgaggccacaaaagtatggggggttttccaaggtcttggtgacatagccttcgcctattcatattctcaaattctcattgaaattcaggacaccataaaatctccaccatcggaagcaaagacaatgaagaagtctgctaagataagtattggagtaaccacaacattttatatgctttgtggtttcatgggctatgctgcttttggagattcagcacctgggaacctgctcacaggatttggtttttttaacccatattggctcatagatattgctaatgctgctatcgtaattcaccttgtgggagcataccaagtttatgcccagcccctctttgcctttgtcgagaaatgggcttcaaaaagatggcctgaagttgagacggaatataaaattccaattccttgtttttcaccctacaatctaagcccattta

SEQ ID NO: 37 - DNA, 179 bp, Glycine max
  Clone ID: PAT_MRT3847_106982C.1
gttcgctcggagttccgctcgagggaccaacaccgtgcacaccggtactggtcccagaagtggaacacacgggcggcaccggttctggaggccatggtgccactggttatggaccaactggtggcactggctatgggagtggaactgggtatggagtcaccactgggggtgcgctcact

SEQ ID NO: 38 - DNA, 753 bp, Glycine max
  Clone ID: PAT_MRT3847_107885C.1
ctagagctcgagccgctcgagccgcgcaaccttatatgtgctgaccctaactttgccatcagcatctgcagtctattgggcatttggggaccagcttctcacccattccaatgccctctcattgctcccaaagactggtttcagagataccgctgtcatcctcatgctcattcatcagttcataacttttggatttgcttgcactcctttatacttcgtgtgggagaaattcattggggtgcatgagaccaagagtttgttcaaaagggctttggctagacttcctgttgtgattccaatatggttcctggcaatcatattccctttctttggtcctattaactcaactgttggatctctccttgtcagcttcactgtttacatcattcctgctttggctcacatggttacctttgcttcagcaccggctagagagaatgctggggagagaccctaatcaaagctaggaggtttttaaatattgtactccatgaacgtgtttgtggcggtatgggtttggggcgtaggatttgggttccggcgctggcctacctccatctgccgcctccccctttttcttttatttctcttttttttttatcatatcatataacttattacgactatttttctttctctctctttgtatagattagcataatgtctccatgaacaatttttcttttcttttttgttcatttttattttgtttcttaacagaatgctgtggagagaccaccatcaaagttagga

SEQ ID NO: 39 - DNA, 1047 bp, Glycine max
  Clone ID: PAT_MRT3847_107992C.1
tgcgggggtggcgggtcctggtgtgggcggcgagggtttggggctcggcggtgcccgctggcccaggaaggtgccccgtgacggcagcgaggccacgacacaaccggccattccgcgtctgcgagcgaagatgtcgggtcgtggaaagggaggcaagggtttgggaaagggaggagccaagaggcacaggaaggtgcttcgtgacaacatccagggtattccgaaagaaacagtcagaatcagaatcagaagaagcgagcaaagatgtcgggtcgtggaaagggaggcaagggtttgggtaagggaggagccaagaggcacaggaaggtgctccgcgataacatccagggaatcacaaaacccgccattcgccgtttggctcgcagaggcggcgtcaagagaatcagtggcctcatctatgaagaaacccgcggcgtccttaagatcttcctcgagaacgttattcgcgacgctgttacctacaccgagcatgctaggaggaagactgttaccgctatggatgttgtttatgctctcaagaggcagggcaggactctctatggtttcggtggttaaattttagggttttgatgggcttagcagctggttatttttgtaaatggtcgtttgtttgggagtatttgattttgtgcttttttgttttttagcctttcttgttaggtgtattgttatttttgcttcaattgaaatggaacaaagagtgttttgtttctggaattctcttcttgttgaaggtgtacactgattacccgctagttaattgcgactttggagataaaagcggggttaatttttgtggctgcaccatgcagtgcaaatataccctcgtgtttagtttgcagcttttgtgatcgttattgcgtctgttcttaccgtgctcaaagggtagccagaggttaaaaggaacaagttgattcctaggtcgcggattagattgaaattaaatttctgctgttggtctagcttgcaattgattatatgtaagtgtaaatttttatattattagtgtgtaattttgtttaaaaa

SEQ ID NO: 40 - DNA, 167 bp, Glycine max
  UNSURE (1)..(167): unsure at all n locations
  Clone ID: PAT_MRT3847_108009C.1
  unsure (1)..(167): unsure at all n locations
anacatctcaagaagctcagtaacgtatctagattatatcttgntcatttcctgntnccgtaagggatactggggntggtaataantctagtccttnggtgatgatgggtctggacatagatacaccatatccctggaaacgacctggcatgccatggaagatcttg

SEQ ID NO: 41 - DNA, 709 bp, Glycine max
  UNSURE (1)..(709): unsure at all n locations
  Clone ID: PAT_MRT3847_108585C.1
  unsure (1)..(709): unsure at all n locations
ccgctcgagcggcgggcgggnnaatncngnnnnaaaannccatcaagcagagatgagatcgagctcgtgcggcgctgctccgtcagcggccgcatccttataattctgaatcagaagaagcgagcgaagatgtcgggtcgtggaaagggaggcaagggtttgggaaagggaggagccaagaggcacaggaaggtgcttcgtgacaacatccagggtatcaccaaacccgcaattcggcgtttggctcgcagaggtggtgttaagagaatcagtggtctcatctacgaggagacacgtggcgtcctcaagatcttcctcgagaacgttattcgcgacgctgttacctacaccgagcacgctagaagaaagaccgttaccgctatggatgttgtttatgctctcaagaggcagggcaggactctctacggtttcggtggttaatttctagggtttccatcggcgtagcagctgcttattggttattgttgtaaatggttgctttttaggcttcttgttatatttgcttcaattgtaatggaacaaagagtattttgtttctggtatttgaatcttaatggttgaagttctcttaattgtcatggttactctgattatctgctagttaattgcgacttaagaaaaaatttgtgttaatttttgtagctgtaccctttacatagcaaatataccttttgtttaattttgcagt

SEQ ID NO: 42 - DNA, 1134 bp, Glycine max
  Clone ID: PAT_MRT3847_108680C.1
cggctcgaggagaaagggcttttttgagtaataggattattatcagtgaaaagagttcccttttttctctgtaaataaaagggttgttgttattattattattgcctagtgtttgttttcagatctgtgtcgtattattaagcagaacaagcaagggtgcaaagtgggggtgttttttttcgctggatgagtggtagctgacactcacttatggcgtctgaaacggcgtcgtcggcggatgaagaaaccgttgttgttgtttcggctgctgcgggtgcaggaggaactgataagagaggcaagcaccggattcttgccgaactgaagcgtctcgaccaagaatccaagtttcttcaggaagaattggaagagcttgagaaaacagaaaatgtgtcgaccatatgcacagaattgctacaaaacatagacactaggcctgatccattactcccagaagtccatggacccgtaaatctcttatgggatagatggtttgaagggcctcaagatccacaggcatgtagatgttggatactttgatttgaagctgtgtcaattgccttgcgttgcaaataggatgccacatataactgcattaaagtgactctggagctgaagaaaatgtttgatgacatgttataccacgcacactaattctataatggatccttgcttttattacattagattctgttccgaatactgtttatgtgtaatcacattcatatactgcattcaactgagaagtatcattatttgtgcttgtaatcccaatccaactgttaatgcacctgaccttggtggactttcatgtgtgcacgagacgttagagacattttagcatcattcagccttgaaggtggtgtggcttttggaaaggcctttacaatgcaatggtttgacgagtcatcaactagtcctgaatgataacgagattttttgggcagagacctcttggggttgggagagcaaagaaagctcataatcccttgtttgagtcatttcacaattaaatgttatgataagattttgtaatcatgttacttctaagcctttttaagttttggtgttttatttaacaagccattactttttgcgtgccaataaagaaaataaagaaataaagaaaagaaa

SEQ ID NO: 43 - DNA, 137 bp, Glycine max
  Clone ID: PAT_MRT3847_108684C.1
gtgtagtcggctggggtgaggcgatgtgcgttgccagatacagttttgtcttgttgactctacgtatctgattatcatttgtaagcgatttgctcaagttatgtgtcgttgatgaataacttgcgttcctcagaaaa

SEQ ID NO: 44 - DNA, 1684 bp, Glycine max
  Clone ID: PAT_MRT3847_109156C.1
caatatgcaaatgagatgatcaaagtctaacttttcccatgcgtaaattattctctaggtctgatactatttgcaaatctttatataagtttttcttcttttatgttttatgatgtgagtgtgatatcggaattagaagaaccggcgtcatttcatttccaccaaacaccaaagaaagaggtgaagtcaaatggtccttagttctgggagtgttgatgcttgagtcttgacggaacgaacggaaaaggggatctcaatggacaacaccaagccccttatcgaactggaactcgacgatgatggcagaatcagaagaaccgggaatgtgtggactgctagcatacacattataacagtggttgtaggggcaggggtgctgtctttggcatgggttatggcacaactaggatggttagctggcatagccagtatcattaccttttcagctgtctccattttcacttacaatcttgtagctgattgttacagatatccagaccctgtcactggcaagagaaattatacttatatgcaggctgtcaaggcttacttaggtggaacaatgcatgtgttttgtggattggttcaatataccaagctcgctgggatcacagtggggtacacaataacttcctccacaagcttggtagcaataaggaaagcaatttgcatccacaaaacaggagatgcagcttcttgcaagtttttgaataatcccttcatgatcggttttgggatcttgcaacttttcttgtcccaaattccaaacttccatgagcttacatggctctcaactgctgcctgtatcacctcttttggttatgtattcattggcagtgggctgtgtctcttggtcgtcctctcaggaaaaggagcagcaaccagcataaccggaaccaaactacctgcagaggataaacttctgagggttttcactggattgggaaacatagctcttgcatgcacttacgctactgttatttatgatataatggacacattaaagtcccatccatcagaaaataaacaaatgaaaagggctaacgtgctaggggtcacagcaatggcaatattgttcttgctatgcagtggccttggctatgctgcttttggtgataacacacctgggaacatcttgactggatttaccgaacccttctggttggttgcactggggaacggattcatcgtaatccacatgattggagcatatcaggttcgatcattctttcactgaaacataattaagttactcatttttaattttgttcttgtaaaatatttttgtatttaatttgtaatttactgaaatatacgcttttaatccgtatcattatatttctgttcttgaataatgacttgatataacgagaccgtgttacttgtcccaaaaaaaaaaaaaaagggcgctatatcttgaaataggtgcaagcatctcctggccaaattcagatttcattaacatggaatatcgattcattgtgggcgggttaatggaccgtttcaacttgtttatatgagtttggctgacgactttttgtaatagtggccagaattcttgcgatggcaatgccgttttttagtgacgttccttcccttcatggagcaattgggtatgggcatctagttgacattaggcccatagaactgcacattgctcaaaatagcattatgaaacgatcat

SEQ ID NO: 45 - DNA, 320 bp, Glycine max
  Clone ID: PAT_MRT3847_109315C.1
ccacgcgtccgcggacgcgtgggcacggcgacaagaaggacgagccgtggtggcccgtgctggacacccgcgacagcctggtggagacgctgaccaccatcatgtgggtcacctccggccaccactcggccgtcaacttcgggcagtaccacttcgccggctacttccccaaccggccgaccaccatccggaagaacatgccggtggaggagggcgggccgggcgaggagatggagaagttcctcaagcagccggagacgacgctgctggacatgctgcccacgcagatgcaggccatcaaggtcatgacgacgctggac

SEQ ID NO: 46 - DNA, 1792 bp, Glycine max
  Clone ID: PAT_MRT3847_110258C.1
cccgcgtccggtgtgagtgtgatggagatggatcctccaccgaagagctggagcatccacacccgatccgagatcatcgcaaaatacgaggtcatggagcgggtcgggtcgggagcctacgccgacgtctaccgtggccgtcgcctctccgacggcctcaccgtggccctcaaggaaatccacgactaccagtccgccttccgagaaatcgacgcgttgcagctcctcgagggctccccaaacgtcgtggttttgcacgagtacttctggcgcgaagacgaggacgccgtcctcgtccttgagttcctcagaaccgacttggccaccgtcatcgccgacaccgccaaggccaaccagcccctccccgccggcgagctcaagtgctggatgatccagattctctccggcctcgacgcctgtcaccgccacatggtcctccaccgagatttgaagccctctaatctcttaatttccgaacacggcctcctcaagatcgctgattttggacaggcaagaattctcatggagcctggtattgatgcttctaataatcatgaagaatattctagagttttagatgacattgacaataaggatactattactagcacccacgatgggaatgcaacatgcaacacaagtgacgtagatagggaagaggaagaacttggttgttttacgtcatgcgttgggactcgttggtttagggctcctgagttgctttatggatcaagaaactatggtttagaggttgatttgtggtccttgggatgtatctttgcagagcttttaacgctgcaacctttgtttcctggaactgctgatattgaccagcttagtagaatcattggtgttttgggtaaccttgatgagaatgcttgggctgcttgttctaaacttcctgattatgggataatctcctttagcaaggtggagaaccctgctggtcttgaagcttgtttgcccaatcggtcccctgatgaagtggctctggtgaaaaaactggtttgttatgatcctgccaagagggccacggcgatggagctgcttcatgacaagtactttagtgatgagcctcttcctgttctggtttctgagctgcgagttcctctgaccagaaaagagcaagatggggattcccctggtgggtggggtgatatcaacgatatggattccgattccgattcccagtttgatgagtttggccctctgaatatcacaaggactggtactggtttctccatacagtttccttgaagaattcaaggtacattgtattcttggaactgcctttttgccttttctgtcgtgttgctcaactgttactatttgctggaaattcttcggtgagaatattgataagaaaaatccctttttttttttctgatttgtcattcacttgtgaacaaagggataaattattcaaaagtaattagaatgattgtgtgtttacatgacattcatagttgaccatgacactcacagttgatagtttatataatacatggacttgtatccttccaaattcacacatataatgatagcacgtactatagttatttttgtgttaaaaaaattttttcacacattgctcatggggtagcttgtgcatcacatggtggtcatgggtacccacctgaggcttacccaccaccacctgggtcatacgctccacaacaaggatatcctccagctgggtatcctgcacaacaagggtatcctccagctgggtaccctgcacatcaaggctatcctcctgctggttacccccccagctggttatcctggttca

SEQ ID NO: 47 - DNA, 342 bp, Glycine max
  UNSURE (1)..(342): unsure at all n locations
  Clone ID: PAT_MRT3847_110470C.1
  unsure (1)..(342): unsure at all n locations
cacacaatgacnacaagtacntccttacaatcaaaancanccaataactancngcattnancaaaagcactacgatgatcagggtcgcnaggttgacgantatggcaacgttgagaagcataccgacgantacggcaaccctgttgcatgctgctagtgtcacctatgtagccnccagnactgctgctggtggttacagtgatgtcattaatnatcaacatgataccaccaatgcctacggcgggggtactggtagacagcattctagtggtggctacgatggtgacactantnaacagcatggnactactggtggctataatgatgacaccaatagtcatc

SEQ ID NO: 48 - DNA, 1364 bp, Glycine max
  Clone ID: PAT_MRT3847_110893C.1
gaacttctcttcaaacactcttctatattcctagtactttgaagagatattgaaataaacaacaatggccaattccatgagctttttcctgcttctttcttttctagcttttgctcccttgtgcctctgtcactataaccaagagggttacctctaccctcagttttatgactattcatgcccacaagctcaacatattgtcaagtctgtccttgctaagtatgttgcagagcaacctcgattggcggcttcgattctcaggcttcatttccatgattgttttgtcaagggttgtgatgcttcgttgttgttagatagcagtgaaagcatcaacagtgagaagggatcaaatcccaaccgtaattcagctagaggatttgaagtcattgatgcaattaaagccgaactagagagacaatgcccttctactgtgtcttgtgctgacatcttgactctagctgcaagagattcagttgttcttactggtggaccaaactgggaagtacctttaggcagaagggactcactaggtgcaagcataagtggctccaacaacaacatcccagccccaaacaacacattccagacaattctaactaaattcaagcttcagggacttgaccttgttgatctagttgctctatcaggggggcacactataggaaatgccaggtgcaccaccttcaggcaaagactctacaaccaaagtggcaatggcgagccagattccactcttgaccaatactatgcttctacattgcgtacaaggtgtccaagctctgggggtgaccagaatctgttcttcctagactatgccaccccatataaatttgacaacagctacttcaagaacctgttggcctacaagggtctcttgagttcagaccaagtcctcttcacaatgaaccaagaatctgctgaactagtgaagttgtatgctgaaagaaacgacattttctttgaacatttcgccaagtccatgatcaagatgggaaacatatctcctctgacgaattcaaggggagagatcagagagaactgcaggaggattaacgcttgaagaagcaacaatcattgccatattaatatatcatacaccaagtcatgtgaccacattttatttatgtttcttttgtttgtgcccaaaataataaaagctgagttcatcatgaagccattgccacttgcccgggtgtccagtggaggcgtttaggctttaggtaacacttttgtgtgtgtcatgaaatttgtgtattcccatttatttataaagaagtgattatttgttagtactcttctgtttgagaagcaaaatcaaacttccacattataataaaaccaaccagtgtgacttttttgtatcg

SEQ ID NO: 49 - DNA, 281 bp, Glycine max
  UNSURE (1)..(281): unsure at all n locations
  Clone ID: PAT_MRT3847_111031C.1
  unsure (1)..(281): unsure at all n locations
cncacgactangacaangncttccttncaantcaaaaccaacaagaacgatggcaagtnatcanaagcacnacgctgatcaaggtacgcaaggttgcacgnntatagcaacgttgagaagcaaancgacgnntacggcaaccctntncatgctgctagtgtcacctatgtatccaccagaactgctgctggtggtacagtgatgacattaataagcaacntgangccacnaatncctacngcntagacactggtagacggcattctagtggnggctacnat

SEQ ID NO: 50 - DNA, 340 bp, Glycine max
  Clone ID: PAT_MRT3847_111790C.1
ggctgcctccaaggatcgcgagaactgcagctgcatcgccaagctcgccgaacatgccgagcgatacgaagagatggtggaatcactgaagaacgaggcgaatctcgacgttgaactgactgaggaggagcggaatttactttctgttgggtacaagaatgtgattggtgctcggagagcatcctggaagatcctgtcttccatccggcaactggaataaacaaaagggaacgagtagaatgcaaagcgcattaaggataacacgcattaggtgaaattggagcttacaaacatctgtaatgatgaaatgactgtgattgatgagcacctgatggcttcg

SEQ ID NO: 51 - DNA, 1654 bp, Glycine max
  UNSURE (1)..(1654): unsure at all n locations
  Clone ID: PAT_MRT3847_111906C.1
  unsure (1)..(1654): unsure at all n locations
gcntacggctgcgagagacgacagaaggggagggaaacacttacatttacntcntctcaangagacgagggggactcaaatttggaaccanaacatgcaagaccctgtgttggtctactcgacaaaccccttggggttattaagggtctctttctaatgaaggttttggataaaaaattggagcagatggggttgaatcaattaggccataaagatgttcctgagccaacatcaacatgaagtgctaatgcagtggctggccttagcacttcangtgtggcttttactgcattgatgcgagctgcaattaataaagttagggggggtgcggttcaggaaggagcgaaagggaaatcagaaaatggcacagtcctcctcgatcgtcgttactctgaggcagcacttgtttaaaaggaacctcacctctctcactctgcctcactctccttctcttccttccttctccttctctctgagaacaacaccccacactcctctctctctctccgcttccttctcttctcacacctccatggcccacacttcccttccctccgccgatgccggcatggacgctgtccagcgccgtctcatgttcgaagacgaatgcattttggtggatgagaatgaccgtgtggttggtcatgattcaaaatacaattgtcacttgatggaaaagattgaagctgagaatttgctgcatagagctttcagtgtattcctgttcaactcaaagtatgagttgcttcttcagcaacgatctgcaacaaaggtaactttccctcttgtgtggacaaacacctgttgtagccatcctctgtaccgtgaatctgagcttattgatgagaatgcccttggagtaagaaacgcagctcagaggaagcttttggatgagcttggtattgttgccgaagatgtaccagttgataagttcacccccttgggtcgcattctttacaaggcaccttctgatggcaaatggggagagcatgaactggactatctgcttttcattgtccgggatgttaatgtgaaccccaatcctgatgaagtggctgatatcaaatatgtgaaccgtgatcagttgaaggagctgttgaggaaagctgatgcaggtgaggaaggtctgaagctatcaccttggttcagactagttgtggacaatttcttattcaaatggtgggaccatcttgagcaaggaactcttggggaggccactgacatgaagaccattcacaagttgacataagtaagttcagaggagcttcctgcatccctgtaatgaagggtggctgcattccgaccaaataagaacgaaattggacctattttgagaagaattttcggagcagtgacttataggatgttgttggtctttttgttattcgatgatagctagaacaataaacgtctgagtgtttaaattagaagaattttttgttgttgcaaatttcggattttgggatgcaggcaagtttatcggaataagaatacaagatgttagtgatttgaatcaaaagatgttagagattggaatcaaggatagtttgtcagtttgtctccttaccacatgatcagtgtatatcccgtgatcacgtgtggaggtacagaaatatagatccagattaccgtccaaagcaattaggattaaaaa

SEQ ID NO: 52 - DNA, 144 bp, Glycine max
  Clone ID: PAT_MRT3847_111927C.1
cttactatcgagactaaatacccttctattaactaaacactggaactaataggcgtacaatatttctgtatactgagctgtattatactttggtttaatcatatgcattacttcatgctgtgtaaaattgttatccgcatataa

SEQ ID NO: 53 - DNA, 2412 bp, Glycine max
  Clone ID: PAT_MRT3847_112250C.1
ggtggctacgaagactgagtcaaataaagttgcagggaatgccattttatatgaatgtgttcaaacaataatgagcattgaagataatggtggcttacgtgtacttgccattaatatcctgggaagattcttgtcaaaccgtgacaacaatatcaggtgaattgcttactggatatgcaagtgtttgtgtgtgtgtgagtgagtgagagcaagagagagtcttgaatgaatgacaacaatgtctataaaatcattagcataatgatctggtggatgtattctctcctataattctgtgattgatggatgagatatgtggcattaaacatgctaatgaaggctgtaactgctgatgctcaggcagtacagaggcaccgtgcaaccattatagaatgtgtgaaggattcagatgcttcgattcggaaaagagcccttgaacttgtttatgttttggtgaatgagactaatgtgaagcccttggcaaaagagcttatagattatctggaagtcagtgatcttgatttcagaggggaccttactgccaaaatttgctccattgtagcaaagtattccccagagaagatctggtatattgatcagatgctcaaggttctgtctgaggctggaaactttgtaaaagatgaagtatggtatgccttagttgttgtgataagcaatgcttctgagcttcatggatatacagtaagagcattatacagagcatttcaaacgtcagctgaacaggagactctagttcgagttacagtgtggtgcattggggagtatggtgacatgttagtcaataatgttggaatgctagacatagaagatccaataacagtgactgagtccgatgcagttgatgtcatagagattgctataaaacgccatgcatcagatcttaccacaaaagcgatggctttggttgcactattaaagctctcttcacgtttcccttcatgttcagagaggatcaaagaaattattgttcagttcaaagggagctttgtgctagaattgcagcagagggctattgaattcagttcgattatttcaaagcatcaaaatattaggtctacacttgtagaaaggatgccagttttggatgaggcaacttacattggtaggagggctgggtctctgccaggcgcagcttcaactccaactgcaccttcatttaatcttccaaatggagtagccaaacctgtggctcctcttgtagatctacttgatctaagttcagatgatgctcctgctccgagctcttctggtggaggagatattcttcaggaccttcttggtgttgatctgtcaccagcatcacaacaatctgttgctggccaagcttcaaaaagtggcaacgatgttcttttggatcttctgtctatcggatcaccttctgctgaaagcagctcatctacagtagacatcttatcctccaattcgagtaacaaagcaccagtttcttcatcattggatggtctctcatctctttcactttctacaaaaacaacttcaaatgctgctcctatgatggatttattggatggatttgcccccatcccgccaacagaaaacaatggaccggtttatccatctgtaactgcatttgagagcagctccttgaggttgacattcaatttctcaaaacaaccaggaaacccacaaacaacagttatccaggctacttttatgaatttgtcctccaatacatatacagattttgttttccaggcagcagttcctaagtttcttcagttgcacttagatccagctagcagcaatactcttcccgcaaatgggtccataacccaaagtttgaaaattactaatagccaacatgggaagaaatctcttgtcatgcgtataaggattgcatacaagataaatggcaaggatacactggaggaaggacaagttaataattttcctcgtggtttatgaagcccaatcaatgatcaggggtcagtaaggtgatgcacaaaacccttcgttttccccggcactctatagttattggtgcggttttcatgtttcattccttcaattgaggaaggtatggttcgagaatctggaccactttttggcttaaatttgaagtcgatttggtggcttcacatcgttgttttacctttttcttttacttaggtgatttatgtacattagtacaacatattcctgtatgaaaatgccatagtcaaattttgcctctcaaggcgctgagagttgtgtcatgttgagtacttgaggtgctttcttgctattttttcggaggtagttgctcggtcttgctgtctaaagttatagtgttgttgaatgcaatttggtatcttttagacgattggtatatttgatttttatgtaacttttccccctcaagattaatgaaaatgtaatctcaaaattatatca

SEQ ID NO: 54 - DNA, 2763 bp, Glycine max
  Clone ID: PAT_MRT3847_112527C.1
ggaaacaaaagagaaataaattataatcaagtattccaaaaaataatcatgatcaaaacgagttggattggctagcaatatgtaaacaacttgtgcttttatatattggttatagggcctttaaaccaacggcgaccactgattaaccagtaagaaactacaagaataagcaaacatccaacggcaacaggggtgtagttaagtgtcttaatggttattgggtaggaaacaggcaaggagaagagtacagaaatggtcagcacccaaagaacagcaacccaacccacaacgacaccataacggcccaagttgaaaggcccactgacaaagtgtttccgtgccaaggtcacccttaagaatatagggaaggcataagcaatatagaggccaattgttgctatggacaccatggcctcaaatgctactatgcttccaagagatgtcagtgccatgcaaaatgatatgaaaacggaaagccaaactgcatatatagggacctcctgcttgttaactttgtgccacaatgatgacaatggcatgcaaccatctctatttggtgcagaagccatatttgaattcctgttaacataactcataccacagaaaaatatgacaacagcaacaattacttagttaattatgtctccagatccatggactgatcttttcttgaatgcttggaaaatacttgagcaattgcatacccaccagcatcattatcttcactcaaaaggtaaaggatgtcagtgactgcaaaggtaatgcctagtatctaaccccatccaacaacaatggatatcccgacagagctgataattccttttggaccattcctatcagcatccttggtatcatctgtcatatgagctgatgcatcaaatccagttagggtatactgactcattagaagtcccaagagaaatatgtagggtttgctgttgattccttccccattttctgtattgaaatgagtgaaaacaaacttggcactagccctttccgttgcaacagatggaatgacaatcataagcacaaaaacacctataacattccaaatagctgccagctgtcctaagaatgataacaatgagataggaaggctgtttattataccgtgtaggaacaaaattcccccatggaaagcaataactacatatttagatgcctcatatccaccaccatttttgccaccagtactaaggagaataataacctgaatcagttgtgcaagtgaataatctacacttgttgtcactgcccactggccaacaatattgaaccagccagtaatccaggaagcaaagggtgcccatctgggcccagcaagcttggcactccaataataaagcccaccagaagttggataagatgaacaaatctcagccattgagaatgcaacgagcatggtgaaagcagaagctaaaaaccacccatacaccagcgaaacagggccgccataattcaacccagtgttgtaaagagtggtcactccagtcaacaccgatataatagaaaacgaaaacgcaaaattcgaaataaccgaaagatcacgcttgagttcttgtttgtaaccgagttctttgagacgggcgtggccggaatcaagtggggcgtggccatttgcgaccacatgagaagggagtattttgtcagagcccatgaagatggaggaaaaatgtcccttttcatcactttgtcccttttcatacattcacatattcattttgccacaccttaaaaccaagcacccggccatatttcaatttttgttttggttagttgtcatgaagagagaaagagaggttgatagcttaaccatggcgaattgtttgatgttgctttctcgtggaagtgaatttgaggccacctactcaagcacttctatgagcaatcgtgtctttgagtgcaagacatgtaataggcaattcccttcatttcaagcacttggtggccacagggctagccacaaaaagcctaggttgatggcaggagatatcgaaggccaattgcttcatgattcacccccaaagcctaagactcatgagtgttccatttgtgggttggagtttgctatagggcaagccttgggaggtcacatgaggaggcacagagcggcgaatttgaatggaaacgtgcacaattctacggctacgagtagtagtagtgggggtagcagttttgattcatcgccaaagaagaaagctgacaacaagagagttttggttttggatttgaatctgacaccctttgagaatgatttggagtttttgaagattggaaagccaactacttttgttgattatttgtattgattgatctgttgagtactgttaattaaacttaggaaggtatagtttatgtatcatagatagatgaatgttttgtttttttttaatctatcgtctataatatttgtttatcattctgtctgaaaaattgctcatttcttgggcaaaattagaacttcatcatgatattctgagtcactgaaaaaaatatttgcaacagaacacaaaccaagccattttcaatccgctacgagagggaaaaaatacaaatggccatgatcaagctaagaacctagaattggaaattaatgatagaccaaaaaaagacacaaaatgaaggaaggaattcaattaagcgagaaagagagaacctaatgaaaaatgacgcttgagttcttgtttgttaccaagttcaagaagacgggcatcaaaatttgtaattgcaaccacatgtaatgggggtgcggacgcgtgg

SEQ ID NO: 55 - DNA, 1837 bp, Glycine max
  Clone ID: PAT_MRT3847_112528C.1
cgaggcttagttgagcctataaataaccccacacacttgtccggcctcctaagactcgctacatcttctttccaaatcccaactactactcacactcactgcagatctcaatccatggctaccattgttagcatcaaggcccgccagatctttgacagtcgtggcaatccaaccgtcgaggtggatttgacatgctccgatggtacttttgctagagctgctgttccaagtggtgcatccactgggatttatgaggcccttgaattgagagatggaggatctgactaccttggaaagggtgtatcaaaggctgttgacaatgtgaacaccattattgcccctgctttggttggcaaggacccaactcagcagactgctattgacaacttaatggttcaacaacttgatggaactgttaacgaatggggttggtgcaagcaaaagcttggagcaaatgccatattggcagtgtctcttgcagtctgcaaagctggtgctgctgtcctgaaagttcctctttacaagcatattgcaaatattgcgggtaacaaaaagttggttttgcctgttcctgctttcaatgtcattaatggtggatcacatgctggaaacaaacttgctatgcaggagtttatggttcttcccgtgggagcttcctctttcaaggaagccatgaagatgggtgtagaagtatatcacaatttgaagtctgtgattaagaagaaatatggtcaagatgcagtaaatgttggtgacgaaggtggctttgcccctaacatccaggaaaacaaggaaggtttggaattgctgaaaactgccattgccaaagctggttacacaggcaaagttgtcattggaatggatgttgcagcttctgaattctacaaggaagataaaacatacgatttgaacttcaaggaagataacaatgatggctcacagaagatctctggagatgctttgaaagatctatacaagtcatttgtgacagagtatccaattgtttcaattgaggatccttttgaccaggatgactgggagcactatgctaagcttactgctgaggttggaaccaatgtacaaattgttggtgatgatctcttggttaccaaccccaagagggttcagaaggcaattgatacaaaagcatgcaatgctcttctccttaaggtcaaccaaattggttctgtgactgagagtattgaagctgtcaggatgtccaaaaaagctggatggggtgtcatggcgagtcacagaagtggagagactgaggataccttcattgctgacctttctgttggtttggcaacgggtcaaattaagactggagctccatgcaggtcagagcgtcttgctaaatataaccagctcttgagaattgaggaggagcttggtgcggaagcagtgtatgctggagctaacttccgtacccctgttgagccctactaaagttttcaagtggaaaaaacctggagatccccacgagtttgagcaatgagatttggatgcgcggttttagttgtgatcaataagtcgatagttagaacaatagtcttggtataaggaccttgccaataattttttagttctgattcacagagctaagacagttccgtcttagactttaaaagttttgatatttagctttaatacttgaagtttacttccaattttatggggtatccccaaaacatttcatactctttgctatgttaacttttttccccttgatccgtgatattcccaatactacgattttaagacttgcgaccaattttatttgtctcaaaagttatttatattgtctttctaaatgaaagatgaacactgcccggat

SEQ ID NO: 56 - DNA, 304 bp, Glycine max
  Clone ID: PAT_MRT3847_113563C.1
tcgggctcttgctctctcatccagatctttcaacagagagagagacacagtggcagcgggcgctcgcactccacgcgaagagttcgcgtacatggcgaagctggcggagcaggccgagcgctacgaggagatggtggagttcatggagaaggtctccgactgcgccgagagcgaggagctgaccgtggaggagcgcaacctgctcttggtcgcctacaagaacgtaatcggcgctcgccgcgcttcctgacgcattatctgctgcattgagcagaaggaggagagccgcggcatcgaggaccac

SEQ ID NO: 57 - DNA, 402 bp, Glycine max
  Clone ID: PAT_MRT3847_114189C.1
ccagaacgaacaaaaatggagaattcgacccaagaatcccacttccgatccgaaaactccgtgagctacgaatccccctacccaatctacggcatgtcgttctccccttcccacccccaccgcctggccctcggcagcttcattgaagaatacaccaaccgcgttgacatcctctccttccaccccgacaccctctccctcacccccaacccttctcgctcctttgaccacccttaccctcccaccaaactcatgttccacccccgcaaacccccctcctcctcctccgacctcctcgccacctccggcgactacctccgcctctgggaggtccgcgacaacttcggggaggccgtctcccttttcaacaacagcaagaccagcgagttctgagccccctta

SEQ ID NO: 58 - DNA, 260 bp, Glycine max
  Clone ID: PAT_MRT3847_114269C.1
tctcgagccgattcggctcgagggcttttgatgaagctattgctacattggatacactggacgaggagtcatacaaggatacgcactttgatcatgcaactccttcgtgataacctcacactttggacctctgacatgcaggacgatggagcagatgaaattaaagaagcagcaccgaaaccggatgacagtaaaaatattttactgctaattagaattgaactcctcctcaaaatctttttgaagggagaagtgtttgt

SEQ ID NO: 59 - DNA, 852 bp, Glycine max
  UNSURE (1)..(852): unsure at all n locations
  Clone ID: PAT_MRT3847_114296C.1
  unsure (1)..(852): unsure at all n locations
actatcttgagattcatctcttttgggctggaaaaggtacttgttgcataccaactcaaggtacttatgggcccttaattcaagcaatccatgctatcccagatttcatacctactgttagtaacaaacctccaagtagtaacaacaataatatcggtctaataattcggctcgagcttggagttggagttgtaagcgttttatcaatttttgcaattttctgtatcattcggagaagaagacgtcgtgatgatgaaaaagagcttctaggaattgatactaagccctacactttcagctattctgagttaaagaatgctacaaatgattttaatcttgaaaataagcttggagagggaggttttggacctgtttataaggggacacttaatgatggaagagtcattgctgtgaaacaactatctgtgggatcccatcaaggaaagagccaattcataactgagattgctactatatcagctgtgcaacatcgtaatctggtcaaattatatggatgttgcattgaggggagtaaaagactgcttgtctatgaatatctagaaaataagagtcttgatcaagcattgtttggaaaatgtttaaccctcaattggtccacacgctatgatatatgcttgggtgttgctagaggtttaacttatttacatgaagagtcacgtcttcgcattgtacaccgtgatgtgaaagccagtaatattttgcttgattacgagcttattccgaaaatatctgactttggtttggccaaattatatgatgataaaaagacccatataagtaccggtgtggcggngacaattggatatcttgcaccggagtatgccatgcgtg

SEQ ID NO: 60 - DNA, 527 bp, Glycine max
  Clone ID: PAT_MRT3847_11449C.1
cccacgcgtccgtacggcgagaagacgacagaagggattcataagtgtgacagaaatggaggatttaaaggaaaaggtcaatgaaggggaaccaacgcaaattaagtatagaggagtacgtaggagaccatggggaaaatttgctgcagaaattagagattcagctagacatggtgctcgtgtgtggctcgggacatttaacactgctgaggaggccgcaagagcttatgatcgtgctgcctttgagatgagaggtgctacggccattctcaacttcccagatgaacaccctccttgcaatgtgacttctcttagcaagaagtcctcatcatctaacactgagattggtaaacaagttgtggtatttgagtgcttggatgacaaattgttagaggaactccttgattgcgatggggaaaaccatcaatgaaaacttggattattaggaagataaggttcaactttttaatcctaaattggtatgtagtgcctgtgtacaattaaatacagtaaagttgcttagtgac

SEQ ID NO: 61 - DNA, 419 bp, Glycine max
  Clone ID: PAT_MRT3847_114734C.1
gtagggtgctcctcattagatggacgcaatttattggagtcttccaaaattgctcttgataaaggaaagcttgaggatgctgtgaattatggaacaaaggcattagctaagatgatggctgtttgtggaccctttcatcaaaatactgcaagtgcatatagtcttctagctgtggttctctaccacactggagattttaaccaggccaccatctatcagcaaaaggccttggatataaatgagagggagctagggcttgaccaccctgacactatgaaaagctatggggatctttccgtcttttattatcgtctgcaacacattgagttggctctgaactatgttaatcgtgctctattccttctacattttacatgtgggctgtctcatccaaacacagcagctacttatataaatgt

SEQ ID NO: 62 - DNA, 238 bp, Glycine max
  Clone ID: PAT_MRT3847_115437C.1
cttcgacgatgacgccgagtatgatgccaccgataatgatgccaagtatgataccaccgacgatgatgcagagcatggtgtcatcaatgataatgccaaacatgatgacagtgccacaatgttactctgattccatctcgcacattatacaacaacaacaattaccattcatgttcagccggacactcgtggcgatctcacccatgtttttacagcagccctttgttggtgctgcatt

SEQ ID NO: 63 - DNA, 196 bp, Glycine max
  Clone ID: PAT_MRT3847_115982C.1
tttcacgacaacccgaccgcggcgtcgcgcccctacgacaaggaccgcgacggattcgtcatgggcgagggcgccggcgtcgtcgtgctcgaggagctcgagcacgccaaggcccgcggtgcgcgcatctacgccgaggtggccggttacggcctgtccggcgacgcctaccacatcaccgcgccgtccgaggacg

SEQ ID NO: 64 - DNA, 956 bp, Glycine max
  Clone ID: PAT_MRT3847_116452C.1
tacggctgccggtccgcgacagcccggggacacaatcaatcccattattaaagggataagccttcaaccttgcaacacaacactacaacctaaggtctgcactacgagaatgtctcagggaagaggcagtgcatctttacctattgtggtcactgtggtttcactactgtgccttttggttcttttggaacgtgctgatgcagcaacttacaccgttggaggacctgggggatggaccttcaacactaatgcttggcccaaaggaaaaagattcagagctggtgatatcctaatcttcaattatgattcaacgacccacaatgtggttgctgtggacagaagtggatacaacagctgcaaaacgccagggggtgctaaagtgttcagttcagggaaggaccaaatcaaactagcaagagggcagaactacttcatatgcaactaccctggtcactgcgaatctgggatgaaagttgccattaatgcagtgtgatggtgcttaatacttcttgagttgaagtgaaaattaagttaatggtcaattagctagcattagtaaatgttagtgtgtgctcatgtatgtactttttttatatgaagctgttatatatatttattaatcactatagttttgtgaagcaaagtgggagtgagctggcttggtagatcaattgttcctatgtttggtatgtgttgtgtagtgggagtataaaaatggtccattagtcacgggctcttcttattagacattggatctacatattttgaagttattgaaagtctcagagccaattatctgtatctgtgtgtcggtgtcacagtgtatggttctattactgattttgtttgcttcaataaattaaatttcctacggtatgatgaattttcctgtgagaaggcaaattgcaggcaaagtaccaatatgcaacaagaggaagggatgtaaaggggtagca

SEQ ID NO: 65 - DNA, 531 bp, Glycine max
  UNSURE (1)..(531): unsure at all n locations
  Clone ID: PAT_MRT3847_116633C.1
  unsure (1)..(531): unsure at all n locations
ccacgcgtccggctcggtcgactactggctagcttgtttcagtcgtccgatctgatctacagaaaaagcaggggcagggcagctagccatgattcagatgaacatgaagcagcctctcgtgctgcccgcgcaccggggcaatgtcatcggctcgcgcctggcgtcgtcgccctctccggtggcggcggcggcggcggcggccagcaggcggaggggcgtcgtgtcctccccccgctcccggctccagcgccacatgcggctgccgaggatcagctgcagcgccaccgaggaggccagcggcgccgtgtcggccgtcaccgtggagaagatgctgacggtgacggcctcggtgcaggcggcgccggccatcggtcagatgtacttncagcgcgccctcgacgacgccggcgacttcttcggcaagacgctgctgatggaactcgtcagctccgaggtcgacgcanagacgggtctggagaagccgccggtgacggcgttcgctcacaagacgctgcgggagggccactacga

SEQ ID NO: 66 - DNA, 1978 bp, Glycine max
  Clone ID: PAT_MRT3847_116966C.1
gctctctctctctctctgccttttaccctaaaaagggtgttcgtttccttcataaggccctcttctgcggcactcttttcagcccagcattgaaacagagagaaacagagactgagagaaacaaaactgattgcgtggctctatagtggttttgttcttatttccacaaattgtcatttcttccttttaacaagttcgtaaaagaaactcactcacctacacatacagacagaccccatcaataatctgaacataaagtttcgttttttgtgaagattttggaggaagagggtggtggttgagtttaattcaaggtcttgcaatggcacccagttttgactttgcttctagcctcctttgcacagaggacagcaccgttttcgacgagagtcataataatgggggtacgatgatgacggcgatgggggtgtacgaggacacgaggagtcctaggaggcgccactttgacgaagaaccagatgagttgccattgctaagtgatgagagcttggtgatgatggtggaaaaagagtgccaacactggtctggtctgcgttacttgaataagtttcaaactggggatttggacttcggtgccagaatggaggccattgattggattcacaaggtccgatcgcattttggatttggtcctctctgtggatatctatctataaattacttggaccgattcctctttgcatatgaattaccgaagggaagagtttggacaatgcaattgttggctgtggcgtgtttatctctagcagccaaattagatgagacagaagttccactctctcttgatttgcaggtgggtgaatcgaagtttttatttgaggctaaaaccatacagagaatggagcttcttgtactaagcacattgaagtggagaatgcaagcaattactcctttcaccttccttgattactttctttgtaagatcaacgatgatcaaagtccattaaggtcttcaattatgcgatccatccaacttatatcgagcactgcaagagggattgacttcttggaatttaaaccatcagagattgcagcagcagtggctatgtatgtcatgggggaaacccaaacagttgacactgggaaagcaatttctgttctgattcaacacgtagaaaaggagagactattgaagtgtgttcaaatgatccaagagttatcatgcaacagtggctctgccaaggattcaagtgcttctgtcacttgcttaccccagagcccaattggtgtgttggatgctttgtgcttcaactacaaaagtgatgacacaaatgctagttcatgtgttaattcttcacacaatagtcctgttgccaaaaggaggaagttaaacaaaacctgtggagctgagcaattgtagtgatgttggagtgggaattttacaatcatccataggatgcttttccaaaaaaatgggcatcatgtgtgttttatggaaggtgctcccctcaaagcaataccaaaatgaggcaggaagacatagctagaaatcttttatttttttaatttctcaaaaagaaaaaagaaaaaaagaccttagtgtaaaaaatacaaaaaactatattaaggtgaggtggatcatgagtggaagatgggtgatcaagcgaacagtgcaatacattgcattctattggcatgaagtgagtaatcaccagctgttaaatattttagatctattaacagcagctagagaacaaaggatctgaagaagagggataaggattattagagtattgtatgtgtaggtaaagttgggggggagtttttcatttgttcaattttttacttttaaaatgggagagagaaaaatagactgaagaaaaaaaagagatagctatatatatgcgggaaatattttatttatgttattatttttattctgttagttatttttacttaatcagattttactctctttttcttaaaaaaaataaagtactgttggtgttgtgtcatg

SEQ ID NO: 67 - DNA, 520 bp, Glycine max
  Clone ID: PAT_MRT3847_117245C.1
ccacgcgtccgcccacgcgtccgcccacgcgtccggaaaaaggagaggcccgcgactgtagtgggattgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcaggtcgattgcatggcttcccttatatggcgtcatcagcggttttgatacgtaccggccattcagatatttaggatatagtttgagaagttttctggccaattcagtgtcgtagtgttttttatttgacatctgtgtacctaaatc

SEQ ID NO: 68 - DNA, 1069 bp, Glycine max
  Clone ID: PAT_MRT3847_117585C.1
cggacgtcggctcgagctcgtccggtctatcacctaatctaagtcatcgtgtggtggtggttttggtcggtggcaaagagagaagaaacaaagcctgttcttcttaccatgtcggatcatcttccgcgcgaagtgctaaccgaaatcctctcccggttaccggtcagatccctactgagattccggtcaacgtccaagtcatggaagtccttaatcgacagccagcacttgaactggcttcatctgactagatccctgaccttagcctccaacacgagcctcatcctccgtgtggactccgatctataccagaccaatttcccaaccctagaccctcccgtatcccttaaccaccctctcatgtgctacagcaacagcataaccctcctcggttcctgcaacggccttctctgtatatccaacgtcgccgacgacatcgccttttggaacccctccctccgccaacaccgtattcttccttacctccctgtcccccgccgccgtcaccccgacacgacgctctttgccgcccgcgtctgcggcttcggcttcgaccataaaactcgcgactacaagctcgtccgcatctcttatttcgtcgaccttcatgaccgctccttcgactcccaactcaagctctacacgctccgcgccaacgcctggaagacacttcccagcttgccctacgcgctctgctgcgcccgtaccatgggcgtcttcgtcggaaactcccttcactgggtcgtcacgcgcaaactcgaacccgaccaacccgatctcatcatcgccttcgatctcacccacgacatcttccgcgagctcccgcttcctgacaccggaggtgtcgacggcgggttcgagatcgacctggcgctgttaggaggctccctctgcatgaccgtgaactttcacaaaacgagaatcgacgtttgggtgatgagggagtataaccgtagagacagttggtgtaaggtgttcacgctcgatgagtcgcgtgagatgagatcgtggaaatgcgtgaggccgctgggctactcgagcgatgggaacaaggttctgttggaacacg

SEQ ID NO: 69 - DNA, 139 bp, Glycine max
  UNSURE (1)..(139): unsure at all n locations
  Clone ID: PAT_MRT3847_117614C.1
  unsure (1)..(139): unsure at all n locations
ctcatggttcagnagccattagcnatttcccttgtctctctccatgcttaantgccaagcataannatcatnnacccatntcgtatcngaccaatggcttcnctcactgtcncaanccattgtgttacnnactttgttt

SEQ ID NO: 70 - DNA, 369 bp, Glycine max
  Clone ID: PAT_MRT3847_117866C.1
cttcaatcaatcccctcaatcatcgtctctcgctctcagcaatggccggacgtggcaaggcgggcggctccgcagcggcgaagaaggcgacctcgaggagcagcaaggccggtctccagttcccggtcggccgtatcgcccgcttcctcaaggccggcaagtacgccgagagggtcggcgccggcgctccggtctatctcgccgccgtcctggagtatctcgcagccgaggttttggagttggctgggaatgcggcgagggataacaagaagactaggattgtaccgaggcatattcagcttgctgtgaggaatgatgaggagctttcgaagttgctggggatggtgactattgctaatggtggggtga

SEQ ID NO: 71 - DNA, 165 bp, Glycine max
  UNSURE (1)..(165): unsure at all n locations
  Clone ID: PAT_MRT3847_118323C.1
  unsure (1)..(165): unsure at all n locations
agcgaaactgaatcagatantgcggcacggaaactaggaantagagcaatggcanangatctggtgctggatactgcaatcanagactgggtgctgatcccnctctctgtggttatggttctcattggggtgtccgtnattntntttctaagcttatgccctntt

SEQ ID NO: 72 - DNA, 323 bp, Glycine max
  Clone ID: PAT_MRT3847_118387C.1
gacaaatataatcggacagtatttggggcaaatgaaggcattattccatccggaggggttataaaggtttgccctctataggagattacatattaccacccccttgtgaatgtgatcaaaggctccaaaatgagctacataattgcaggggttgcaaacttacaattcatcggtacatacttgtgtggctctggattaggccagctaatatcgccaacatacaaacctaactggctcaaagacccttaaatattttcagggtccaacccatatgcttttcttgttggaacttattgttggacacacacttaaccacccccttt

SEQ ID NO: 73 - DNA, 268 bp, Glycine max
  UNSURE (1)..(268): unsure at all n locations
  Clone ID: PAT_MRT3847_118549C.1
  unsure (1)..(268): unsure at all n locations
cagancnactataagcacttncgtacaatcagnngnaacnnncactatggcaagtnatcanaagcactacgatgatcagggtcgcaangttgacgagtatggnaacgttgctgangnanaccgangantacggcaaccctgttcatgctgctagtgtcacctatgtagncaccagaantgctgctggtggttacngngatgacattaatnagcaacatgataccannnntgccnccggcgnagacactggtagacagcattctagtgg

SEQ ID NO: 74 - DNA, 427 bp, Glycine max
  Clone ID: PAT_MRT3847_118762C.1
gacgaagctcgaaaggggctcgagaaatcatgtacgttacgaggacgagaatagtagatacctttgcattggaagtgtagagaaggtgttatgtttgattgcgcgttgggttgaagaccccaactcagaggcatacaaacttcatttagcccgaatccctgattacttttggctggctgaagatggcttgaagattcagagttttgggtgccagatgtgggatgcagcatttgctattcaagcaatacttgcttgtaatgtgagtgaagaatacgggcctacacttcggaaagcacactccttcgtgaaggcttcgcaggtccgtgaaaacccatctggtgatttcaaagcaatgtacacacacatatccaaaggatcgtggacattctcaatgcatgatcacggttggcaagtctccgactgcacg

SEQ ID NO: 75 - DNA, 2126 bp, Glycine max
  Clone ID: PAT_MRT3847_119165C.1
ccggggtcgacccacgcgtccgtacgctccgtttattcttatataaggggaaacgattctccgtttattcaaaaacgaaaaacacatctctctgattaatacgcactctcgctgtgagtttgaatttagttgggagactcgaaataatgtcgtcgacgacgcagaatcgtcgttcgtcgtttactccctcgacggcgtcgtctttggcgaaagcgaaacgacatccatcgtcggtgtcgtcgtcgtcgtcggggaaggcgaaggtggtttctactcagaacttggctgtgaagagagcgcctctcgccaacctcactaatcaaaggaacgcgccttattcttcttcttcttcttctttggtgcaaggttcaaataaagttgccaagaccaagaaagaggctcctgcaagaaccagcgtctcaaaatcaacaatttctgggaacaaatcttcccagttaaaatctgttaactcaagctccgttgttattccaaaggctaattctttatcacaaaagaaggatgctgctcccacagttgccacatttgccgtgcctgttcgtagcggcattgatgtttctcctagtaaatcagatggaaggttcgtttctatggatgagacaacatcttcatgtgattctatcaagagtccggatgaagttgaatatctggataacagggatgtttcagatgttgattcaattcagaaaaagataataagcaatttgaacatttctgataccacagagcccgaaggaaacgtatgtagtagggaaataattgttgagttggaagaaagagtggacaagattgtcaatatcgataacatttactctgatacgcagctttgtgcaacctatgtttgtgacatctacaaacacctacgtgaatccgaggaaaagaaaaggccttccactgacttcatggacacaattcagaaggacataaatgttagcatgcgcgctatattggttgactggcttgttgaggtggctgaggagtatcgtcttgtacctgaaacattgtatttgacagtgaactacttagatcggtatctttcagggaatgctatgaataggcaaaggttacaactacttggtgtttcatgcatgatgattgcctctaaatatgaggagatttgtgctcctcaggtggaagaattttgttatataaccgacaatacttacttaaaagaagaggttttgcaaatggaatctgctgtcttgaattatcttaagttcgaaatgacagctccaacagttaaatgtttcttaagacgatttgttcgtgcagctgctcatgatgtccaggagatcccttcacttcaactggagtacctaaccaactttattgccgaattatctctcttggagtacagtatgttgagttatcctccatcactgatagctgcttctgtaattttccttgccagatttatacttttcccttcaaagaaaccatggaattctacattgcagcattacacgctctaccggccttctgacttgtgtgcatgtgtaaaagatctccatcgtctttgttgcagcagccatgattctaatttacctgcaatcagagataaatacagtcagcataagtacaaatgtgtagccaagaagcacatccctccttcaatacctcaagaagttttccagagttgaacaaagtaaattcatgttgacaatccaattattggatgcacaggccaaggaaattcatgtctctcaatgatgcaaggaccatttcctgttagatgcatagttggaacttggaagatgatgcagatggagatgtgctgatggagctagtgtttttttccatggctagcataaaatagatgtcataaaaattctatatgacaaatttcgtcctcttgtatacacagcacttcaaatgcttaatcatttacaggaatgagaatattaatctcctctgattctgagtgtatacattgcaggcattttttttatatattcaaagtatgctcagttgcacatcaaaaaaaaaaaaaaaaaaaaaaaaaaaaaagcggggtctcccgagtagcccctctccccgctccccgctttccactcggttccttcttattattaaaatgaataaaaaacaaactaagcatgtgttagtat

SEQ ID NO: 76 - DNA, 367 bp, Glycine max
  Clone ID: PAT_MRT3847_119722C.1
tgaagagaaaaatcttaaaattccaattacatataataaaaacttcaacgtacttaataaaatatgcaatttggaaaacacttgataatggaaggacaaactaataacggcccagcgcatccacaatcataacaaacatgaatgccttacatctcagtgccaaagagatattatctaccaacaccttatgccttccaaaagatatggaggagaagttcaattctaattagcaagaaaatatttttactggacatactgaatcggtgcgtgtactttaaatttatctgctccatcatcctgcatgtaagaggtccaaagggcgaggttttcacaaaggatagcactctgatcatgcaactccttacgg

SEQ ID NO: 77 - DNA, 569 bp, Glycine max
  Clone ID: PAT_MRT3847_12032C.1
gaagatgcagcacggagatgacatcgttaaacttaaccctgttgacgtccgttaatccagatgatttccgttgccctatttctctcgagttgatgacggatccggtcactgtgtcaacaggtcaaacctacgaccgagcctctattcagaaatggctcaaagccgggaacacaaaatgtcccaaaacaggggaaaaactaacaaacacggacttagttcccaacacaacgctcaagagactcatccaacagttctgcgccgacaacggcatttccgtcgctaactcctgtaaccgtaaaaccaacaccgtctcagcaggtagtcccgcggcggcacacgcgattcagttcctcgcgtggttcctcacgcgcaggctagcattcggaacccaagaccagaagcacaaagccgcgcaggagattcgctttctcgccagaaccagcattttcaatagggcgtgtttgattgaaatgggaacagtgcctcctctgattgaacttttagcctctgcatcgaacgataataaatccacgcaagagactacaatctctgctctactgaagctctct

SEQ ID NO: 78 - DNA, 1512 bp, Glycine max
  UNSURE (1)..(1512): unsure at all n locations
  Clone ID: PAT_MRT3847_120799C.1
  unsure (1)..(1512): unsure at all n locations
actccgcaatgctgatttccattctctcttagtgtcagtcttattcctcccgaacccgaaattcagtccttaaatgataaataatatcccagttgtttctgctaaacttgggggagtaggaaaacatggccactttcgagcaattttggagcagaaaaacgttactaggtcttgctttgggacagtttctttctctcctcatcacttccactggtttcacctcttctctattggctaaaaaaggaattaatgcaccaacttctcagtcgtttctaaactatgtgttcttggcaattgtctatgggattattgttctatacagaagggaagcactcaaggcaaaatggtattattacatacttcttggattggttgatgttgaagcaaattttcttgttgtgaaggcatatcaatatacatcactaacaagtgtgatgctgcttgactgctggtccatcccatgtgtcatgctttttacatggattttcttaaaaacaaaatatggattcaaaaaggtcactggtgtagttgtttgcattgctggccttgtcctggttgtattttcagatgtccatgcaggcgaccgggcagggggaagcaaccctagtataggggacattcttgttattgctggtgctacattgtatgctgtcagtaacgtcagcgaggagtttctagtgaaaaatgctgatagagttgagttgatggcaatgttgggactctttggtggcattattagtgccattcaaataagcatacttgagcgcaatgagctcaaatctattcactggtcagctggggcagttcttccttttgttggatttgcggtggctatgtttatgttttactctttagtccctgtcctacttaagatcaatggttccactatgttaaatctgtctctattgacctctgacatgtgggctgtcttaattcgcatttttgcttaccatgagaaggttgattggatgtactatgtggcctttggtgctgttgttgttggtctcattatctactctggtggtgacggagatgagaatcaagaccctcatcatgttgctgaagatgctagccaaagacaacatgatgaagaagctacttcaggtaaatcataatataacagcagccaggctggaagctcaaaacactaagcacgcctgaagaggtgcttgaaaggtaaaaccatgacagagtctcctccaaagatgaagattttacttccattcaatttgtgtagatggaattttgagtgttttggacggttttttgaaagttggtactagatttttagtgaacatagtttgctaaatatgatatttaattatttttgaagaaaatctataagaaagattttcggagataataagtaacagccgtttattttttcgtatgaaatttgggatgttcgattaaaaattgttgcactttcttctaatatagttactgttgagatgttcatcgaggattttctaaaatggaattattnctagattaatcctgctgtttctagca

SEQ ID NO: 79 - DNA, 487 bp, Glycine max
  Clone ID: PAT_MRT3847_120904C.1
gctgccatgaatgactgctcatgctggattgtttgaggtaggttctcccaagaaaggagacactgtatacgatacacctgcctctggtgctgttggtcaacttcttggccaatacgctaagtcgactgggcgaaatgttgttggaagtgctggaaggaaagagaaggtggatctgctgaagaataaatgatgattagatgaatctgataactacaaagaagaaccagacctcaataccccttccaaaaggtactttccagaaggcattgaccttaactctgagaatgttgcgggcaaaacacttgatgcagtactcccaaacatgaaatttcatggacgaatacctgtctgcggattgatctctcaggacaatcttactcagtctgacggtgtcacaaatatggcaaatctcatatgtaagcgggtctatatggacggtttaattgcaactgatctctatcatctatatcctatattcttgaagcta

SEQ ID NO: 80 - DNA, 681 bp, Glycine max
  Clone ID: PAT_MRT3847_121346C.1
gtccggacttcccgggtcgacccacgcgtccgcaaggctcctgtgtctggtggggctcttggtggaggacggatggttgaaagactcactcaagtgttgcagtattggacactgctgctggtgtttggtgtgatataaaatctgttgttacgagttcaagaactggtagatacagtgctgatgcagcaggaggagatgctgcagttgagttgactcggcgttgtaggcacgcagcagctgctgttggtgacctaatttttatttatggtggtttacgtgggggagtcttgctagatgacctacttgttgctgaagatcttgctgctgctgagacaacagctgctgcttcacatgctgctgctgctgcagctgcatctgcatctaatgtacaagcaggacgcttacctggacgatatggatttgctgatgatagaacgagggaaacgatgcctgaggcagctgctgatggttctgttgttttaggaaatccagttgcgccaccaatgaatggtgacatttatactgatatcagcactgaaaatgccatgcttcagggacctcggcgaactgctaaaggtgtggagtatctggttgaagcatcagctgcagaagctgaagctatcagtgcagcactggctgctgccaaggcacggcaggagacgggagaagttgaattgcctg

SEQ ID NO: 81 - DNA, 481 bp, Glycine max
  Clone ID: PAT_MRT3847_121950C.1
tggaaacagcgaggactagagaaggagcaatagccaaagacaccactgaaactgaactcaccaaaatccctctcctccgggcaactgttgaaacactgcatccctcttccaaggaagaggatgattttatgattagaagattcctgcgtgctcgtgatttagatgtagagaaggcttcggcaatgttcctcaagtacttgaaatggagacatgaatttgttccaaatggttctgtatcagtgtctgatgttcctatcgaacttgcacaggataaggtgttcatgcaaggacgcgacaagataggtcgacctatacttattgtctttggtagaaggcattttcagaacaaagatggtctagatgaattcaaacggtttgttgtttatgttcttgataaagtatgtgcgagtatgccacctgggcaagaaaagtttgttggtatagcagaactgaagggatggggatactcaaacagtgacgt

SEQ ID NO: 82 - DNA, 1270 bp, Glycine max
  Clone ID: PAT_MRT3847_121951C.1
ggggaagaaacatttaatttgggttgataatagtttatgttaagatatcactactgctatatatatgttgccatagccaagttagccttataaagggaaactcacttgccttatttttggttttgagattgagctaaaggccaactcaaccatcgaatttgttggtgattgaaagagaaggaagaagaagcaggaaatggaagcagtgagagctggtcgagaaggagcaataggtctaggtcaaggtgatggcgtagccaaggacagcactgagactgaactcaccaaaatccgtctcctcagggcaattgttgaaacccgtgatccctcttccaaggaagaggatgattttatgattagaagattcctgcgtgctcgtgatttagatgtagagaaggcttcggcaatgctcctcaagtacttgaaatggagaaattcatttgttccaaatggctctgtatctgtgtcagatgttcctaacgaacttgcacaagataaggtgttcatgcaaggacacgacaagataggtcgacctatacttatggtcttcggtggaagacattttcagaacaaggatggtcttgatgaattcaagcgatttgttgtttatgttcttgataaagtatgtgcaagtatgccacctgggcaagaaaagtttgtcggtatagcagaacttaagggatggggatactcaaacagtgacgtgcgtggatatcttagtgctctatccattttgcaggattactacccagagagattggggaagttgtttattgtgaacgcaccatacatctttatgaaagtgtggcaaattgtttacccattcattgacaacaaaaccaagaaaaagatagtatttgtggagaaaaataaggtgaaatcaacactgctagaagagatggaggaaagtcaggtcccagagatattcggtggctcactgccattagtcccaattcaagatagctaattaattaagtaaccgctgacagaataaggagaggcgggcctaaaaataaatattgttatttcttatttatgtgtttctatgccgttttctttttacccaattactttacactgttgtatcagctatcaatattcagtagtaaatgagtacgatttttttttcctaaaaaaaaaaaaaaaaaggaaaaaaaaagaaaaaaaaaaaaaaaaaaaaaaaaaaaaaaaaaaaaaaaaaaaaaaaaaaaaaaaaagaaaaaccccaaaaaaaagagaaagaaaaaaaaaaaaaaaaaaaaaaaaaaaa

SEQ ID NO: 83 - DNA, 1566 bp, Glycine max
  Clone ID: PAT_MRT3847_12197C.1
ggtggcggacgcgtccgacggctgcgagaaacgacagaaggatacggctgcgagaagacgacagaagggtacgcgccagagaagaggacaagagggaaagagtgaactgagcgatagatgggactgcctaaccggctcccacgcccttgatggtcttctaagagaagttcgatccgtggggcgaggtaagagagggagtagagtaatatcgcttacagtaagaggtgagaaagagagacaaatcggcagaagcaaggaggcagagaccgagagagcaactgcacgcactgtaactcctaacttcccagatcgtcttcttcctcttttctctccggtgattgttggaactcagagagcttctttgatggaacagtacgagaaggttgagaagataggcgaaggaacatacggcgtcgtttacaagggtcgcgaccgcgtcaccaacgagaccatcgcgttgaagaagattcgcctcgagcaggaggatgagggggttcccagcaccgccattcgcgagatttctctcttgaaagaaatgcagcacaggaacattgttaggttgcaggatgtagtgcacgatgagaagagtttgtatctggtttttgagtaccttgacttagatctaaagaagcacatggattcatctccagaatttgcaaaagatccacgacaagtaaaaatgttcctgtaccaaattctctgtggcattgcatactgtcattcacatagagttcttcatcgagacttaaaaccacagaatttgttgatagatcgcagcactaatgcactgaaacttgcagattttggattggccagggcttttggaattcctgttaggacatttacacatgaggtggtaacactgtggtacagagctccggaaattttgcttggatcccgtcagtattctaccccagttgatatttggtcagtgggatgcatatttgcagagatggtaaatcaacgaccacttttccctggggactctgagattgatgaattgtttaaaatattcagaatcatgggtacaccaaatgaagatacatggcctggagtgacatcattgcctgattttaaatcagccttccccaaatggcagcctaaggacctgaaaattgtggttccaaatcttaagccagctggtcttgatcttctttctagcatgctttacttggatcccagcaaaagaattactgctaggagcgctcttgagcatgaatacttcaaagacattaaatttgtaccctgatttcttatcttcaaggctgaggtgtcttattagtatgtgtagcatttatgggttttgactcaaacgcgtgttgtccttgcttttttcttcaatgcttttggaccgaatcatatttcatttatttgttcttacatttttatttagtatgtgtgatcttgttacctatttacccgtttaatgtattagtctcgatgcaatgcaactagcaaatttcagtttgcttgacttgtttgtacttaatgctgaatgttgcttagcccggggcctgtaaaattggctactgttcctgtctgtaaactgcttttatctgctttccc

SEQ ID NO: 84 - DNA, 1820 bp, Glycine max
  Clone ID: PAT_MRT3847_122017C.1
cgcggcctgacctggaagcttcggtttctctctctctctctttctctttctcttagggttttcactttcaccaatttctccttctcttccgatctacgcccaaaggtatcacctcgcgtgcattcgttcctaatcctttcaaactctccgttctcccatctttaacttgtttaagctgctacgtttaattgaattcgccgtttccaaattgtcttttcatttctttcttttgttctgcaattagacattgctagggttctggagtactggattagctcattaaggattgagtactccatctatcttctgtcttcatggataaagacaaatctctaggtttgccacctccgtctggacgttattctggttactcgtccaccggaagtgttttcaacgtgaaatctgaaccgtccccgtcgtcgtcaaccacgttgtatccgccattggctccgggaactaccagttccgagtctagccattttggacatggattgtccacggattctagtggttttagtcatgatattagcagaatgcctgataatcccccgagaaatagaggtcataggcgtgctcattcggagattctcactttaccggatgatattagtttcgacagtgaccttggtgttgttggaggtggtgatggtccttccttctccgatgatgccgaggaggacttgctgtccatgtaccttgatatggataagttcaattcatcgtcggcaacgtccacgtttcagcatagtcaatccatggacgggtcaaccaccatcaagcctgagtcgccggcaggggcacccacctcttctaccgagaatgttgttattggggcaatagaaaggcccagagttgctcaccagcatatgattgccatcgacggtgcaaacaggatatggcctgagatgctggttgctgcgtcagaagacatgtctgcggctgattccaaaaaagcaatgtcagctgccaagcttgctgaacttgccttgattgaccccaaacgtgcaaaaaggatatgggcaaataggcagtctgctgcaaggtcaaaagagagaaagatgcgatacattgctgagcttgaaaggaaggtgcaaacattgcaaacggaagcaacatctttgtctgcacaattaactctcttgcagagagatacaaatggcttaaattctgagaacaatgaactgaagctgcggttgcaaaccatggagcaacaagttcacttgcaagatgcattaaacgatgcattaaaagaggaaattcagcatttgaaaatattgactgggcaagctatgccacctaatggaggacctatgatgaactttgcttcttttggaggggggcagcaattctatcccaataatcatgccatgcacacccttttagctgcacaacagtttcaacagcttcaaattcaccctcaaaagcagcagcagcatcagtttcagcagcttcagcaacagcagcgggaacagcaccaacaatcaattgacttgaaaatgagagaagctacacctactccatgccccaaagacaatgcctcatcagatgtaaatccttctggggccaaggactgttgagagttgagactgctcattgtcttctctatttgctttatagattttcctttgtcttgtgtcctagtgtgtttagcctttgttatattttttcattcttaaacagtacaaatggtcctagttagagattgagtataatacatttgcatctttgttattatgtaatactaaacttcttttgatactctgtagtcaattgctatggatatacaggggtaggttcatgtgtttagtctatgctatagc

SEQ ID NO: 85 - DNA, 913 bp, Glycine max
  Clone ID: PAT_MRT3847_122018C.1
agcatagtcaatccatggacgggtcaaccaccatcaagcctgagttgctggtctcgggttcggaagacatgtcggcggctgattccaaaaaagcaatatcagctgccaagcttgctgagcttgccttgattgaccccaaacgtgcaaaaaggatatgggcaaataggcagtctgctgcgaggtcaaaagagagaaagatgcgatacattgctgagcttgaaaggaaggtgcaaacattgcaaacagaagcaacatctttgtctgcacaattaactctcttgcagagagatacaaatggcttaaattctgagaacagtgaactgaagctgcggttgcaaaccatggagcaacaagttcacttgcaagatgcattaaacgatgcattaaaagaggaaattcagcatttgaaaatattgactgggcaagttatggcacctaatggaggacctatgatgaagcttgcttcttttggaggggggcagcaattctatcccaataatcatgtcatgcacactcttttagctgcacaacagtttcaacagctacaaattcaccctcaaaagcagcagcagcaacaacatcagcatcagtttcagcagtttcagcagcaacatcagcatcagcatcagcagcaccaacaatcaagtgacttgaaaatgagagaaacttcacctactccatgccccaaagacaatacttcgtcagatgtaaatccttctggagccaaggattgttgagagttgagactgctcattgtcttctctatttgcttcgtagattttcctttgtcttgtgtcttagtgtgtttagcctttgttatattttttcattcttaaacagtacaaatggtcctagttagagattgagaataatacatttgcatctttggtattgtgtaatattaaagttgttt

SEQ ID NO: 86 - DNA, 1944 bp, Glycine max
  Clone ID: PAT_MRT3847_122890C.1
aatcgcaaattttcttccccaaatcgtagatctacggtaaaattctccttccatcgctgcttccttttccttttcgcggattcccaaatctacatattcctcttcctgcacccccgtttgtgttccccgattcgcttctcgccttttgcacgtgcgaattagggtttcaattcgcgtttgccatttcatgaggccagatctagttgtattgcatgcattggtttaactggagtagtgtggtaagatgggaggtggatttagagtgcttcatttagttaggccgtttctatcgtttcttcctgaagttcaaactgctgacaggaaagtgccatttagagagaaggtcatatacactgtgatctctcttttcattttcctggtttgtagtcagctccctctatatgggatacactcaacaacaggtgctgatccattctattggatgcgagttattctcgcttcaaatcgtggaactgtcatggagcttggaatcactcccattgtgacttctgggctagtaatgcaacttctggctgggtcaaagatcattgaagtggacaacaatgtacgagaggatcgagccctgttaaacggggcacagaagctacttggtattttgatagctgttggtgaggcagttgcctatgttctttcggggatgtatggcagtgtggggcaacttggagtagggaatgccatcctcatcatcatccagctatgttttgcgggtataattgtgatatgtctagatgagcttcttcaaaaaggatatggtctggggtctggaatatccctattcattgcaaccaatatctgtgaaaacattatatggaaggcatttagtccaaccaccatcaacagtggacgtggagctgaatttgaaggtgctgttattgctctgttccatttgttgataactagaacagacaaggtccgtgctcttcgtgaggcattttaccggcagaatcttcccaatgtgacaaatttgcttgctactgtcttgatcttcctaattgtgatatacttccaaggtttccgtgtggtcttgcctgtaagatcaaagaatgctcgtggacagcagggttcatatccaatcaaattgttttatacctccaacatgcccatcattcttcagtctgcccttgtttccaatctctacttcatctcccagctgctccaccgtaagtacagcggaaacttcttcgtagatctattgggaaaatggaaggaatctgaatatggaggtggtcagtctgttcctgttggtggcattgcatactatatcactgcaccatccagcttagctgatatggcagccaatcctttccatgctctgttctatcttgtgtttatgctttcagcctgtgccttgttctctaaaacatggattgaagtctctggttcatctgctaaagatgttgccaagcagcttaaggaacaacaaatggtaatgcctggacaccgcgagtcaaacttgcagaaagagctgaaccgatacattcccacggccgcagcatttggaggcatctgtatcggtgctctgacagtgttggcagacttcatgggggccatcggttcaggaaccggaatattgcttgcagtaacaatcatctatcagtactttgagacatttgagaaggagagagctagtgagcttggcttcttcggtttctaagttctgccaagcaaataatgttggttggtgactccaacgagctctcccacaccccttgtttgagggatcgttatacttgtaggtcgtttaacatcgtaagggaggacataactagtttgttgtcaagatttacttttctttttttccctttcaactgaggaagtatcaagtagtacatcgttgttaacatttttgggtttcctctgaaatatacttgtgtttatcattaaattcaatctatacgtaagtctgacaccaaggtttaaaaa

SEQ ID NO: 87 - DNA, 370 bp, Glycine max
  Clone ID: PAT_MRT3847_123247C.1
ggctagaaaacatttttttaattttctaaaccgctttataagggaaatttcgggggctttatgaaaataggcggttcaaaaccccgtcctaggggagggacaaactaaaatagcccagtccctccccaattcataacgaaaaacatgaaggcccaaaatctcagtacccccgagattagcattcaacaccttttccctttgaaaaccttccccaggggaagttcaatccctaattaaaagtaggggatgtttaattttgtcccccgccccctttgggggcggcttttttaatttcatttgccccatcttcctgcatgtcagaggcccagagggtaaggttatcacaaaaaagttgcatgatcaaagggct

SEQ ID NO: 88 - DNA, 618 bp, Glycine max
  Clone ID: PAT_MRT3847_123814C.1
cttgtccctatttaaatagctatctagaaagtcctctctatgttccatttcatctcccatactcaaactcactctttctaagttttttctatctctttctctctctctgtctgccatggttctctccaaaaccacctccgaatccgacgtctctgtccactcaaccttcgcttctcgatatgtcagaacttcgcttcccaggtttaagatgccggaggagtcgataccaaaggaggcagcgtatcaaataataaacgatgagttgatgttggatgggaacccaaggttgaacttggcatcatttgtgacaacctggatggagccagagtgtgataaactcatcatggctgccattaataagaactatgttgacatggacgagtatcctgtcaccactgagttacagaatcgatgtgttaacatgatagctcatcttttcaatgcaccactagaagagactgaaactgcagttggtgttggcacggttggctcatcagaggccataatgttggctgggttggcattcaaaaggagatggcagaatagaaggaaactggaagggaagccttatgacaatcccaacattgtcactggtgccaatgttcaggtttgctggga

SEQ ID NO: 89 - DNA, 1171 bp, Glycine max
  Clone ID: PAT_MRT3847_124335C.1
gatattcaaaacacaacacagattccagtacatgacgtatgattagaggttttgtattttagcataacattgactattgttagctattggctccatgtgaaatgcgaatcaaatttgtttgaagctctgcatttgatttaaggggatccaagagcacccatcatctcacaatgatagccgttgaaaatgacaatgcaaatttctaaaatactaaaataatttattgaccaatcaaaacaagttgatcatagatggtccaaaactcaagtggccaccactttgttcacacaatccaacaataaaaatggccattttgctttaagaaattctcatgctgggttgaaatccattagcagtgaatcctccatcaactgaaacaatctgtccagtgatgtaggatgctgctggcaggcaaaggaaagtcaccaaggatgaaacttcatgtgtttctgccatccgctttatcggcgttcgagatattatctcactaacaagctgtttgttcgcaagcaaaggttccacaagtgaagttatggtataccagggtgcaacaccgttgctccttatattgtcttttgcccattcacaagcaaaatatttggtaagctgatcaatagcagctttagttgctgcgtaaatggctccagaacctacgcttgtctgacttgcaacagaggaaatggacacaatacttccatttccagatgctttaagaagaggatatgcaagttggcacaaatggtatgtggagtccaagttagttgccatcaattttgaatattcttcggctgtatactcaattgtcggcttcctcacatttgttccaacattgtttacaagtatgttgagcttgccgttgaaagcagaggccacttgttgaatgaggttctctctatggggtggagaagacgcatcacaaaccaacccagaaaccgaaaatcccttctctttccactccttcaagcatgcattcagctcttcttcattcctcgaacaagtgtacactgtggcaccaaactccgctagttcctccaccacagcgtgcccaattccacgcgttcctccagtaacgagagcagtggttcccttaagggaccatctagagcctctgctactgccttcagggttcgccattgttgtttgcttttggttttctggtgtccggcttcct

SEQ ID NO: 90 - DNA, 1038 bp, Glycine max
  UNSURE (1)..(1038): unsure at all n locations
  Clone ID: PAT_MRT3847_124426C.1
  unsure (1)..(1038): unsure at all n locations
ngaccttcccccactcatcaaacatttgatttgtatatggcaaaagacagtttcatacaactattgcactaaaacacaaaccaaatcaagacaaaaccagattctgagatcgcttcttctgtgaaaaaaaatcgtcttggcactgattcttttcagtttccaatgaactgagagtgaaaagcagggaattaatcagtttcatccagtgattgggttttggcaatcagatcaaaaaccatgagagaagaaggttcaggatatgacagcaccccttttttggatacccaatatgcagaatgtcacgtcgaaagaactggtacagtgtggactgcagtggcacacatagtgacaggagtgatagggtcaggagtgttgtctttggcatggagcattgcacagcttggatggattggagggccactcactattgttttctttgctgccatcactctcctctcttctttccttcttagcaacacatatcgttctccagaccctgaacttggccctcataggagctcctcataccttgatgctgttaatttgcataagggggaagggaatagtcgcttctgtgctgtttttgtgaacgtaagcttatatggttttggaattgcttatgtcattactgctgctatcagcatgagagcaatccaaaaatcaaactgttcccaagacaatggaaatgaagtaacatgtggatttggggatggatatttcatgcttatttttggggctatgcaagttcttctctcgcagatacccaacttccataatattcaatggttgtcaattcttgcagcaattatgtcctttgcttatgctttcataggaatggggctttctgtcgggcaagtcacagaaaatggacatgctgagggtagtattgaaggaatccctacttccagtggaattgaaaagttatggctggttgctcaagcacttgatgacatagcattctcctatccattctcagtaattcttattgaaatacgagatactttgaagtgccctccaccagaagacgtagccatgaag

SEQ ID NO: 91 - DNA, 2136 bp, Glycine max
  UNSURE (1)..(2136): unsure at all n locations
  Clone ID: PAT_MRT3847_124570C.1
  unsure (1)..(2136): unsure at all n locations
tcgctcgtccatacgacctaatccaattcagaccacgaaaaaaccaactacatcagctcatggcaacccccaaccccaccagattctcccttgccatggagagaaccgggcaatgggttttctccccagaaatccccaccgatgttattgttgcagttggacaaaccaatttttctctccacaagtttattctggcggcgaagagtaactacgtcagaaaagtgataatggaatcagaggagagtgacctaacaagaatagagatttccgacatacctggaggatcagaagcttttgagaaagcggcgaagttctgttacggcgttaacttcgagatcacggttcacaacgtggcggcgctgcactgcgccgctgtgttcctccagatgaccgacgagtattgcgacggaaacctcgccggaaggacggaggattttctctctcaggtcggcctctccacgctccacagcgccgtcgcggttctcaaatcctgccaaaagatcctccccttcgccgccgaggtcaacgtcgttgaccgctgcgttgaggtcatcagctgcaaggcttgcaacgaggcgaatttcccaagccagtcgccgccgaactggtggacggaggagctcgccgtgctcgacgtggattcctttgcaaaggtgatcaccgcgatgaagcagcgtggcgcaaagtacttgaccgtcgccggagcgttgattacgtacaccgaacgcgcgctgagggagctcgtcagggatcagaccggcggcggaaaaggaatccggtcaccggaatccggagactccgattcggagtcgaaaagaagcgaacagcgcgagcttctgcaggctatcgttcctctctttccgacggagaaagccgcgtttccgatcaacttcctctgctgcctcttgcggtgtgcgatctacctccgcgcgtcgagcgcgtgcaagcgcgagctggagaagcgcgtgacggagattctcgagcacgtgaccgtcgacgacctcctcgtgctcacgttctcctacgacggcgagaggctcttggatctggacagcgtgaggagaattatctccggttttgtggagagggagaagggcacgacggtgttcaacgccggcgtcaacttcaacgaggacttctccgccgcgatgcagcgcgtggccaaaaccgtcgactcgtacctcgctgagatcgccgcgtacgccgaactctccatctcgaaattcaacggcatcgccatcctcattcccaaaggcgcgagaaaatccgacgacgatctataccgcgccgtcgatatctacctcaaggtgcacccgaacctggacgagatagagaaggagaaagtgtgcagtgtattggacacgttaaaactgtcctacgaggcgcgtgtgcacgcgtcgaagaacaagcgtttgccgctacagatcgtgcttcacgcgctgtactacgaccaactacaaataaggagcggtacggcggcggacaagcaagctgtggtggcggcggcggagaaaaaacagctgcaagctgacgtgtccttggtgagggagaacgaggagctgcggtcggagctgatgaagatgaaaatgttcatttccgatttgcagaagaatgttcacggaacgtcgtcgtctgggagggagaatattgggcccactaaaaagcccacgttcttctcgtccatgtccaagaaactgagcaagttgaacccgttcaagaatgggtctaaggacacgtcacacatcgacgatgcccctgtggacttgaccaagcccagaaagagaaggttctccatttcctagatttgctttccttagtcaattccaagctttgtcaaaaagaattttaaattttttgaagtaattacgttttctctcttgattgttaatttttttcatgaaagtgtcaatttgtaattaagaaaaaagtgagacgtgattggatttcttaaattagatttgttcatatctgtatgttaagatgtatttgatctggatatataggaacatcctagtttcaatatgaattaatgagaattataataaaaatgctttgagtcgtgcttaaaaaaaaaaaaaaaaaaaaaaaaaaaaaaaaaaaaaaaaaaaaaaannaaaaanaaaaannaaaaaaaaa

SEQ ID NO: 92 - DNA, 930 bp, Glycine max
  Clone ID: PAT_MRT3847_124754C.1
ggctatctaaggttccggagggtgtagacaacaacaggggcaatgtttacattggcagtacaagcccgacaaatgttgcaagagcttactatgagcaatttcaaagagatttctctctttttctcaagtgtcgtgcagaggaattagttaaaggaggtcgtatggttctaacatttttgggaagaagaagcgatgatccctctagcaaagatggtggctacgtttgggagcttatggctactgctcttaacgatatggtcttgcagggaatcataaaagaagagcagttagatacttttaacattcctctatacactccatctccttctgaagtgaaattggaagttcttaaagaaggttcatttgccagcaatcgtctagaggtgtctgaagtgaattggaatgcttttgatgactggaacgctcttgaatttgaatctgaaaggtctgatacacttagtgatggcggatacaatgtggcacagtgcatgagggctgtggcagaaccaatgcttgttagccactttggtgaagctatcattgaagaggtttttagccgctaccaacaaatcttgactgatcgtatgtccaaggagcaaactaagttcatcaatgtcaccgtattattgactagaaaagcataagcaagaagtttgcatctatatagggtttctcaaaatgggattgttgtagtcatagtttaaaaatccggctcgactaggcttgtcggatcgagatctgatgacataacccgtctgatttgattattggaccggttatgtatttggtccagaataatccggtccaacccgcccgatttggagtaaattcggtgattctgtctgatatttccatttcgcctaaaaaagaatacaaaaaaaatgttaaaaaaatttaagacttaaaaaaaaaaaaaaaaaaactgagact

SEQ ID NO: 93 - DNA, 2482 bp, Glycine max
  Clone ID: PAT_MRT3847_124919C.1
ccacacgtccgacgtgggaggaaggaaagagcatacgtgttgcgttagtgtttagtgttatatctccgcagtggatcaaatcaaacaaacacttccatccatcaccctttctctctgcttagggttttgatcgcatcggatcttcactctcttctccgatctcaaaatgcccgccgtttatggagctcgcttgaccaccttcgaagactccgagaaggagagtgaatacggttacgttcgcaaggtatcaggaccagtcgtcgttgcagatggcatggctggggctgctatgtatgaactcgtgcgtgttggtcatgataatctcattggtgaaattattcgtctcgaagggaattctgctaccatccaagtttatgaggaaactgctggcttgatggttaatgatccggtgttacggactcacaagcctttatccgtggagttgggacctggaatactggggaatattttcgatggaattcagaggcctttgaaaactattgctaaacgatctggtgatgtctatattcctcgtggtgtctctgttccagcactcgacaaagatacactttgggaatttcaacctaagaaaattggtgaaggcgaccttttaactggtggagatttatatgctactgtttttgagaacagtctaatgcaacaccatattgcacttcctcctgataacatgggaaagattacctacattgcaccacctggccaatattccataaaggatactgtattggaacttgagtttcaaggtgtcaaaaagaaattcaccatgcttcagacttggcccgtacgtacaccaaggcctgttgcatcaaaacttgcagctgatactcctcttcttactggtcagcgtgttcttgatgcccttttcccctcagttcttggcgggacttgtgccatacctggagcttttggttgtggtaaaactgtcattagtcaggctctttctaagtattccaattctgatgccgttgtatatgtcggctgtggggaacgtggaaatgaaatggcagaggttctaatggactttccccaacttacaatgacattacctgatggtcgtgaagaatctgtcatgaagcgcacaacactagtggctaacacttcaaacatgccagtggctgctcgtgaagcttcaatttatacaggaatcacattagctgagtatttcagagatatgggttataatgtcagtatgatggcagattctacatctagatgggcagaagcattgcgtgaaatctctggacgactggcagaaatgcctgcagatagtggatatcctgcataccttgctgcacgtttagcctcgttctatgaacgtgctgggaaggtaaaatgtcttggaggccctgaacgtacaggtagcgtaactattgttggtgctgtttcgccacctggaggagatttctcagatcctgtgacatctgcaaccctgagcatagttcaggttttctggggtttggacaaaaagcttgctcagaggaagcactttccttctgtaaactggcttatttcttattcaaaatactcaacggcacttgaaaccttttatgagcaatttgatccagattttatcaacattaggacaaaggctcgtgaagttctgcaaagggaagatgacctgaatgaaattgttcagcttgtgggcaaggatgctttagctgaaggagataagatcaccttagaaactgcaaagcttttgagagaggattatcttgctcaaaatgcctttacaccatatgacaaattctgccccttctacaagtctgtttggatgatgcgcaacattatccatttctacaatttggcaaatcaggcagtagagaggggagctggttcagatggtcagaagatatcttacacccttatcaagcatcgtatgggagatctgttctaccgattagtgtctcagaaatttgaggatccagcagaaggggaagctgctttggttgctaaatttcagaagttacatgaggacctgactaatggtttccgcaaccttgaggacgaaacccgatgattgatgatttaggtatggtagtttgctcaaatattgtgttatttccaattgtaagaggcagtctagcatcgcagggttacaacgtcccgagtgttcttatatttgactgtttgattcattcatatcacatttatttcctttcttggtgctggtttggcttttgatctagtctcatgtgtagctataatcatgtgtttcagtcatcctcagtttgtttattgaaaataagaaacgaaacttgctctttcaatatgtatttaggagaataaagttattttagaacatgaagtgcctgcggcaatcggattccggattcatataggtggaatttttggtggaagtggattatcttgaatcctgtatttcatagatggacttcttgtagcaaagagtatttaattatttattcaaaatatgttatacatgttaaaaaaaaaaaaaata

SEQ ID NO: 94 - DNA, 257 bp, Glycine max
  Clone ID: PAT_MRT3847_125358C.1
acgcaattcgacgcgagcacaagcactccgatgatcagggtcgcaaggttgacaagtatgacaacattacgaaacaagctaacgaatacggcaaccctattcatcctgctagtgtcacctcatgtaccccaccaaaccacctactggtagttacagtgatgacattaataagcaacatgataccaccaatgcctacgacgtagacactcgtaaacagcattctagtggtagctacgatggtgacactaataaacatc

SEQ ID NO: 95 - DNA, 142 bp, Glycine max
  Clone ID: PAT_MRT3847_125661C.1
ggtcatcctgtttgcgggctgcttatttaatttcatctgctccatcatcctgcatttcagaggtccaaagggtgagggtataacaaaggaggtgcatgatcagaagggtatcctttgttgactcctttcccagtgtatccaa

SEQ ID NO: 96 - DNA, 1637 bp, Glycine max
  Clone ID: PAT_MRT3847_125727C.1
tttgatttagccttttcttttctcttttggttgtcatggtggttatttcacctcctcttagatctgaagagtttcataagggtttttgctttgcccatcattgattctcttgagttttgtaaaagaaagcctcttttagattcctttgatcataagaagctcctatcctctgcattcctctctgagggtatctctctctctttgaacttagagagagagagagagagttgaatttagaagtatcgtttttgctatgtgcaattgttagagagatcaatgaataggggaattgaagtgctctctccagcctcctatctccaaaactccaattggttgttccaggaaagcaaggaagcaagatggactgcagaagagaacaaactgtttgaaaatgccttggcttactatgataaggacaccccagatagatggatgagggtggcagccatgattccagggaaaactgttggtgatgtgatcaaacagtacagagagcttgaggaagatgtgagtgtcattgaagcaggtttgatcccagttcctggctatactactgccagttctttcacattggagtgggttaacaatcaaggctatgatgagttcaagcagttctgtaatgttggtgcgaaaaggggtgcatccacgaggccaactgagcaggaaaggaagaaaggagtgccatggactgaagaggagcacaggcaatttctgctgggtctcaagaagtatggtaaaggggattggagaaacatctctaggaactttgtgaccacaaggacaccaactcaggttgcaagtcatgctcagaagtacttcatcaggcagcttacaggagggaaggataagagaagatccagtatccatgacatcacaatggttaatctccaagaaacaaaatctccttcatcagacactaccaaaccctcttctccacttcagaatcaggcattgtctagcatggttaaggaggaatatgagtggaaattgccatgtgagggcatgcccattgttttcaattccacaagtggaaacatgttcatgtcagcaccactgcatggcatttcttcatatgaatctagaccacaggagcaaaatttacttagacaatctccatggatgccagttttcaccttgtgatgctattttgcaaatgcaattgatgcgacatcggtgatctatacaagtggtgcagggattagagttttgaagttagatggaaggtttgtgtgagctagcatccgatgttcatcttcctatataggcagccaggagttatctgcagatcgccctgaggaagaggagctatctcttgcctttttaaaagatgcttcaaataaatatattcagttccaagtatacataaagaattaaataaaggcatcaatcatgttgatgtactagtggtgtaatataaaacaatttggactgttaatttttataaccctatattaggagtgtatttcaagccataaagttatgattataccagaaagattttccaagtgtggtgaggagttggacagagctttggtcctcatgtaaaaatgtgatcataaagcatttgatatgaaacataatgtcttggaagcatttgttccacaacatggtggacattaagatccaagctgaaagtc

SEQ ID NO: 97 - DNA, 915 bp, Glycine max
  Clone ID: PAT_MRT3847_126514C.1
ggcttcgctctcgtcaagtttcaggccttccttagtagcagagaccaacttctttccctcaaattccttaagctgaccaacagcatactcgtcaatagcatcaaccatgtagagaacctcgaaccccttcttcttaagcttttcaaggaaaggggaattctcaacagctttcttgctttcaccagtaatgtagtagatgtcattctgcccttccttcatcctggtaacatagtccttgaggctggtcatctcatcaccactcttggtggagtgatacctgagcaattcagcaagttttgtcttgttctgagaatcctcatgaataccaagtttcagattcttagagaaggcttcataaaacttgttatagtcttccttgttctcagcaatttcaaagaacatctcaatgcacttcttgaccaagttcttcctgatgactttcaggatcttgttctgctgcagcatttctctagaaatgttgagaggaagatcctcagagtcaacaatgcccttgacaaagctcagccactctgggatcagctcctcacagttgtccatgatgaagacacggcgcacatagagcttgatgttgttcggcttcttcctggtgtcaaagaggtcaaagggggccctcttcggcacaaacaggacagccttgaactcaagctgaccctcaacagagaagtgcttcacggcgagatgctcctcccagtcgttggtcaagctcttgtagaaagcagcatactcttccttggtaatatcctcaggcttcctcatccagataggcttctgcttgttaaccaattgccactcatgagaaacctccttgatcttcttcttcttcttttccttttcttccttctcatcaacatcctcaaccttgccctcctcgtccttcttatctcggacgcgtgg

SEQ ID NO: 98 - DNA, 1959 bp, Glycine max
  Clone ID: PAT_MRT3847_126516C.1
cggttgcgtgggcggacgcgtgggcttctgtccgctgcgactctctttccttccctctttttccgaatctgaatcgaaatggcttcggagactgagacgtttgcttttcaggccgagatcaaccagctcctcagtctaatcatcaacaccttctacagcaacaaggagatctttcttcgtgagctcatcagcaatgcctctgatgctttggacaagattcgatttgagagtcttacagacaagagcaagcttgatgctcagccagagttgttcattcacattattcctgacaagaccaacaacacattgtctatcattgacagtggtattggcatgactaaggccgatttggtgaataacctcggtactattgcaaggtctgggaccaaggaattcatggaagccctggctgctggtgctgatgtgagcatgattggacagtttggtgttggtttctactcggcttatcttgtagctgacaaggttattgttaccacaaagcacaatgatgatgagcagtatgtctgggagtcccatgctggtggctcatttactgtgacaagggatacatctggtgagaaccttggtaggggaacaaagataactttgtttctcaaggaagatcaacttgagtatcttgaggaacgccgtctgaaggatttgataaagaagcattctgaattcattagctatccaatttctctttggattgagaagaccactgaaaaggagatttctgatgatgaggacgaggaagagaagaaggatgaggagggtaaagttgaagatgtggatgaagataaggagaaggaggagaagaaaaagaagaccattaaggaggtatctcatgagtggtcattggtgaacaagcagaagcctatttggatgaggaaacctgaagagatcacaaaagaagaatatgctgctttctacaagagtcttaccaatgattgggaagagcatttggctgttaagcacttttctgttgagggtcagctggagtttaaggctgtcctctttatccccaagagggcaccttttgatctttttgacactaagaagaagcctaacaacatcaaactgtatgtccgccgtgttttcatcatggacaactgtgaggagttgatgccagaatatcttagctttgttaagggtattgtggattctgaggatcttcctctcaacatttctagagaaatgctgcagcagaacaagatcctgaaagtcatcaggaagaacttggtcaagaagtgcattgagatgttctttgaaattgctgagaacaaggaagactataacaagttttatgaagccttctctaagaatctgaaacttggtattcatgaggattctcagaacaagacaaaacttgctgaattgctcaggtatcactccaccaagagtggtgatgagatgaccagcctcaaggactatgttaccaggatgaaggaagggcagaatgacatctactacattactggtgaaagcaagaaagctgttgagaattcccctttccttgaaaagcttaagaagaaggggttcgaggttctctacatggttgatgctattgacgagtatgctgttggtcagcttaaggaatttgagggaaagaagttggtctctgctactaaggaaggcctgaaacttgacgagagcgaagacgaaaagaaaaagaaggaagaattgaaggagaaatttgagggtctctgccatgtgatcaaggatgtgttgggtgacaaggtggagaaagttgtggtgtctgatcgtgttgtggattctccttgctgtctcgtgactggtgaatatgggtggacagccaacatggaaaggattatgaaagcacaggcattgagggacagcagcatggctggatacatgtcgagccagaagaccatggagattaaccctgagaaccccatcatggatgacctgatgaagcgagctgatgctgacaagaaa

SEQ ID NO: 99 - DNA, 2076 bp, Glycine max
  Clone ID: PAT_MRT3847_126518C.1
ccacgcgtccgccttttcgttctgttttggcttcttcgctgcaactctctaccttccctctttttccgaatctgaatagaaatggcttcggagactgagacgttcgcttttcaggccgagatcaaccagctcctcagtctaataatcaacaccttctacagcaacaaggagatctttcttcgtgagctcatcagcaatgcctctgacgctttggacaagattcgatttgagagtcttacagacaagagcaagcttgatgctcagccagagttgttcattcacattattcctgacaagaccaacaacacattgtctatcattgacagtggtattggcatgactaaggctgatttggtgaataacctcggtactattgcaaggtctgggaccaaggaattcatggaagccctggctgctggtgctgacgtgagcatgattgggcagttcggtgttggtttctactcggcttatcttgtagctgataaggttattgttaccacaaagcacaatgatgatgaacagtatgtctgggagtcccatgccggtggctcatttactgtgacaagagatacatctggtgagaaccttggtaggggaacaaagataactttgtttcttaaggaagatcaacttgagtatcttgaggaacgccgtctgaaggatttgataaagaagcattctgaattcattagctatccaatttctctctggattgagaagactactgaaaaggagatttctgatgatgaggatgaggaagagaagaaggatgaggagggtaaagttgaagatgtggatgaagataaggagaaggaggagaagaaaaagaagaccattaaggaggtatctcacgagtggtcattggtgaacaagcagaagcctatttggatgaggaaacctgaagagattacgaaagaagaatatgctgctttctacaagagtcttaccaatgattgggaagagcatttggctgttaagcacttttctgttgagggtcagctggagtttaaggctgtcctctttatccccaagagggcaccttttgatctctttgacaccaggaagaagcctaacaacatcaaactgtatgtccgccgtgtcttcatcatggacaactgtgaggagttgatgcctgaatatcttagctttgttaagggtattgtggattctgaggatcttcctctcaacatttctagagaaatgctgcagcagaacaagatcctgaaagtcatcaggaagaacttggtcaagaagtgcattgagatgttctttgaaattgctgaaaacaaggaagactataacaagttttatgaagccttctctaagaacctgaaacttggtattcatgaggattctcagaacaagacaaagctagctgaattgctcaggtatcactccactaagagtggtgatgagatgaccagcctcaaggactatgttaccaggatgaaggaaggacagaatgacatctactacattactggtgaaagcaagaaagctgtcgagaattcccccttccttgaaaagcttaagaagaagggatacgaggttctctacatggttgatgctattgatgagtatgctgttggccagcttaaggaatttgagggaaagaagttggtctctgctaccaaggaaggcctaaaacttgatgagagcgaagacgagaagaaaaagcaggaagaactaaaggataaatttgagggtctttgccatgtgatcaaggatgtgttgggtgacaaggtggagaaagttgtggtgtctgatcgtgttgtggattctccttgctgtctggtgacaggtgaatatgggtggacagccaacatggaaaggattatgaaagcacaggcattgagggacagcagcatggctggatacatgtcaagcaagaagacgatggagattaaccctgagaaccccatcatggaggagctgaggaagcgagcagatgctgataagaatgacaagtctgtgaaggatctcgtgctcttgctctttgagactgctcttctaacttctgggttcagccttgatgatcccaacactttcggctacaggattcacaggatgctgaag

SEQ ID NO: 100 - DNA, 2186 bp, Glycine max
  Clone ID: PAT_MRT3847_126530C.1
tccgcgcgagcacccccccggtccctcattcttcccacgcaacaaaacttcccttgttcctgctcctcgaacccttgagagcgagaaaccacgtttctctcttgaggttaattattattattattgagtattgagcatggaggcgccatctctcaccaaacccaacgacccaacaaaaccttccaacacttccagcacccttagtctggagggggggccgggcgaagcgagcccactccgaaaaatgtttgcggtggcgtccatcgccgccggcatacagttcgggtgggctctgcagctgtctctcttaaccccctacgttcagctcttaggagtcccccacgcggcggcctccttcatctggctctgtgggcccatctcggggctggtggtgcagcccattgtgggctactacagcgaccactgcacctctcgcttcggccgaaggcgccccttcatcctcggaggcgccttagccgtcgccatcgccgtgttcctcatcggctacgcggccgacataggacactccgctggcgacgacataactaaaaaaacccgaccccgtgcagttggggtcttcgtcataggattctggatcctagacgtggccaacaacatgctccagggaccctgccgcgcctttttagctgacctcgctgccggcgaccagcaaaaaacgagaatcgccaacggtttcttctcgttcttcatggccgtcggcaacgtgcttgggtatgctgcagggtcctacagcggtctccacaagatcttccccttcacggagaccaaggcctgtgacgtcttctgcgcaaacttaaaaagctgtttctttttctcgatcctactgcttctctttttagcaactgttgctctgctctacgttaaggacaagcaagttgaagcaattcctctggatgatgccactcaaccctcttgtttctttcagcttttcggtgctctgaaagagctcaagagaccgatgtggatgctgatgctggtgacagctgtgaactgggtggggtggtttccttacttttttttcgacaccgattggatggggcgcgaggtgtacggtggtcaagtgggggaggacgcgtacgccaatggagtgcgcgttgggtcgctagggctgatggtaaacgccgtcgttttgggcttcatgtcgctggcggtggagccgttggggaagatggttgggggagtgaagaggctgtgggcgattgtgaactttattctggcaattgggttcggaatgacggtggtgatcaccaaggtggcggagcaccagcgcaagatgaatcccgccgccgtgggtcacccctccgaaggggtggtggttgggtccatggttttctttggggttcttggagttccccttgcgattactttcagtgtcccttttgctctagcatcaatatactgcagcgcttcaggagcaggacaaggtttatctttgggagttctcaatcttgcaattgtggtaccacagatggtggtgtctgcattaagtggtccttgggattccttgtttggtggtggcaacttgccggctttcatggtgggtgctgcggcagccgcgttgagcgccataatggcgattgtcttgctgccaactccaaagccagctgatgaggccaaggcttcaagcatgatggcagggggctttcactagttaatggagttttgcatgtttcagttttgtcccctgctttaatagaaagaaaaaaaaaaacagtaataaaagaggaaaaattggatagtctcttttgatttgaagctggtgtgtaattatgtaatagacccaccaagtgctacatttgtaaccttttgtagcacccactgaacatagtaattgcagagtttggtgtgattgtacataattgcagtggttggaacttcttggaagacccttcctcttatataattttagtctgtttcagtgttcagaggaatgtggtgattaaggatgagtcttagtttaagactttacatcaattaatgataataagggaaatgctactttttacaaagatcaaaaaagtaattaaggaagagtcttagttttaagactttatatcaattaacgttgcttagcgtattgctacttttccctcctttacttatctgtttctttacatgtaaaaagtattatgagaaagtgttataaaaataatatttctcatttg

SEQ ID NO: 101 - DNA, 2491 bp, Glycine max
  Clone ID: PAT_MRT3847_127203C.1
gccgtgagggagagcgcttagggatttgtgagtgccttggtaactcgcgctcgcccgcgtgcgtcctttcttcttcttcttcttcttcctgtcttcacctaaccaaatgggcgcctccaccacctgatccacctctgtttcttcttcctttcatccgttcatacgggggttagatgatggagtcctgtgattgtatagatacgcagtatccgccggatgaacttcttgtgaagtatcagtatatctcggatgtgctaattgctcttgcgtatttttcgattccggtggagctcatctattttgttcagaagtctgctttctttccgtatagatgggtgcttatgcagtttggtgcctttattgttctctgtggagcaactcatttcataaacctgtggacattctctccgcactctaagtctgttgctgttgtcatgacgattgccaaagtttcgtgtgctattgtgtcatgtgcgacggcactgatgcttgtacacattattcccgatctgttgagtgtcaagaggcgcgaatcgatcctcaagaacaaggctgaagagcttgacagagagatgggacttattcttactcaggaagagacgggaagacatgttagaatgttgactcatgaaattaggagcacacttgacaggcatacaattttaaagactactcttgtggagctggggaggactttgggcttggaggagtgtgcattatggatgccttcgagaagtggtctgaatctgcaactttcccatactttaacctatcatgtgcaagttgggtctacggtgcaaacaaacaatcctattgtcaatgaagttttcaacagccctcaagctatgcggataccacccacctgtccattggccaggatcagacctcttgtgggaagatatgtgccccctgaagttgttgctgttcgggtgccgcttttgaatctgtcaaattttcaaattaacgattggcctgatatttcagcaaaaagctatgcaatcatggttctcatcctccctactgacagtgttagaaaatggcgagaccatgagttggaacttgttgatgttgttgcagatcaggtagcagttgccctttcacatgctgctattttggaggagtctatgcgtgcccgtgatcaattcatggagcagaatgttgctttagatttagcccggcgagaggcagagatggcaattcatgctcgcaatgattttcttgctgtcatgaatcatgaaatgaggacaccaatgcatgcaattatagcattgtcatcacttctcttggagactgaactgacgccagagcaaagggttatgatagagacagtgttgaagagtagtaatgttttggcaacactcattaatgatgttctagatctttctcgacttgaagatggtagcctcgaattagaaatgggaaaattcaacctccatggagttttgggagagattgttgaactgataaaaccaatagcatccgtgaaaaagttacctatcaccttaattctgtctcctgatctgcctactcatgccattggtgatgaaaagcggcttacacaaactcttttgaatgtcgtgggtaatgctgtcaaattcactaaggagggctatgtttctgtaagagtatcagttgcaaaaccagaatcttcacaggattggcgacctccagagttttatccagcatctagtgatggccatttctacattcgagtccaggttaaggactctggatgtgggattctcccacaagatattccgcatctctttaccaagtttgcccagtctcggagtggaccagctcgacctagcagtggtgcaggtcttgggcttgccatttgtaaaagatttgtaaacctcatgggaggccacatatggattgagagtgagggccttgacaaaggaagcacagctacatttatagtcaaacttgggatttgtggcaatccagatccatccgatcatcaagctgcaaacagaagccaagcatatagtggaagtggtggcctcgctagatttaaacccttcatcacagatgaaaacgacactggtttttctactagacgcaatcaaagaagtttctaatatccaagacaccaaaattgcatacctctcaatcacagtcgacaagatggagtaaacctcctactttcattttgcatgtgctaaattgtataatttgcagtttgcggctgtagaataggattactatgtcaggcatatttctaacaaacaggttttatgcgaactcctgttgtattaactagaatacaatacaacaaaacaaagttgagagacgatctgttacttaatttgacttgtagtatatattgtcagtggcttttgccgtttagcgttcataaaaatgacagtattggcatgaatcagttgtcatccctccccatgttccgtgattcgttagatttggtgtctgtcgtttgtgctaaacttaaactgttttgtgaaagaaacataggataagtggacggatc

SEQ ID NO: 102 - DNA, 660 bp, Glycine max
  Clone ID: PAT_MRT3847_127234C.1
gtatgctgatatgcactattcaaataggagcattagctatgtttgttaatgtcactttatggtacgtggagtgtcttaggtgacttacccacagaacatagaacgagtgaagtacgtagagataaaattatagaacaagaatgaaggtagcacaggtactgcacatgaacggcggcgttggacacgcaagctatgcaaacaactcccttcttcagcaaaaggtgatttgtttgacaaagcccataagagaggaagccataacaagcctctattgcaacaccgtccccagaagcttggcggttgcagatttgggttgctcttctggaccaaacactttgcttgttgtgtctgaattcatcaaaattgtggagaagctttgtcgggagctaaaccataaatctccagaatacaaggtctttctgaatgatcttcctgggaatgacttcaacaacatcttcaagtcccttgatagcttcaaaaagaagttgtgtgatgaaatggaaagtgggattggtccatgctacttctctggggttcctggttctttctatggcagggttttcccaaatcaaagtcttcattttgtccattcctcttatagccttcactggctatctaaggttcccgagggtgtagacaacaacagggcaatgttacatt

SEQ ID NO: 103 - DNA, 270 bp, Glycine max
  UNSURE (1)..(270): unsure at all n locations
  Clone ID: PAT_MRT3847_127507C.1
  unsure (1)..(270): unsure at all n locations
agcgaatccctctctctctttctctttctctctcatccagatcttgcaaaaaaaaaaaaacacaatggnagcgagngctccnantcnangcgaaganttcgtgtacatggcgaantggcggannaggccgagcgcnacgnggagatggtgganttcatgganaaggtctcngcctccgccgagagcgaggagntgaccgtggaggagngcaacntcctctcngtggcctacangaacgnaatcggcgtncgcngcgcctcctggcgataa

SEQ ID NO: 104 - DNA, 1754 bp, Glycine max
  Clone ID: PAT_MRT3847_127582C.1
ggcttcctttttctttctttggttcctttccccagccaggtctttcttggaaaagaaaaagtctttgggtttgtgcagtagttgagttgaggaagtgatggaagcagtttacaggttgaaacctctttccgggacatgacgaagagggttcatcttgttagggaggtcacaacgttaattctgccattgcagcaaatcgttaccttgtccatggcaatctcgggtcgttgtgcaggtaccttcatgctccaactacttccccttgcttcctcgtcattatcatcatctgtaatttcgtattagcgtacactacacacactcctcttcctagctgccttcacagcaaaatactggttgaaacctcttttgccttgtctagaggaggaagtggttagagttgggaacgctactacttctgagatgcgtgttggatcaacggctaattgttgttacctgcagctggaagctcctcaacagaataatgtaaccgagtcatcatcagatatgtcagatcggatgatcaagatccagatcgcaaatcaccctctttatccagatttactctctgcatatatagaatgccaaaaggttggagcaccgccggaactggcatgccttcttgaagaaataggccgagaaagccaccgcatgaatgctcgccgtgagattgtggagggtcctgaacttgaccacttcatggaaacattctgcgaagttcttcatagatacaaggaggagttgtccaggcccttcaatgaagcgacgttatttttgggtgacatggaatcacaactcagcaacctttgtaatggaacactaacaaagtcatcggataacaacaaccgctccgatgaggtagctagtggggcatcagaagaggaattaagttgtggggagatggaagcatttgaagatcatgtatcttcttctgtaacttgcccaagtgatcaaaggcttaaagaaatgctccttcgcaaatacagcggccattttagcggtttgagaaaggaatttctaaaacgaagaaaaaagggtaagctaccaaaggatgcaaggatagcactcatggactggtggaacacccattatagatggccttatcctacggaagaggagaaagtgaagttgtcagaaattactggactggatcaaaagcagatcaataattggttcatcaatcagagaaaacgtcattggaaaccaactgatgacatgcgatctgccgttatggacggcataagaggacctatgttgttttaattctggaaagtggtcctcaacgatctgattctgaacttggaatctttgcaattgcaggagtaatgtatatgtattgcattccctgttatacatgatatactaaattttggagtctgaactgatgattgccaggtgcgtttggctaatatacttatcaaatttgtagctatggtagtgtaatgcgtcattgtagtgaagcattgtcgaatcttttattactttttgcggtaatgtcatcatgaagaaagaaaagaatggatttttctggaggtagcagtcatttctctgaagttgtacccaaaaattattaatgagcaatgtatgtgcattgcattcctgttacacgtgatatatatactaaattttagagactgaactgttgtttagctaatatacttgtcaaagttgtagttatagtagtgtaatgcgccattgttatgcagtattcctgaatctttgattatattataacaatgtcgtgctgaagaaaaata

SEQ ID NO: 105 - DNA, 1248 bp, Glycine max
  Clone ID: PAT_MRT3847_127587C.1
gagaattagatatacatattttatttatttgcttaggatattgtcctaaaacttacttgcttggaccccagtagttgagttgaggaagtgatggaagcagtttacaggttgaaacctcttttggatgtggttagagttgggaacgctaccacttctgagatgcgtcttgactcaacggctaattgttacctgcagctagaagctcctcaacctcaagagaataataatgtaaccgactcatcatcagatatgtcggatcggataatcaagatccagatcgccaatcaccctctttatccagatttactctctgcatatattgaatgccaaaaggttggagcaccgccagaactggcatgccttcttgaagaaataggccgagaaagccaccgcatgaatgctcgccgtgagataggggagggccctgaacttgaccacttcatggaaacattctgccaagttcttcatagatacaaggaggagttgtccaggcccttcaacgaagcgactttgtttttgggtgacatggaatcacaactcagcaacctttgtaatgaaacactaacaaagtcatcggataacaacaaccgctccgacgaggtagctagtggggcatcagaagaggaattaagttgtggggagatggaagcatttgaagataatgtatcttcagtaacttgtccaagtgatcaaaggcttaaagagatgctccttcgcaaatacagtggccattttagcggtttgagaaaggaatttctgaaacgaagaaaaaagggtaagctaccaaaggatgcaaggatggcactcatgggctggtggaacacccatcatagatggccttatcctacggaggaggagaaagtgaagttatcagaaattactggtctggatcaaaagcagatcaataattggttcatcaatcagagaaaacggcattggaaacctaccgaggacatgcgatttgccgtcatggacggattaagaggcggcggtggcggcggcataggagggcctatgttgttttagctctggaagtgctcctcaacgatctgaacttgtacccttcgtaattgcaggagcaatgtatgtgcattgcattcctgttacacgtgatatatatactaaattttagagactgaactgttgtttagctaatatacttgtcaaagttgtagttatagtagtgtaatgcgccattgttatgcagtattcctgaatctttgattatattataacaatgtcgtgctg

SEQ ID NO: 106 - DNA, 397 bp, Glycine max
  Clone ID: PAT_MRT3847_127714C.1
ccacgcgtccgggaggctagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtactcgcttcgttttctctgcatgcgtgtataattgtgttcaataataagtgagagcggtgtgatgtgtggctccaaaaaaaaaaaaaaaaaaaaaaaaaataaaagggcggccgctctagagga

SEQ ID NO: 107 - DNA, 2125 bp, Glycine max
  UNSURE (1)..(2125): unsure at all n locations
  Clone ID: PAT_MRT3847_127767C.1
  unsure (1)..(2125): unsure at all n locations
ctccctcgtaaccaaaagccatttccaactcaaaaaacatggctccttttcctcttatgtgcttcgttattttgctcctatcctccactgtttcagtcacagccaccgccacccaaacaaccttaacagtgggaaaactcgaccaagttccacacataatgtgcaaggagtgcgagcttccacccccaccccctaaagagtgtcctccgccgccgataccactagcacctccaccaccgttaccaccatcaccttcaccaccgttaccaccatcacctccaccaccgttaccaccatcaccttccgcaaccttaccggcacctataccgctaactcactcactccccaaactcattcaagtcgctaatcctagttccttcaactcctcgctggcaacaacagcagtactaccattagccgcgtttttcaaaagtgattttcgagaattagcgatgggaattgaaagaggaggcttcaagggattcaggagcgcctggagcgtgccgcccaagccgtgcgattcctgcaagctggcctcggcggcgcttttctgccgccccgattccgcgtttctctgcatcgcctgcgattccaacattcactgctcgaacaaactcgcgtcgcgccacgagcgcgtgtggatgtgtgaggtgtgcgagcaggcacccgctgctgtcacgtgcaaggccgacgccgccgccctctgcgtcacgtgtgactccgacatccactccgcgaaccccctcgcgcaacgccacgagcgcgtccccgtggaacctttctttgactccgctgagtccatagtgaaagcctctgctgccgccaccttcgggttcattgtcccatccgacgacggcggcgcctccgacgctttcgcccccgatgactccgacgccgccgcgtggctcatcccgaaccctaatttcgggtccaagctcatggacgcccccgaaatcaagtccaaggagatattcttctctgaaatggaccccttcctcgattttgattactcaaactccttccaaaaccacaacagcgccggaaacgacagcgtcgttccagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaacacggtgtcagacatgtcgtattcttttggtcggaacagttcggattcgagtgggattgttgttgtgtcaggaaatagtgtggggcaaggtgcgacgcagttgtgtggaatggatcgggaagcgagggtactgcgatacagagagaaaaggaagaaccgaaaattcgagaagacaattcgatacgcatcgcgaaaagcatatgcggaaacccggcccaggataaaaggccgcttcgccaaacgaacagaaattgactcggatgtggagcgtctctatagccctggccctgcggtgctcatgctggacactccatacggcgtcgtaccatcgttttagttaatttcaaaatgaagaaacgatggagtgcatgaatcttagaataatgattagcgattctgtgggattgttaggggaaaaaggtgaagaatcgaatcggtacgaacgtgattcttagctggagcgcgatgggggaagattattgtgaagatttgtctcgatcgaccagaaaagcccgtttactttttataaaaaaaaaaacaacgtgcttttttaaggggtctactgtttaatattctcactgccttgcctgcttctgtctttcttagtattaaagtgtcttttttttgctcagctatatcacggatctctttccccattcctattggctgtcctccccaactatatatatatatcacttttttaattcattaccatcatcatttaacacttcacttttttattatatactcctcatcaaaattccaaggtcacaccaagccaattttcggtctatgattccctaatattcatttaagaaatacttgtgctttatttactcttttatgttaacatttcaattactgttgagcattnnnantccaaga

SEQ ID NO: 108 - DNA, 608 bp, Glycine max
  Clone ID: PAT_MRT3847_128170C.1
gaagatgaacaccatcaaactttatgtcaggagggtgttcatcatggacaactgtgaggagctcattcccgagtacgcttggatttgtgaagggtgttgtcgactccgatgacttgccgctcaacatttctcgtgagctgctgcagcagaacaagatcctgaaggtgatcaggaagaatcttgtgaagaagtgcattgagatgttcaatgaaattgcggagaacaaggaagactacaacaagttctatgatgctttttcgaagaatttgaagttgggtatccacgaggatagccagaacaggtccaagttggctgatttgctcagataccactcgacaaagagtggagacgaattgacaagcttgaaggactatgttacacggatgaaggagggtcagaaggacatttactacatcacaggagagagcaagaaggcagtggagaactctcccttcttggagagactcaagaagaagggctatgaagttcttttcatggtggatgcaattgatgagtatgcagttgggcaactcaaggaatacgatggcaagaaattggtttcagctacaaaggaagggttgaagctggatgatgagactgaggaggag

SEQ ID NO: 109 - DNA, 259 bp, Glycine max
  Clone ID: PAT_MRT3847_128189C.1
gagactttgggtggtatctttaccaggttgattaaccgcaacaccacaattcctactaaaaagagtcaggtgttttcaacagcagctgacaatcagactcaggttggtatcaaggtgctacaaggtgagagggagatggctgtagacaacaaatcgcttggagaatttgagcttgttggcattcctcctgccccaagaggcatgcctcagattgaagtcacatttgatatagatgccaatgggattgttactgtctctg

SEQ ID NO: 110 - DNA, 1280 bp, Glycine max
  Clone ID: PAT_MRT3847_12866C.1
ctcgagccgctcgagccgctcgagcggctcgagagctccttatacaccaccagctgatggtgtacagagtcaacttgtctgttctgggtgtagaaaccttctagtgtttccagttggagccacctccgtgtgctgtgctgtttgcaatgctgtcacagcagtgccacctcctgctaaatcacaaatactggtgtgtgacaggcacagaaatggctataggctacctaccgcccccaagaccgggccggactgacccacgcgtccgctcccctttagtttcattcacaaggggaagaagcaattcatttgactcttactttatcatctgctttaccatttgatttgctggcaccctcttcttcacgggagctgaaaaaaatgggagaaagtgctttgttctctgtgtagagtttggcagagaaagataacaacattttttagccctttataatgccagttccacttgccccatacccaacaccaccagctccatatacaccaccagctaatggtgtacagagtcaacttgtctgttctgggtgcagaaaccttctagtgtttccagttggagccacctccgtgtgctgtgctgtttgcaatgctgtcacagcagtgccacctcctggcacagaaatggcccagttagtatgtggaggttgccatactttactcatgtacatccggggcgcgacaagtgtgcaatgttcatgttgtcacactgtcaatctagctttggaagcaaatcaggtggcacatgtcaactgtgggaactgcaggatgctactggcgtaccaatatggagcaagatccgtgaaatgtgcagtttgcaattttgtaacatcagttggggccacagcaagcaccactgagcagaagttcagcacctaaaacatacaaaatagcaaggtcattatagactctacaaccttggttttgagttacatatcgcccttaaggaataaagaggttatcagattggagaggaaactcgtttcacgtgtatagagttatttttttgccttgcgtgattgtattaaattatatttttgttagattgggtgtatgaaaaaactatttatgataagttttctgtttctgatgagtgttttgaaaaatcccatcgttagattttgggtgtaaagtttattttcagctgtagataatttgtactatattaggaataatagatgcacaataagaaagtaattgacataaccctcacaatcactaaataagtggttgagaagtatttggaatgggtttaaagccgagaaaatctc

SEQ ID NO: 111 - DNA, 361 bp, Glycine max
  Clone ID: PAT_MRT3847_128763C.1
gatcagtggcttccctcactgtcgcaaaccattgtgttcgcacgttgcatcgcactcactctctcacctaagcatcatcccatcacctcccacttccttccgcgccatcaaagtcacaattttttgggctcagtctatcgcactcatccctgtccatacttcccgcttcctcttcttcactcatgtgcgccattttcgccatcgtgcctaaaggttcagagccaccgaattttacgctaatcgcatagaacgggaagagtgttagcctcgccaacttcagcagtacaccagtctgtgtgtatttctaccctgctgatgagacccctggctgttccatacaggcttgcgctttcagggattc

SEQ ID NO: 112 - DNA, 272 bp, Glycine max
  UNSURE (1)..(272): unsure at all n locations
  Clone ID: PAT_MRT3847_129210C.1
  unsure (1)..(272): unsure at all n locations
cgacgantncggcaaccctgttcatgctgctngtgtcaccnatgtngccaccagaactgctgctggtggttncagtgatgacattnatangcaacatgntaccaccaatgcctacggcgtagacactggtagacngcnttctagtggtggctacgatggtgacactaangnncntcntggaactnctggtggctntnntgatgacnccnntagacatcntggaactaccggtgtctatggtatngacaccgataggcaacancgtgggacta

SEQ ID NO: 113 - DNA, 612 bp, Glycine max
  Clone ID: PAT_MRT3847_129723C.1
cttgcagacagtaaatttgaggagttcggaaattttggatcatccacacactcagatttgtaatgaaggtcgtcagaatgcattatcagagatcttggagatattgacagtggtatgtgaaactcacaatttacctctggcccagacatggattccctgtaagcatcgaagtgttttggcccaaggtggtggtgtaaagaaaagttgttctagttttgatggtagatgcatggggaaagtttgcatgtctacaactgacatagcattttatattatagatgctcatttatggggttttcgtgaggcctgtgttgagcatcacttacaacaaggtcaaggggttgctgggagggcttttttgtcccacggcatgtgcttctgttcaaacattacccaattctacaaaactgattaccccttagttcattatgctctcatgtttgggttaacaacctgttttgcaatatgtttacgaagctctcatacaggaaatgatgattatgtattagagttttttctgcctcctagaataacacacattcatgaacaaaagactttgttgggatccatattggcaataatgacacagcatttccagagtcttcatattaa

SEQ ID NO: 114 - DNA, 638 bp, Glycine max
  Clone ID: PAT_MRT3847_1298C.1
agatcccaaccaaaccagttcaagaggtcattgctgaaatgcctaatggaggagtagatcgtgctttgaatgcacaggaagcatccaagcatcaatctcggcatttgaatgcactcatgatggttggggtactgctgtccttgttagtgtgccaaagaaggatgcagaattcaaaactcatcctatgaagttcatggaagggagaactcttaagggtaccttctatggtcactatagaccccgcactgacattcctggtgttgtggagaagtacctcaacaaggagctggagctggacaaatttatcactcactctgtcccattctcagagatcaacactgcatttgatcttatgctgaaaggggagggaataaggtgcctcatctgcatggaagagtaaatcaatgatgttctctgctgaacagtgtttgcgtgtaatgtgaaaagagaattgaataaatttggcatgtaattcggttattggattcatgctacatgagtgtgtaaagaggtaatgggggtgatgactttcttggtcattgtcgtggctttgtgatttctattgcaaatgttgtcttgtaactttgttgtattttcagcaatatatgatatatgatatctatcttaatttctatctt

SEQ ID NO: 115 - DNA, 1483 bp, Glycine max
  Clone ID: PAT_MRT3847_1301C.1
gatcatctcatatttctcatcaagttactatctataattaattaaattcctcgtggaatattgaagaagccatgtctacagctgggcaggtcatcaagtgcagagctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagagtaaatcaatgatgaatgatgttccctgctgtgagaacaatgtttctgtgttatgtgaaaagagaattgaataaatttggcatgcaattcggttgttggattcatgctatatgagtgtgtaaagaggtaacggggggtgatgactttcttggtcattgtcgtggctttgtgacttctattgcaaatgttgtcttgtaactttgttgtattttcggcaatatatctatatgatatctatctttctatcttttttttgtgaaaaaaaaaaaaaaaaaa

SEQ ID NO: 116 - DNA, 1278 bp, Glycine max
  Clone ID: PAT_MRT3847_13029C.1
taattcccggggcggccaccgcgaaacaattaacacacacaaacagaggctacgtacgatcaaattaattaagatggcggaagtgaggaacaaacaagtggttctgagggactatgtgagtggttttcctaaggaatccgacatgaacatagttgaaggaaccacaatattgaagcttccacaaggttccaatgatgtgcttctaaaaaatctctacctttcctgtgacccttacatgagaatgctcatgaccaaggtggaaggcctcgacgtgtttggcacctatacacctggctctccattaacagggtatggagtgtccaaagtcctagaatctggacacccagattacaagaaaggtgatttagtgtggggatctacaaaatgggaagaattcagcttggtgtccccaactcaaatacttttcaaaattgagcacaccgatgttccgctttcatattatactggtattcttggtatgccgggaatgactgcatatgcaggtttctttgaagtaggctctcccaagaaaggagagaatgtttttgtttcagctgcctctggtgctgttggtcaacttgttggccaatttgctaaattgactgattgttatgtggttggaagtgctggaagtaaagagaaggtggatcttttgaagaataaattaggatttgatgaagcctttaactacaaagaagagtcagacctcaatgcaactttgaaaaggtactttccagaaggcattgacatatactttgagaatgttgggggcaagacacttgatgcagtactcccaaacatgaaatttcatggccgcatacctgtctgtggaatgatctcgcagtacaatcttactcagttcgatggtgtaacaaatttggcaaatctcatatttaagcgggttaaaatggaaggttttattgcaactgatttctatcatttatatccaaaattcttggagtttgtcctgcctcatatcagaaaagggaaggttgtgtatgtggaagacattgctgagggccttgagaagggccctgcagccttggttggcctctataccggtcgcaatgttggtaaacaagtggttgttgttactcacgagtaaaattatataaatatattgttattctctaagctttaattccgaattttcaattttctgttggatattgaaccttgcttttatggtttatgcagtcattcttctattttgttgatagaaattactacattagtgacattttgtgataaataaaacctctaatatatgctatcaac

SEQ ID NO: 117 - DNA, 126 bp, Glycine max
  Clone ID: PAT_MRT3847_130881C.1
gctaactcttcttgcagtatctctctacatcaccttcataactgagtctcccagttttactagagattacggttgaaaaggcagatttgggtttgagactaaaattgagcttacctaagaaacccc

SEQ ID NO: 118 - DNA, 2170 bp, Glycine max
  Clone ID: PAT_MRT3847_131458C.1
agattgttgaatcatcacatggctgtgacaaaagagaaagaggatgttcggaacactgggaagagattgaaatgcatgaggaatgaagaagaagaagtttatgaagaagaagagagtgagcttcctttaaagccaggatttttcttctacccaacaacacccacttcctttgttgtatctgatgctcttgaacccgattttcccatcatatatgtcaacaaggtctttgaaatctccactggatatcgtgctgacgaggccctcggtcgcaattgtcggttcttacagtatagagatcctcgagctcagaggaggcaccctttggtggatcctgttgttgtgtctgagattagaagatgcctcgaggaaggtgttgagttccaaggtgaacttctgaatttcagaaaggatggtactcctttggtgaacagactgagacttgcgccaattcatgacgatgatggaactgtgacacatgtgataggtatccaactcttttctgaggcaaatatagatctgaaccgtgtctcatatccagtcttcaaagagacttgcaatcaagattttgataagactggtaaatataatcctaagagtggacaatcattgtacagtcagcaccaagagatgtgtggcattcttcagctttctgatgaagtcttggctcacaacattttgtcacgcttgacaccgagggatgttgcatccattgggtctgtatgcaggaggatccgtcaattaacaaagaacgagcatgtcaggaagatggtatgtcaaaatgcgtggggcaaagaagtgacgggcacattggaactgatgaccaagaagttaggatggggtcgtctgactcgggaacttaccactcttgaagctgtttgttggagaaaactgacagttggaggtgcagtggagccttcacgctgcaatttcagtgcttgtgctgcaggaaaccgacttgtattgtttggaggtgaaggagtggatatgcaacctatggatgacacttttgttctaaatcttgatgctaaaaatccagaatggcgcagggttagtgtgaaatcatcccctcccggaaggtggggccacacgctctcatgcttaaatggttcttggttggtggtttttggtgggtgtggtaggcagggattgctcaatgatgtgtttgtgcttgatttggatgctcaacagccaacatggagggaggtttgtggtggaacaccaccacttcctagatcatggcatagctcttgcacaattgaagggtccaaattggttgtctccggcgggtgcacagatgctggggtacttcttagtgacacatatttactggacctcacaacagataatccaacatggagagaaattccaacttcatgggctcctccttctcggttggggcactcactctcagtctatgggaggactaagattctaatgtttggaggacttgccaagagtggacacttgcggctacgatcaggcgaggcttatacaattgacttagaagatgaacaaccacaatggaggcaactagaatatagcgcattcacagggttagcgagtcaaagtgctgttgttcctcctcctaggctggatcatgttgctgtcagcatgccttgtgggaggatcattatatttggaggttccattgctggtcttcactcaccatctcagctctttctgttggacccctctgaagaaaaaccatcctggaggatcctcaatgttcctgggcaaccgccgaaatttgcttggggtcatagcacttgtgtggttggagggacaagggtgttggtgttgggtggacacactggggaggaatggatactgaatgagttgcatgagttatgcttggcaagtcgacaggactctgacctgtgaagtgcataaaaccagaccctcttctctcaagacaagattttggttgcaaaaaggttttgggtggctttcctttagcagtttggtttttgtatatgagccactattacatgattgttatatgaaatgacgtgtgtattaccagtgtttttgaatgatatatgatgtcatctggctcctctgtacatcatagagttcttggctgttgtatcatccctcctttttcttttacaattagttttgttaataattaattcatttattattatttttttatattaaaaaaaaaaaa

SEQ ID NO: 119 - DNA, 2515 bp, Glycine max
  UNSURE (1)..(2515): unsure at all n locations
  Clone ID: PAT_MRT3847_131774C.1
  unsure (1)..(2515): unsure at all n locations
gggaatcgagcagaagcatgcactatgatcaaccctctgggcttaatgatgttcaaaatcatgacttgtacaggccagtacacagtagatccatgggcaatatgtcaaccgagttcccagcctgcacatctgggcgtcagaaccaagggtatttggtggatgagttcccacacattgatatcataaatgacctgcttgatgatgaacaaggtattgggaagacggccaaggcaagttcagcattccagtctctgaataatggaccacagttgctgaatcgacagtcacttttcctggggatctgngtgcagatgatgatttgggatcttcaaccagttcttgcaggtttgagcgatcacaaagttaccatcatgaccatagattccaaggagggtatgacttgtctggtgggcattatgattcactgagggattatattcaaccgatgagtagtgtgcctggcgtcaatgggcaggttgatgggttgattcgaaaccaatggcangtggccggttccgatgtgttccaagcctagtttctttccagcgatgacaaagattgttggcacacttggcccaaagtcacgatcggttgacgtgatttcccaatgtcttgaggcaggaatgtctgtggcaaggtttgatttttcatggggtgatcctgaataccaccaagagacgttggaaaatttaagggctgctatcaaaagtaccaagaaactttgtgcggttatgctagataccgtgggtccagaactacaagttgtcaacaaaactgagcacccaatttcccttcaggctgacacattggttgtcttaactcctgatcagaacaaagaagctacttcaaatcttttacctgtaaattttagtggactttcaaaggctgtgaagaatggtgatactatttttattggtcaatacctgtttactggaagtgaaacaacctcagtgtggctagaggtcagcgaagtgaatggtgatgatgtcacttgtgtcataaaaaattctgctactcttgctgggtcactgtatactttacatgtctctcaaattcatatcgaccttcccactcttgacaataaggataaggaggtaataagcacttggggtgctcaaaacaatatagacttcctttcattatcatacaccaggcacgctgaagatgttcgccatgctcgtgagtttctctctaaactaggtaacctcaaacagacccagatatttgcaaagattgaaaacatagaggggttgacacattttgatgagatattgcgagaagcggatggtatcatcctctcacgtggaaatttggggatagatcttccacccgagaaggtgtttttatttcaaaaagcagctatttacaaatgtaacatggctgggaaacctgctgttgtcacacgtgttgtggatactatgaccgataacctaagacctactcgtgctgaagcaactgatgttgccaatgcagtgttggatggcagtgatgcaattgttcttggggcagaaactttgcgggggttataccctgtagagactatttccactgttggaaaaatttgtgctgaggcagagaaagtttataatcaagatttgtatttcaagaaggctgtcaaatttgttggagagccgatgactcatttggaatcaatagcttcctctgcggtacgggcagccatcaaggttaaggcttctgttattatttgctttacttcatctggcagggctgcaaggttgattgctaagtaccgtccaaccatgcctgtgatatccgttgtcattcctcaactaaagacaaatcaacttcgatggactttcactggagcttttgaggcaaggcaatcacttattgtgagaggtcttttccctatgcttgcagatccacgacatccagctgagtctaaaagtgcaacaaatgaatcaattttgaaggttgctttagaccatggcaaggcttttggtatcataaaggcacatgatcgagttgttgtatgccagaaagttggtgactcctcagttgtgaagattattgagcttgacgaatagaacttgattcattttcaagtttgcgttataatatgtcttctttgtattagtattttctgttgtatgctttaataataaaaacacttcaaaataatgtgtatcacattggaagaaatgcttttggggaatggatatcattcattgccagcatgccaactgttgtttataatataacaccattgaatccttttatcaatacataagcaagaaaatttcctattactatcaagattactcaaatatggcatgtggtgtcaatggttatactgtattcaggccttcgaatggtccgtagagggaaaagatgacaaaggttgcccacaaattagtggtcatcaaccaatgtaataatgtatttgaggaaattgttgggtctctttagattggagtgaggttgtatccccttgataggaaaacattttgtaaagagtgtttccgattaatttggttgcagtttttcataaaaa

SEQ ID NO: 120 - DNA, 253 bp, Glycine max
  Clone ID: PAT_MRT3847_131964C.1
cctctctctctttctctttctctctcatccagatcttgcaaaaagcaaaagacccaatggcatcgagcgcgcccactccaggcgaagagttcgtgtacatggcgacctgtcgaaacaggccagtcgctacgcggagatggtggagttcttggagacggtctccgcctccgccgaaaccgaggacctgaccgtggagaagcgaaacttcctctccgtcgcctaaaagaacgtaatcgctgctctctgcgcctcc

SEQ ID NO: 121 - DNA, 1241 bp, Glycine max
  Clone ID: PAT_MRT3847_13199C.1
agacgacagagaaagacacttgattagctgaggaggaagagagaaaaaccatggcaataacactcaacaatggcttcaagatgcctatcattggattgggcgtgtggcgcatggaaggaaacgaaatcagggacctaattctcaattccatcaaaattggttatcgccattttgattgtgctgctgactacaaaaacgaagcagaagttggagatgcgcttaaggaggcttttgatagtggccttgtgaagagagaggatctcttcattaccaccaagctttggaattctgatcaaggccacgttcttgaggcgtgtaaagacagtctcaagaagcttcagttaacgtatctagatttatatcttgttcactttcctgttgccgtaaggcatactggggttggtaatacttctagtcctttgggtgatgatggggtcctggacatagataccaccatatccctggaaacgacctggcatgcaatggaagatcttgtttcatcgggcttggttcgcagcatagggatcagcaactatgatatctttctgaccagagattgtttagcatattccaagataaagcctgctgtaaatcagattgaaactcatccatacttccagcgtgattctctagtcaaattttgtcagaagcatgggatttgtgtcactgcacacactccactaggaggtgctgcagcaaatgctgaatggtttggaacagtttcatgtttggatgaccaagttctcaaaggtctggctgaaaaatacaaaaagactgccgcccagatcagccttcgctggggaattcaaaggaacactgtggtcattcctaaatcgtcaaaactggagaggttgaaagagaactttcaggttttcgattttgagttgtctaaagaggacatggagctcattggaagtatagatagaaaatatcgaaccaatcaaccagctgtgttttggggcatagatttgtatgcgtgagaatgcccttcctaagtctgtatcatggctgtttgaccttgtgttaagattcagatttggtataagctgatctttcaggctccttagtagctcagtttatttgataatgtaaactttctttgttgatggttgaaaaatcatcttctcatcccatatccaatctcgtggactaaataagagagacttctgaatgttgttgcttaaaaaaaaaatccatttgtttaaaaaaaaaaaaaaaaaaaaaaaaaaaaaaaaaaaaac

SEQ ID NO: 122 - DNA, 1744 bp, Glycine max
  Clone ID: PAT_MRT3847_132102C.1
aactcaactcttcctaaacctaaacacacacacttacactttgcattccaaattccacaactttcactttctacaacactatttaccccattttctctaaatccaaacaggccccaaaagaaagagagggaaaattctcttccatggcctcttcacgccctgccaatgtgggaatccttgccatggacatctacttccctcccacctgcgtcacccaggatgctttggagggtcatgatggggtgagcaaagggaaatatactattgggcttggacaggattgcatggccttctgctctgaggttgaagatgttatctcaatgagcttgacggtagttacttcacttcttgaaaaatttaatgttgatccaaagcaaattggacatttggcggttgggagtgaaactgttattgacaaaagcaaatcaattaagaccttcctgatgcaagtttttgaggcaagtggtaatactgacattgaaggtgttgattcaactaatgcatgctatggaggaacggctgctttgttcaactgtgtgaattgggtggagagtagctcatgggatggacgttatggacttgttgtttgtacagacactgcggtatatgctgaaggacctgctcgtcccactggaggagctgctgcaattgccatgcttgtagggccagatgctcctattgcttttgaaagcaaactcagaggcagtcacatgtctcatgcatatgatttttacaagccaaaccttgctagcgaatatccaattgttgatggaaaactctcacagacctgttatctcatggcacttgattcctgttaccggctttactgtgagaaatttgaaaaattggaggggaggcctttttcaatgtcagattctgattattttgtgtttcattctccatataacaagcttgtgcagaaaagttttggccgactatacttcaatgacttcttgagaaatgccagttttgttgatgaagttgccagggaaacccttgcaccatatgcatccttatctggtgatgagagttatcaaagtcgtgatcttgaaaaggcaaaccagcaagctgcaaaacatctatatgatgcaaaggtgcagcccagcacactaatcccaaagcaagttggtaacatgtacactgcatctctttatgcagcatttgcatctcttcttcacaataagaacagttcgttggtaggtaaacgggtagttatgttttcatatggaagtggtttaacagctacaatgttctccttccagcttcaagagggtcaacatccgtttaacttgtcaaacattgtaacagtgatgaatgtttcggacaagttgaagcagagagttgagattcctcctgaaaagttcgttgaaacattgaagatcatggaacaccgttatgggggtaaggactttgtgacaagcaaggactgtagctacttaactccaggcaccttctatctcaccaatgttgattccatgtacaggagattttatgccaagaaggactaggttattggttagttgatgatcgctgatatattcaaatatggagttaaaatgtattttcttatggttcacctgtatttgatcccataaggttgtgtatcaaaatgtttataagatgtttcatttttttgtggtgatcaggttgtaaccaaaataagaataagtttatttgcgaattggcaattgtttttaaatgcactaataatccaaatatattagtagtttcttcttgagtgcgc

SEQ ID NO: 123 - DNA, 108 bp, Glycine max
  Clone ID: PAT_MRT3847_132766C.1
cttgttgaagccatgtctacaactggtcagggcatcaagtgcagaactgccgttgcattggaagcagggaagccactatcgataggaaccatagaagttgcaccaccc

SEQ ID NO: 124 - DNA, 2145 bp, Glycine max
  Clone ID: PAT_MRT3847_133042C.1
cggaattcccgggtcgacccacgcgtccggtcacaccaaacagagcgcagaaaataaaataggtgaaatgaatatcgatttcaattccgccactgaatttcgaaaccaaaaaaccattccaacgaagaagatgaacctcgaagaagagggttagttacttctgagtgagtgagtgagttagtggttcctctgaggaacggtgaggaccttcaatttctcaagttctcaaccgttcgttttctctttcgttcccctaaccgccgtggatgggacaatctgtttcctccgccgccgtcgctagccgtcgcgagagggaccaaggccaccgctccgtcaactcttccaagaccagattcaccgcctcggtttcgccgatggccggttattcctccggcgccgccgaagaaggcgaaaaccatcgcgtggaggccgttgccgatgaatccaccgactacatctccgatctcccgaacgagtgcctggcttcggtgtttcagtttctcagctccgccgatcggagccgctgttcgctcgtttgccggcggtggctccagatcgaaggacagagccgccacaggctttctctgaacgccgaactggatctgtttccggcgattccgtcgctgttctctcggttcgattcggtgacgaagctcgcgctgaagtgcgaccgcagatccgtgagcatacgcgacgacgcgctcgtgctgatctcgcagcggtgccctaacctcacgcgcctgaagcttcgcgcgtgtcgcgagctcaccgacgcaggaatggaagcgttcgcgaagaactgcaagggattgaagaagctctcgtgtggatcgtgcacgtttggatccaaaggcatgaacgcggtgctcgacaactgcgccgcgctggaggagctctccgtgaagcgcctccgtggaatcgctgacactgcagcggcggagccgatcggtcccggcgtggctgcggcgtcgctgaaaatcgtttgcctgaaggagctctacaacggacagtgtttcggaacgctgattctcggggcgaagaatctgaaaaccttgaagcttttccggtgctccggggattgggaccggctctttcagttaatggcagatcgagtcacgaacatggtcgaagttcacctcgagaggcttcagattagcgacgttggattgcaagcgatcgcgaatttttcgagtttggagattttgcatctcgttaagactcctgaatgttctgatattggacttgttgctattgcagacaggtgcaagcttttgcggaagcttcacattgatggatggaaggcaaatcgaattggcgacgaaggtttgatagctgttgcaaaaggttgccctaatttgcttgaattagtgctaattggggttaaccctactaaggcgagtttggaaatgttggcgtctaattgccagaatctcgagcggttggctttgtgtggaagtgattcggttggtgatcctgagatatcttgcattgctgcaaagtgtgtggctttgaagaaactgtgtattaagagttgtcccgtttccgatcaagggatggaggcattggggaatgggtgtccgaatttggtgaaagtgaaggttaagaagtgtaaaggggttacccctgagggtggtgattggttgaggaggactagagggtcagttgctgttaatttagatactggtgaggcagagcttcaggaagccagtgctagtgatggaggggcacaggacaatggtgtagagttccctcaaatgcctgcccaaatcgctgctgcatcgagcagcactcggtctagttcgtcgaggtttgcgcttatgtctgcgaggatttcagcggctgcattgaggagcactcggtctggttcgtcgaggttagggcttttgcctacgaggatttcagcggctagcacttttaggagatggtctggtggtagcactagtgcacgccatggttagggacagggccaaagcaaaacctgagtctttgaccatttttcattgtttttggttgtcgtatcatttgatttttatatttcttgtacttaaatttgaaatttatgccgtgtgatgtttattgcctttggaattgaagcttcacggttgcaattgacaatcgcatttttttcctttctctactttcata

SEQ ID NO: 125 - DNA, 1566 bp, Glycine max
  Clone ID: PAT_MRT3847_13379C.1
gtatcgagtctagtctctacaatcactccttcctctcatcctctataaagaaagtgcttaatttgtgttgttacttggttcagtttccatggattgggggcttgctatatcttctcatcctaaaccttattcagtcacaactggtggaaatctctggcggagtaaacacaccaccaagaatatttactttgcaagttcttggatatcaaaagcttcacgacacaaaagggaaactcaaatagaacataatgttttgaggttccaacaaccaagtttggatcatcattacaaatgcatcagaggagggtctacatatcaagaatgcaatagaaaatttgttgtgaaggcaatctctaaacaacctcttggttttgaagctcatgcttccaatcctaagaacattttggactctgtcaaaaatgtattgtctgctttctactggttttcctatccatacacaatgattggcataacattatgcgcattttcttcatctcttctcgcggtggaaaaattatcagatatatctttatcatttttaattggcgtgttacagggtgtgctgcctcaattgtttattgaaatttatctttgtggtgtgaatcaactgtatgaccttgaaatagacaagataaacaaaccacatcttccaatggcatctggacaattttcctttaaaaccggtgtcattatttctgcagcatttttagctctgagttttggatttacttggattaccggctcttggccattgatttgtaatcttgtagtaatcgcttcatcgtggacggcttattcaatcgatgtgcccctactgagatggaagagatacccatttgtcgcagcaatgtgcatgatttctacttgggctcttgcattgccaatttcatatttccatcacatgcagaccgttgtgttgaagaggccaattggctttccaagatcattgggttttcttgttgcattcatgaccttctactccttgggtttggcattgtccaaggatatacctgacgttgaaggagataaagagcacggcattgattcttttgcagtacgtctaggtcagaaacgggcattttggatttgcgtttccttttttgaaatggctttcggagttggtatcctggccggagcatcatgctcacacttttggactaaaattttcacgggtatgggaaatgctgttcttgcttcaattctctggtaccaagccaagtccgtagatttgagcgacaaagcttccactggatctttctatatgttcatctggaagctattgtatgcagggttctttctcatggcattaattagatgaggatatcgtggaaggcttaaacaatgttctcgacacatacaccaaaataaaaggaatatatgttttgcatctaagatttattaaataaagccgaatgttggttcttgtatcattaagattttttttttaattgtcgaagactttatgtattcatattcaccttgacttctacggtcaaatttttcataagtggaataaaagcaacttgttatacaagtttttttttttaaaaaaaaaaaaaagcttgt

SEQ ID NO: 126 - DNA, 3318 bp, Glycine max
  Clone ID: PAT_MRT3847_134145C.1
tcggtgttacgtaatagcatgatgcgttttcaggttttgggtagagatctcgctgggggtcctgaccagcaacgtccattgccaacgccgattgcggcaatcggcacgtagccagaccctgtttttgtgggtacgtggatgctggagttggatgctaacactcctcctgcaccaaatagaggccctcctcaagtaccttatgaccgaggtactcttgcttggatatagtttgttgctagtaatgatgtccttattgtttatgccgtgacgactggtgctatagccggaatttccggtggtactaatataacatgatggtgtttacgggttactcaggctggtgatattatgcaagcaattagctgcatggacggtgctttcggttgtcctggatatcatcaccagctgatttggcccattcagcatccaagtccgaggagcaaagcatagttggtagccactgctcaatttgtgcactgtgacaaaagatagtagttgtggggaaggattccgcccacctgttttgaggtccgcccttagggtatatagtgagggtctgggttgtccgtgtggctatctttctcgttattttgttcaatttttgtttacttatttgtcctatggttgggtttttgcgttttgctcacggacattgcatctcactctggtcagcgactaatttttgtgggaccgcatgtaatgctggggcaattttagctttgggtagagcccgcgttgtcgtcactcgtccgatcggtatgttctcatgctcctggtgtgtcaccatctcctagatatcagcatgcagcggtatttgttaatgcaaggctccatgtgtctggtggggcccttggaggaggacggatggttgaagattcatcgagtgttgcagtgttggacactgctgctggtgtttggtgtgataccaaatctgttgttaccagtccaagaacgggtagatacagtgctgatgcagcaggtggagatgctgcagttgagttgacacggcgttgtaggcatgcggctgctgctattggtgacttaatttttatttatggtggtttacgtggtggtgtcttgctggatgacctacttgttgctgaagatcttgctgctgctgaaacaactgctgcttcacatgctgctgcagcagcagcagcatctaatgtacaggccggacggctacctggacggtatggatttattgatgataggacaaggcaaaccatgcctgaaacagatcctgatggttcagtagttttgggaaatccagttgccccccctgtaaatggcgacatgtatactgatatcagcactgaaaatgccttgctcccgggatctaggcgaacgagcaaaggagttgagtatctagttgaagcatcagctgcagaagctgaagctatcagtgccacactggctgctgctaaggcacggcaagtgaacggtgaagttgaattgcctgaccgagaccgtggggctgaggcaacacctagcgggaaacaaatatcttccttgattaagcctgattctgctgggtcaaatagcattcctcctggtggagtgaggctgcatcacagagctgtggttgttgctgcagagactggcggagcattaggtggcatggttagacagctttcaattgaccagtttgagaatgaaggcaggcgggtcagttatgggactcctgaaagtacaacagctgctagaaaattattagaccggcagatgtctatcaatagtgtcccaaaaaaggttgtagctcaccttttaaagcctcgtggctggaaaccaccagttcgtcgacagtttttcttggactgcaatgaaattgcagatctttgtgatagtgcagaacgcatattttcaagtgaaccgagcgtgttacagcttagggctccaattaaaatatttggtgatctacatgggcaatttggagatctcatgcgcctttttgatgagtatggtgcaccatcaactgctggtgacatagcatatattgactatctattcctaggagattatgttgatcggggacaacacagcctggaaactatcacccttctgcttgctctgaaggttgagtatccaaacaatgtacatttaatacgtggaaaccatgaagctgcagatattaatgccctttttggtttccgaattgagtgcattgagaggatgggtgagagagatggaatttggacatggcaccgtataaaccgtctgtttaattggcttcctctggcagccctaattgagaaaaaaattatttgcatgcatgggggtattggtcgttcaataaatcatgtggaacaaattgagaatattcagcgtccaattacgatggaagcaggatcaattgtgcttatggatctattatggtctgatcctacagagaatgacagtgttgaaggactgcgaccaaatgctaggggtccaggattagtcacttttgggcctgatcgagtaatggaattttgcaacaacaatgatcttcagctgattgttcgtgcacatgaatgtgtgatggatggctttgagcgttttgcccaggggcatttgatcacacttttctctgctacaaactactgtggtacggcaaataatgctggggcaatattagttttgggtagagatctcgttgtggttcctaaattgattcatccattaccgcctgcaatttcttcaccagaaacgtcaccggaacgtcatattgaggatacatggatgcaggagttgaatgctaacagaccaccaacaccaactagaggccgtcctcaagtaacaaacgaccgagcatgatgccgtttacagggtattcgagcttacccgctgaaagcttcaaggatcaagcttttatttgtcccggttctcatcgctcaatcatctggcctgtagacgatacaagttcgagaagcaagcaaagttggtagccactgctaggttggttcaattgacaaaagctagaagttgcagtatgggttcctacccacctgttgtaaattgagccctagggtacaaaatcaaggtcatggatgtccgtgtcatggaatgtcagtgctggctatttttctcattattttttacatattttttttactcattgtccctaggttattgttttttttttttcaatttatatttttaaatcaagaggacaagggtttttttttttttcctgtgatggtgagatatataaatcagaaatctttcttgggggtccatgtatcatagggggttgttgtgtagttcccatccatgctctgtacaactaatttttgtgtgaatcaacatattctgacaggaaatgtgaattttgagaat

SEQ ID NO: 127 - DNA, 1788 bp, Glycine max
  Clone ID: PAT_MRT3847_134494C.1
acaagtcgcaaccactctactctcattgaggaaaatatggggctagttgcgagtgggctccgcaaaattgtaggggtgactcgatccgatttggctcgatcttttaatcaaagggtgtggtaacttcatctctttcgtttcgtccttgccttcaccccaaagcctattttcccattttccccttttcatgataacaactccccaagttccttcgtctcttttgtttcgtcctttccttcaccacttttcccttttcattttcaggataacaaaacaacactccttgcaggattaaacttcacttcaattgaactaacctgtctgtgggttttttgtagattgattcaattcaatggcttcagtaatgctcagtggaactgaaaagctcactctcagaaccctaaccggaaacggcttaggtttcactggttcagatttgcacggtaagaattttccaagagtgagttttgttgccaccactagtgctaaagttcccaactttaggagcttagtagtacccaagtgtagtgtctctgcttcgaggccaagctcgcagccaaggttcattcagcacaaaaaagaggcgttttggttctataggtttctctcaattgtgtatgaccatgtcattaaccctggccattggaccgaggacatgagggatgatgcccttgaacccgctgatctcaatgacaggaacatgattgtggtcgatgttggcggcccttggcagcgacaccactcgtttggttcctattcacatgtggatgcaagaatccattctttcccaaaggtcaccccaccagctagctaaggccaagcagtaaggaaccactcaaggaatgcaaaataatcgaaggggatgccgaggatctcccctttcgaaccgattatgccgatagatatgtatccgcaggaagtattgaatactggccggatccacagcgtggcatcaaggaggcttacagggttttgaaacttggagccaaggcatgtctaattggtccggtctaccctacattttggttgtcacgtttctttgcagatgtttggatgcttttccccaaggaggaagagtatattgagtggtttcagaaggcagggtttaaggacgtccaactaaaaaggattggcccaaaatggtaccgtggtgttcgccgacatggcttgattatgggttgttcagtgaccggtgttaaacctgcatctggagattctcctttgcagcttggtccaaaggaagaagatgttgaaaagcccgttaatccttttgtgtttgcactgcgcttcgttttgggtgccttggcagccacatggtttgtgttggttccaatttacatgtggctgaaagatcaagttgttcccaaaggtcagccaatctaagagatattgataattagtaatccttttgatacttatcagtgtcttctccaaagtttcatcaaatgtacgcgcaattaagagaaatttgatcaaatgtcaaatagtttattacgtaattgagtttaaattttctgggtgctttagcaagctatgataatttgggcgggaggggctaatgcaacgtcattttgttctgtccatcagcagtcttagaggtcaattattccaacattgttttatgcaatgattatataaggacgttaatgtttgtttagggtctaacatccctttcttttttccaactgatactaatccaatatgtctgttaatgttaaccttttgaaggataatatattaaggaatataatgctctaataaaatctgagagcctgataatttgacatt

SEQ ID NO: 128 - DNA, 1825 bp, Glycine max
  Clone ID: PAT_MRT3847_134495C.1
ttttaaaaggttaacacaaagggaaatattgcccccaggccgggaatttatttcccctccctatgggggccccccctttttttttttttgttaatttttttttttgttttttttttttttttttttttttttttttttttttttttttttttttttttttttttttttttttttggaaaaaagaaagggatgttaacctctaaacgacattaacatccttatataatcattacataaaacaatgttggaataattgacctcttaagactgctgatggacagaacaaaatgacaagtggacgtgtacaatatggttgcattcgggcttcccgcccaaaattatcatagcttgcaagagcagccagcaaatttgagctcagttacgtaataaactacttgacatttgatcaaatttctcttaattgagagtacatttgatgaaactttgaaaaagatactgataaagtatcaaaaggatcactaactactaatatctcttagattggctgacctttgggaacaacttgatctttgagccacatgtaaattggaaccaacacaaaccatgtggctgccaaggcacccaaaacgaagcgcagtgcaaacacaaaaggattaacggacttttcaacatcttcttcctttggaccaagctgcaaaggagaatctccagatgcaggcttaacaccggtcactgaacaacccataatcaagccatgtcggcgaacaccacggtaccattttgggccaatcctttttagttggacgtccttaaaccctgccttctgaaaccactcaatatactcttcctccttggggaaaagcatccaaacatctgcaaagaaacgtgacaaccaaaatgttgggtagaccggaccaattagacacgctttgcctccaagtttcaaaaccctgtatgcctccttgatgccacgctgtggatccggccagtactcaatacttcctgcggatacatatctatcggcataatcagttcgaaaggggagatcctcggcatccccttcgattattttgcattccttgagtggctccttctgcttggccttggcgagctggtggggtgactggtcaagaatggtgacattcttggcatccacgtgcttgacaataccaagagtggtgaaacccgtgccgccaccaacatccaccacaatcatgttcctgtcattgagatcagcgggttcaagggcatcatctctcaattgtgtatgaccatgtcattaaccctggccattggaccgaggacatgagggatgatgaccatgtcattaaccctggggagaaacctatagaaccaaaacgcctcttttttgtgctgaatgaaccttggctgcgaggttggcctcgaagcagagacactacacttgggtactactaagctcctaaagttgggaactttagcactagtggtggcaacaaaactcactcttggaaaattcttaccgtgcaaatctgaaccagtgaaacctaagccgtttccggttagggttctgagagtgagcttttcagttccactgagcattactgaagccattgaattgaatcaatctacaaaaaacccacagataggttagttcaattgaagtgaagtttaatcctgcaaggagtgttgttttgttatcctgaaaatgaaaagggaaaagtggtgaaggaaaggacgaaacaaaagagacgaaggaaataggcgagtggtgaatgaaaagggaaaagtgttgctttgttatcctgattgaacgccgtggcggttgaattgggtgtcgttcacaaaaatttgcgatttatttctcaccactcgcatattttcc

SEQ ID NO: 129 - DNA, 865 bp, Glycine max
  Clone ID: PAT_MRT3847_135197C.1
ccctcattcactctcttttctccggcagcaccaaaaccacccaacacttgaaatcaatatccattgttaccaaaaaagaaagatcaaaacaccctttacatcattatactcagttccctctttccctatcaaaaccctttcccacaacactactcactctagtagtacaagcaaaaccttctaactttggcttcagcggcacatatatatatatatatagaacatgtataccttgaaccactcttcatatttgtaccatgtttcccctgagctctcctcttccttggactcgtcctcgccggcttccgagggctctcgcggcgtggcattttccgacgaggaggtgcggctggcggtgaggcacccgaagaagcgggccgggcggaagaagttccgggagacgcgccacccggtgtaccggggcgtgaggaggaggaacacggataagtgggtaagtgaggtgagggagcccaacaaaaagaccaggatttggctggggacttttcccacgccggagatggcggcacgggcccacgacgtggcggcaatggccctgaggggccggtatgcctgtctcaacttcgctgactcgacgtggcggttaccaattcccgccactgctaacgcaaaggatatacagaaagcagcagcagaggctgccgaggctttcagaccaagtcagaccttagaaaatacgaatacaaagcaagagtgtgtaaaagtggtgacgacaacaacgatcacagaacaaaaacgaggaatgttttatacggaggaagaagagcaagtgttagatatgcctgagttgcttaggaatatggtgcttatgtccccaacacattgcatagggtatgagtatgaagat

SEQ ID NO: 130 - DNA, 2650 bp, Glycine max
  Clone ID: PAT_MRT3847_135935C.1
ggctcgaggcaaattgcacgaccatggctttctctatctcactctttttattagtcctgcttttttctttccaatcttcttcatcttccctattgtcattgaacaaggggtcctccctctcagtggagaaacacgcagaagacgttattgtctccccaaatcaaatgttctgtgctggcttctttcaagttggtgaaaatgccttctcctttgccatatggttcaacgaccctcacactcacaacaacaaccacaccgtggtttggatggcaaaccgtgaaacacccgttaatggaaggctatcaaagctttccctcttaaacagtggtaacatggtcttggttggtgcaggtcaaatcactacatggtcatcaaacacagcatcagatgctccagtaaagttgcatctccaagatgatggcaatcttgtgttacttgatctccaaggaaccattttgtggcaaagttttgataccccaactgatactctccttcccggtcaattacttaccagatacacacaactagtgtcttcaagaagccagactaaccattctcctggtttctataagatgctatttgatgatgacaacgttcttcgtcttatttatgatggtcctgatgtctcaagcacatattggccaccaccatggctactcagttggcaagctggaaggtttaattacaacagcagcagagttgcagtgttaaattctattggaaatttcacttcatcggataattatgatttttccacggatgatcatggcacggtgatgccaagaagattaaaactggattcagatggaaacgctcgtgtgtacagtagaaatgaggctttaaagaaatggtatgtttcatggcaattcatatttgatgcatgcaccagtcatgggatttgtggtgctaacagcacttgcagttatgatcctaaaaggggacggagatgctcgtgtttaccaggatacagagtgaagaaccatagtgattggtcttacgggtgtgaacccatgtttgatcttacttgcagcagaaatgagtctatctttttggagatacagggcgttgagttatatggttatgatcacaattttgtccaaaacagtacatacataaactgtgtgaatttgtgtttgcaagattgtaactgcaaagggtttcagtacagatatgatggtaaccaaatatttagctgctttacaaagtcacagttgttgaatggaaggcgttcaccaagttttaacggagcaatttacttgaggctgccaatcaccaataacttctccaaggaagaatctgtgagtgcagatgatcatgtttgttctgtgaagcttcgcaaagactatgttagaaagccagaaaatcgtttggtgagattttttctgtggcttgctactgcagttggggctttagaagtgattttctttttcctgatttggggtttcttgatttggaacctcaaaacgtctagtgcagatcagcaaggctaccatcttgcagcggtgggattcagaaaatatagttatttggagttgaagaaggcaacaaaggggttcagccaagagattggaagaggtgcaggagggattgtgtacaaaggcattttatcagatcaaagacatgttgcaattaagagactctatgatgctaagcaaggagaaggagaattccttgctgaagtgagcatcattggaaggctcaaccacatgaatttgattgaaatgtggggatattgtgctgagggaaagcataggttgttggtgtatgagtacatggagaatggttctttggcacaaaatctctcatccaacacacttgattggagtaagagatatagcattgctcttggaacggcaagggttctggcatatcttcatgaagaatgcttggagtggattttgcactgtgacataaagccccagaacatacttcttgatgctagttatcagcccaaggtagcagattttggcctgtccaagctactaaatagaaacaacctcaacaattcaagtttttcaatgatcagaggaaccagagggtatatggcacctgagtgggttctgaacttagcaatcacctcaaaggttgatgtttacagttatggaattgttctattggagatgataactgggaagagcccaacaacaaccggtgttcaaaacattgatggagaagagccatacaatggaaggctggtaacatgggtgagagagaaaaggagtgccacatcttggttagagcacatcattgatcctgcaattaagacaaattatgatgaatgcaagatgaaccttttggctacagttgctttggactgtgtggaggaagacaaagatgtaaggcccaccatgagccatgtggtagaaatgctacaaagccatgaaagtgatcctcgtaatatcatcaatgcttgatggttacatttcttggtcctcataatgctaattaatggtatacctcataatactattatcaactcttgatggctactttcgacgtatcaggtactcaccgcaaggaagtagattttacattttagaatgcttctatatatatactttttttttaattctatatttttgtctttcatgtggtgtttgtaatttgtaaagttgtttaagataaataaatttcccttgtttgaagtctt

SEQ ID NO: 131 - DNA, 716 bp, Glycine max
  Clone ID: PAT_MRT3847_136001C.1
ctgcaattcactctgtacaattcttcgttcgttctctgcagttatatcctttttgagcttcaatggcggacgctgaaaccttcgctttccaggctgagatcaaccagcttctaagtctcatcatcaacacattctacagcaatgcttctgatgctttggataagattcgattcgagagcttaaccgacaagagcaagctcgatgctcagccagagctcttcattcgtcttgtgcctgacaaggataacaagactctttccattattgacagcggcattggaatgaccaaagcagatttggtgaacaacttgggtaccattgcgaggtccgggaccaaggagttcatggaggcgttgcaggccggtgctgatgtcagcatgatagggcagttcggtgtggggttctactctgcttaccttgttgcagagaaggtcattgttaccaccaagcacaatgatgatgaacagtacatttgggagtctcaggctggtggctctttcactgttactagggacactgatggcgagcaactcggaaggggaaccaagatcaccctcttcctcaaggaagatcagttggagtacttggaggagaggagaatcaaggatcttgtgaagaagcactctgaattcattagttatcctatttacctttggactgagaagacaaccgagaaagagatcagcgatgatgaagatgatgaacccaagaggagg

SEQ ID NO: 132 - DNA, 1275 bp, Glycine max
  Clone ID: PAT_MRT3847_136003C.1
aaaaaaagaaaacataatgcagagagaggtagaagaatccagaacccgttgtttgtctcccattcccgttcctatataaagctccttctttcacaaccttcaccaacttcaactctctacaattcgctctgtgcagtttcctcgctctcttttctgcaattttcttttttgttcgttctctgcagttatatcctttttgagcttcaatggcggacgctgaaaccttcgctttccaggctgagatcaaccagcttctaagtctcatcatcaacacattctacagcaacaaggagattttcttgcgtgaactcatcagcaatgcttctgatgctttggataagattcgattcgagagcttaaccgacaagagcaagctcgatgctcagccagagctcttcattcgtcttgtgcctgacaaggataacaagactctttccattattgacagcggcattggaatgaccaaagcagatttggtgaacaacttgggtaccattgcgaggtccgggaccaaggagttcatggaggcgttgcaggccggtgctgatgtcagcatgatagggcagttcggtgtggggttctactctgcttaccttgttgcagagaaggtcattgttaccaccaagcacaatgatgatgaacagtacatttgggagtctcaggctggtggctctttcactgttactagggacactgatggcgagcaactcggaaggggaaccaagatcaccctcttcctcaaggaagatcagttggagtacttggaggagaggagaatcaaggatcttgtgaagaagcactctgaattcattagttatcctatttacctttggactgagaagacaaccgagaaagagatcagcgatgatgaagatgatgaacccaagaaggaggaagaaggagacattgaggatgttgacgaggagaaggagaaggattccaagaaaaagaagaagatcaaggaggtgtctcatgagtggcaactcatcaacaagcagaaaccaatttggctgcgaaagccagaagagatcaccaaggatgaatacgcttctttctacaagagcctcaccaatgactgggaagagcacttggctgtgaagcatttctctgtggagggccagcttgagttcaaggccatcctctttgtcccgaagagggcaccctttgatttgtttgacaccaggaagaagatgaacaacatcaagctttatgtcaggagggtgtttataatggacaattgtgaggagctcattcctgagtaccttggatttgtga

SEQ ID NO: 133 - DNA, 1342 bp, Glycine max
  Clone ID: PAT_MRT3847_136440C.1
cacgcgtccgcttctaccacctacgtcgtttcgcgtgagtaccagcttttcctttgggcaattctcgtcttcggtgattcctatggtttcttcattgaattcgataaagccattgaacatgtcttcagcaaccaagggtgataggaagactgcacttgatgtggcatcatggatgttcaatatagtcacatctgtgggaataatccttgtgaataaagccctcatggctacatatggtttcagctttgctacaacgttaactggtctgcattttgccacaacaaccttgctgacagtctttcttaagtggctgggatatgtccaaacctctcaccttcccttacctgatctcatcaaatttgtcttatttgcaaatttctctattgtcggcatgaacgtgagtttgatgtggaattctgtcggtttctatcagattgctaagctgagtatgattccagtatcttgtttcctggaagttatcttggataatgtgcgatattcaagggacacaaaacttagcatttctctagttctccttggggttgctgtatgtacagtcactgacgtgagtgtcaatgctaagggttttatagctgctgcagtggcagtttggagcacctcactacagcagtattatgtgcattttcttcagaggaagtactctcttggatcgtttaacttgttgggccacactgcaccagtacaggcagcaagtttactactagtaggtccctttttggactattggctgacaaacaaacgagttgacgcctacaactatggtttcacatctactttgttcatcattatctcttgcaccatcgcagtagggacaaacctcagccagttcatctgcattggcaggttcacggctgtatctttccaagtccttggacacatgaagactattctggtactggccttaggattcgttttcttcggaaaagaaggcctcaatttacaagtgattctgggcatgaccattgccatagcgggaatgatatggtatggcaatgcatcttctaagccaggagggaaggaacgtcttagcttacccattaaccataccaccaacaagacacaagagtataatgtactgccagtgtcctctgaaacggatcaggaaatatagaagttgatgtaaataaagtggtgccctctaggacacctcatttggacacttctcctacccgtatggaacacaacatgcttagtcaaatcttcttctctctctctctgcttacttacagggtttgcaaaacagaaagcttgtgttctccgcaatgaaaaatgacttattgtctcagtttttagaaaaatgaaaattaatttctagtccttc

SEQ ID NO: 134 - DNA, 1490 bp, Glycine max
  Clone ID: PAT_MRT3847_136906C.1
acgcgagcttgagcttgggatggagtttacattcatctcaagccatttgtctctcacatcaattcatgcttctcctctcttttgaacacacaacaaaaccagagttaccaacagatccaattctaatcctttgaaattcactaaccccctatttctattctctcttagttccagtttttcactttgctagtgtcttctgcatttgcttccacagttgcttcgccaggaagaaataacaaaaggaaacaccttcttgcttttcctacctgattgtaaagaatctctcttttctcatttgggacatcactgttcactttctgcatcaactcgctgttggattttaatatttatctctgctatcaatattattaaggtctcacttctgggattctgaattctatgccccttggaccaaagtttctgtaaggggattttttgttgtaaagtatggaattcgagacttcatatccaacttgttttatgtcaaattcaagttggttttctcaagaaagccaattcacagaatggacaagagaagagaataagaaatttgaaagtgcccttgccatatatgataaggataccccagacagatggctgagggttgcagccatgctccctggaaaaactgtctatgatgtgatcaaacaatacagagaattggaagaagatgtttgtgaaatagaagcagggaggattccagttcctggatatcctacctcttctttaacattgaagatggttgacaaccaatgttatgatgcatgcagaaagaagcctgcaactctcaggagttctgatcaggagaggaagaaaggggttccttggacagaagaggaacacagacgttttctgatgggacttttaaagtatggtaaaggggattggagaaacatttctcgtaattttgtggtcacaaaaactcccacccaagtggcaagccatgctcaaaagtattacataaggcaaaagctttctggagggaaagacaataaaaggaggcctagtatccatgatatcaccattgttaatcttacatcagatcaagagaagcctcttttactcaatgatgagtctcacatgacttttgagcaacagaagctaactagcatgccaaaagtacaactagaatggattaatcaccacgacaatgggtcacgtatggttgtcaacccaaattatgatatgttcatgtcaccttcatctggcatctcttccaagaccctcaagttgcaagggcaagatttctatgaatgtgcctttcatgagacttatgctaagcttaaaaattcgggtttcaggacaacttctagagacttcaacaaggaagtcagacagttatttaacatgtctatttctttgtatagactcaatctgcatcacaggatgcgccattcaggtattctcagtctcgggcaacgagacaatattcagtattcatgcactctgatcttgttatgaacagcataccggttctactacatagatca

SEQ ID NO: 135 - DNA, 1552 bp, Glycine max
  Clone ID: PAT_MRT3847_136907C.1
ccacgcgtccgcattcatctcaagccatttgtctctcacatcaattcatgcttctcctctcttttgaacacacaacaaaaccagagttaccaacagatccaattctaatcctttgaaattcactaaccccctatttctattctctcttagttccagtttttcactttgctagtgtcttctgcatttgcttccacagttgcttcgccaggaagaaataacaaaaggaaacaccttcttgcttttcctacctgattgtaaagaatctctcttttctcatttgggacatcactgttcactttctgcatcaactcgctgttggattttaatatttatctctgctatcaatattattaaggtctcacttctgggattctgaattctatgccccttggaccaaagtttcgtaagttctttgttgttgtgcatttcttttctttttttttttatccgtgggaatggaagaatgacaggaggtttacaataactcgtgcatccttcttaaccaacttaactagactcccttgacatttctttctagtttctcatttccatttctttagtgtaaggggattttttgttgtaaagtatggaattcgagacttcatatccaacttgttttatgtcaaattcaagttggttttctcaagaaagccactacacagaatggacaagagaagagaataagaaatttgaaagtgcccttgccatatatgataaggataccccagacagatggctgagggttgcagccatgctacctggaaaaactgtctatgatgtcatcaaacaatacagagaattggaagaagatgtttgtgaaatagaagcagggaggattccagttcctggataccctacctcttctttcacattgaagatggttgacaaccaatgttatgatgcatgcagaaagaagcctgcaactctcaggagttctgatcaggagaggaagaaaggggttccttggacagaagaggaacacagacgttttctgatgggacttttaaagtatggtaaaggggattggagaaacatttctcgtaattttgtggtcacaaaaactcccacccaagtggcaagccatgctcaaaagtattacataaggcaaaagctttctggagggaaagacaataaaaggaggcctagtatccatgatatcaccattgttaatcttacatcagatcaagagaagcctcttttactcaatgatgagtctcacatgacttttgagcaacagaagctaactagcatgccaaaagtacaactagaatggattaatcaccacgacaatgggtcacgtatggttgtcaacccaaattatgatatgttcatgtcaccttcatctggcatctcttccaagaccctcaagttgcaagggcaagatttctatgaatgtgcctttcatgagacttatgctaagcttaaaaattcgggtttcaggacaacttctagagacttcaacaaggaagactcaatctgcatcacaggatgcgccattcaggtagccaattcacttgctgatgtggctgactcacatgagcacttgaattga

SEQ ID NO: 136 - DNA, 1816 bp, Glycine max
  Clone ID: PAT_MRT3847_136948C.1
ggctcgaggtcttgtctccggtttgttgcagttgcggttgcggttgcgattgcgatggtgaaatcgaacgagaacggttctggttccgtttcggtgcctcctttcctgaaaaaatgttacgatatggtggaagaccgcaacactgattctatcatccgttggagcgatggcggtgacagctttgtcatctccgacatcactcaattctccgtcacgctccttcccacctatttcaaacacaacaatttctccagtttcatcagacaactcaatatctatggtttcaggaaaattgatacggattcctgggaatttgccaatgaaaactttgttaggggtcaaaagcatttgttgaagaatatacatagaaggaaacatccacacagtgcagatcagcaaaaggcattgccacagcaagacaattgtgatgaaccatcccaagaagcaccaaatcatggcctttggaaagaagttgagaatctaaaacttgataaaaattcgctcacacaggaattggtcaaacttaggcaacatcaggaatctgctgagagtaagttgctgctcctgagtgatcgccttcaaggaatggaaaagcatcagcagcagatgttgtcattcttagtcatggttgtgcaaagccctgggttcatggttcagcttcttcatcctaaggaaaataattggcgtttggctgaatcatggaatagattggatcaagataaacaagatgacaagccagttgcttctgatgggatgataataaagtataaaccacctgtaggtgaaaaactaaagcccgtagttcctctatctcctggtttcgaaaatcaaccagaacctgagctttctgctgatgggctgaaagacttgtgcatcagttctgaattcttgaaagtacttctggatgaaaaattgtctccgttagaaaatcattctccatttctcctaccagatttacctgatgatggttcatgggaacagctttttcttggcagtcctttcctgggaaacattcaagattctaagaatgaaagtgaggggcacaccaacagtggaatggagatggaaccaacaatatctgagactccaaatgaaaattctcgaacttttgaatcgatgatcgtagagatggagaaaactcgagaataagttggagttgtatgcacatggtgggctgtcttcataaaataatatccatcaaatatttttcatatgggctgtctcatactgagctaatggagctttagattctgaaactaacaacatatagggaaggaagtaataatgttcatcagatatttttcagctgagctgtcttcacatattacttcaacactataattatatcatagtattaagtcgcaattattttctctcccatcttccttcagcagttgttagatcctcatctaaaatccttattttggcatcttgatacatggtgtcggagaccaggagtcgtatgttagtgcactagtgcggctacctatatataatggatcaaatatttcttatttggagaactgcaagggaaaacggcaactttattttttgtgccacattaaacagtggcacttgccttcatatatattataaaatttcataaaattcatgcttcgtttgcatattattattgcagaagccagtgctctgataatgctctttcccttttctctcttacttcccgtagtcctcatgcgtctgaactttataattctactgttgtgttttgatatggtggcaaagagattttgttgcaccacaaaaaggttcattataaattaagttggattaaagctaacttcaaaacaaaaaa

SEQ ID NO: 137 - DNA, 2905 bp, Glycine max
  Clone ID: PAT_MRT3847_137166C.1
gtgttatttaaaacagaaatcacatgtatggctggtagcagtaaaggataatattaatgttgaatagcggatttagatgcctacgaaccatgtttttgtcgtgtattcctatttcctagtttcattcagctcactgatttcaattacattgcataggcaattttgtaaatcagaggctaagagacttgtagtaatttgtaaagacgcctctgaattttggtccaccaccacacccttcttctcatctccaccacaccaggtgttgttgcgcttcagaaatggctaccggagctgctgtgccaactacgttttctaccctcaagacatgggattccagtttggggtttgcaaaaaacatagattttgtgagagtttccgatatgaagagcatgaaatcttctgcgaggaaaagggtgtcaattatcaggaactcaaatcctggccaagatattgctgaacttcaacctgcatccccaggaagccctcttttggttcctaggcaaaagtattgtgaatcattgcacaaacccatcaggagaaaaacaagcacagtaatggttggtaacgtggctattggtagcgagcatcctataagaattcagaccatgactacaactgacactaaggatgttgctgggacagttgaacaggtgatgagaatagcagataaaggagctgatattgtacggataacagttcaagggaagaaagaagctgatgcttgttttgagattaaaaacacccttgtgcagaaaaattacaacataccgttggtggctgatattcattttgctccctctgttgctttgcgggtagctgaatgctttgataagattcgtgtaaaccctggaaattttgctgatagacgggctcaatttgaaacattagagtacacagaagaagactatcagaaagaacttgagcatattgaaaaggttttcacaccattggttgagaaatgtaagaaatatgggagagcaatgcgcattgggacaaaccatggaagtctttctgatcgtataatgagctactatggagattcacctaggggaatggtagaatctgcttttgaatttgcaaggatatgccgaaagttggactatcacaattttgttttttctatgaaagcaagcaacccggttatcatggttcaggcataccgcttacttgtggctgaaatgtatgtccaaggctgggattatccattacacttgggtgttactgaagctggagaaggtgaggatgggaggatgaagtctgcaattggcattggaactcttcttcaggatggattgggtgatacaattagggtttctctcacagaaccaccagaagaggagatagatccttgcagaaggttggcaaatcttggaatgagagcttctgaactccagaagggggtggaaccttttgaagaaaagcacagacattattttgacttccagcgccgatctggtcaattgccagtgcaaaaagagggtgaggaggtggattacagaggtgcactgcaccgtgacggttctgttctcatgtcagtctccttggatcagttaaagatgccagaggtcctctacaagtcacttgctgccaaactcattgttggcatgccatttaaggatttggcaacagtagattcaattttattacgggaacttcctccagtagatgatgctgatgctcgactagcactcaagagactgatagatatcagcatgggggttataactcctttgacagagcagctaacaaagccattacccaatgccatggttctagtaaaccttaaggaaatatctaccggagcttataagcttttgccacaaggaacacgcttggttgtgtctgtccgaggtgatgagccttatgaagaactggacattcttaagggtgttgatgctactatgcttctccatgaccttccttatacagaagacagaattagcagagtgcatgcagccagacggttatttgagtacctatctgacaattctctaaacttccctgttattcaccatattcagttcccaaatgggattcacagggatgacttggtaattggtgctggttctgatgctggagcccttctggttgatgggcttggagatggactacttttggaagccccggacaaggattttgaatttattagaaacacttctttcaatttgttgcaaggctgcagaatgagaaatacaaagacagagtatgtctcatgtccatcctgtggcagaacattgtttgatcttcaagaagtaagtgcacaaattcgggagaagacatcacacctccctggtgtttcgattgcaatcatgggatgcattgtaaatggaccaggggagatggctgatgcagactttgggtatgtgggaggcactcccgggaagattgacctctatgttgggaagactgtggtgaagcgtggaattgcaatggagcatgcaaccaatgccttgatcgatctaataaaagagcatggacgatgggtggaccctcctgcagaggagtaaaggcaagagctcaattttgagattggcattcaagtccaatgtaagatgatcattgttatagcctattattgtacacatgtaatataagataacactcaatgcttaagtttgagcctagttttaagttccttttgagaaagatcccaattaaagcttgggcggtgaggaaatcgacagctataacaagtatacagataacagtgtattgctttgccccatcagccatcaataataatgagaatctcttagaatagtgccagttaaaaaaccgggccttattcgcccagcagtatcatttagaattagagggatttaaaataaaacttttcaaatattagggatcaaatgtaaaattcgagtatatattaggaatcaaaaacatatttaagccttatctt

SEQ ID NO: 138 - DNA, 1976 bp, Glycine max
  Clone ID: PAT_MRT3847_137229C.1
ggccggaaccacgcgtccgcctcaatcacccaacacctagtattattattcaatgcctgaaactcccccatcactagaaagaaaaacataacaagtcaccatataaaggagttagagtcattaataggagttagtttgagacttgaaagactgaaaagaaagtgaaagtggtccaacctagttagacaacaaaaaatggcatcggataaggtggtggaaacggtcatagcagggaactacgtggaaatggaaactgaagggaagcccaaggacgtaaaaaccaagctatcaagcttgttgtggcatggaggttctgtttatgatgcttggtttagctgtgcttccaaccaggtggcccaagtgctgcttacgttgccatactcattctcccaactgggaatgctttctggcatacttttccaaatcttctatggtttactcggaagttggacagcttacctcattagcattctctacgttgaatacagaacaagaaaagagagagaaaaagttaacttcagaaaccatgtcatccagtggtttgaagttcttgatggactcctcgggaagcactggagaaacgtgggtttggcctttaactgcacatttcttctgtttggatctgttatacaattgatagcttgtgcaggcaacatatattacataaatgaccacctggacaagaggacttggacttacatcttcggagcttgctgtgccaccactgtctttattccttcctttcacaactacagaatctggtcctttttgggcctccttatgaccacttacactgcttggtatctcacagttgcctctctccttcacggtcagatggaaggagttaagcattcgggtccgaccaaattggttctatattttacgggggccacaaacattctctacacattcgggggacatgctgttactgtggagataatgcacgcgatgtggaagcctcaaaagttcaaggccttatacttactggcaaccctgtatgtgctgacactgacgcttccatcggcagcagcagtgtattgggcatttggagacatgcttctaaatcactccaatgcttttgctctccttccaaaatcacccttccgtgacatggctgtcattttaatgctcatccaccagtttataacattcgggtttgcatgcaccccattatacttcgtgtgggagaaagcaatagggatgcacgagtgcaagagcctatgcaagcgtgcattggtgagattaccagtggtgatccccatatggttcttggccatcatattccccttctttggtcccatcaactccaccgttggctctctccttgtcagcttcaccgtttacatcatccccgccctcgcccacatcttcaccttcagatcaccctcttccagacagaatgcagtggaacaacctcccaaatttgttggaagatgggtgggaacctttattatcaacacttttgtggtggtgtgggtcctagtcgtaggatttggatttggagggtgggccagcatggtgaacttcatacgccagattgacacatttggactcttcacaaagtgttaccaatgccctccaccgcttctaccacctatgccgccgcatcagctcaacgccaccgcgccttccccacttcaccaccctcatcatgcacactaaggattgcactctttaaagttcaaattgagacccatctatgaagcggcaccctaggctctttggtgaaattattaacggtgcaatacatgtcattgttacgttgagaatgataaatttgtaatgtattggccgtgtcataattaaacatataatgtattcttcaattatccttctctttatagccttaaggtagttttgagcactttgtcatggtcagttatcataagaagaaaaaagaaaataaaacgataaggtttatgatgaatttgcacaaagtttgtttggttttagaccaattaattcaacatatttat

SEQ ID NO: 139 - DNA, 1219 bp, Glycine max
  Clone ID: PAT_MRT3847_137321C.1
ggcagttttataggtctgtaaataagactgactacttgactttgcgcaatgggtttatcactgtccacctggctcctggaagtaaatataatttccaaaagtttatcaaaagatcattagaagatgacttcaaggtggttgtgggagtcagtcctatcctctgggcatcagttgtagtttaccttctcatcaatattaatggatggcgtaccacaatttgggcagccttaattcctgttgtcttaattttggctgttggaacaaaacttcaagctatattggcaaagatggctcttgaaatcaccgaaagacatgcagttgtccaaggaatgcctcttgtccagggctcagacaaatacttttggtttggtcaaccacagttagttcttcatgttattcattttgctttgttccagaacgcattccaaataacatatatcttgtggatatggtattcttttggggtgagaaactgtttccgtactgactacaagcttgcagcattaaaagtagctatagggatttcgatgctatgcctctgcagctatatcacccttccattatatgctcttgtaactcagatgggttcaaggatgaaaacagcagtatttgaagagcaaacaaacaaggctctgaagaaatggcacatggatgcgaagaagaagaagaagaagcatgtaggaacagtgacactaggaaagtcgagtgcacgaatcatggatggaagccccattggtaattcttcaacagtgcactcctcctctgttcccacactacaccgtttcaaaactaccggccactcaacccgctcctcatcgaaagagtacgaggatcatgatcatgatcatgaatatgaatccgatgatgttgagttgtttcctgtgtcgtcgcaaacaactagcttcattgtaagagtggaccgtggcgaccaacaacaacaagcagaagaagaacatagacaacatagtgagggagaaaccaacagtagcagtgaaggtgaattctcatttgcaaaacctgaccccgtagaaattagaaccaccacatagcagcatatattcacctctattcttttgcaatatcttcacataaaaaagaagaaaaaaacattttctagatcatggggtatcttgaaacttagagatgaatttttacattcttgatcagcataattcacttgctcctaatggaagcattgccctcacattatataaaaagg

SEQ ID NO: 140 - DNA, 252 bp, Glycine max
  Clone ID: PAT_MRT3847_137585C.1
ctcggttcctgcaacggactcctctgtatatccaacgtcgccgacgacatcgccttttggaacccctccctccgccagcaccgtattcttccctctttgcccctcccccgccgccgcctccaccccgacaccactctcttcgccgcccgcgtctacggcttcggcttcgaccatacaagtcccgactacaagctcgtccgcatctcttacttcgtcgacttgcaggaccgctccttcgactcccaggtcaag

SEQ ID NO: 141 - DNA, 1570 bp, Glycine max
  Clone ID: PAT_MRT3847_138356C.1
aaagggggggttgggctgtgcatccgaaattctgatctgtgagaatgggaaaaggtggatctctgagcgacggcgtggtgaagaagatcgttctctcctacagctacgtggcaatatggatcttcctgagcttcaccgtcatcgtctacaacaagtacatcctggacaagaagatgtacaactggcccttccccatctccctcaccatgatccacatgtccttctgcgccaccctggccctcctcctcgtccgtgtcctccgcctcgtcgagcccgtctccatgtcccgcgacgtctacctctcctccgtcgtccccatcggcgccctctactccctctccctctggctctccaactccgcctacatctacctctccgtctccttcatccagatgctcaaggccctcatgcctgtcgctgtttactccatcggcgtcatgctccgaaaagaatcctacaaaaacgacaccatgcttaatatgctctccatctccctcggcgtcggcgtcgccgcctacggcgaggcccgcttcgacgcctggggcgtcctcctccagctcggcgccgtcgccttcgaggccacccgcctcgtcatgatccaaatcctcctcacctccaaggggatctcgcttaacccaatcacttctctctactacgtcgcgccgtgctgcctcgtgtttctctctattccgtggatctttgttgagtatcctgttttgagagacacttccagcttccacttcgatttcgtcatcggctggaccaactccttctgtgcattcgcgctgaatctggccgtgtttcttcttgttgggaagacgtctgcgttgaccatgaatgtggccggtgttgtgaaggattggttgctgattgcgttttcgtggtcggttattaaggacaccgtgacgccgataaatttgttcggctacgggcttgcgttcctcggcgtggcgtattacaatcactcgaagctgcaggcgctcaaggccaaggaggcgcagaagaagaccgcgcaggcagatgaggaggaagggaggttgctcgaggacagagatgacaacaagaggaacgaacagcagacttaacttttatttatttttaatcgttccctgttttattttacacagattcaagaaaggaaaaaaacaaacaagaggtttggtttggttttcgaggcaaatatggaaatgtcatcgtcctctctgggcatattgccggttcggtattgtttttttagttgctagatcttcttcacgttgccaatgcggtgggtagttaattagtagatatgggtttgagatttgagaacaattatgtgttactagagctagagtctccaatccttttattattattattattattattttcttttatctcattcccgttttcggtggttttgttttatgttatgttattgtaggaactcgatttatggagtttacatgcttcttattaattcatagtacatttcaattctgtgtaatgtgaatttgggatttatcttatagccaagctgtctgacaaatttcacttggcactgtgttccgaattactctgtttcggttgt

SEQ ID NO: 142 - DNA, 2673 bp, Glycine max
  Clone ID: PAT_MRT3847_139152C.1
ctcgagccgattcgtctctagtctttatttatctagcgtgtctgagaattccgtggggtggacgagcgagggtgcgactatgacctgcgacttcgatctccggcaatccgcggcgaggttcgtccagtaaaacggcgccgtatagcgggatctgcgacgctgggcggagtggcaatggagggcgagaacgcgagcaacaaggtgatcgagttgatgaacgagatagccagcatctccgattacaggcctccggtgaagaagcagtactgcaacttggcgcggaggctgaagcttctgatcccgatgttcgaggagattagggacatgaacaaagacgcgcttcccgataacacttccaacgccgtcctcgccttcaaggaagctctcgaatccgctatggaactcctcagattcggaagcgagggcagcaagctttacttggtccttgagcgggacgaaattatgaataaattctacaaggtgacagctcagttggaacagtcgttgggtggtatttcctatgataaacttgatatatcagatgaagttaaagagcaggttgagttggttcttgcccagttcagaagagctaaagggagggttgatgaaccagatgtcaggttgtatgaggatatgttgtctgtttacaacaacagcagtgatgcagctacagatccatctgttctaagtcaattagctgaaaagttgaaattgatgggaatagctgatcttactcaagaatcacttgctttgcatgagatggtggcatcaagtggtggggatccaggggcacgcattgagaaaatgtcaatgttattgaagaagataaaggatttcgtgcaaatagaaaatctagtcaaggatgataatttaggaggaaaaggcattttctcaaaagtctatggacttgggacaaatgaaaagagtcatcaagctcctgttatccctgatgattttcgatgtccgatttccctggaattaatgaaggaccctgtcattgtttcaacgggacagacttatgagcgtacttgtattgagaagtggttgcaagcagggcatggaacctgccccaaaacacagaagactcttactagtactgttctcacgcctaactatgtattgcgaagccttatagcacattggtgtgaagccaatggcatagagccaccaaaacgacctagcgattcacaacctagtaaatcagcatcagcctactctcctgctgagcaaagtaagattgaaagtcttctccaaaagctcacatctgtgagtcctgaagaccagagatcagctgctggcgagatccgccttcttgcaaagcgcaacgcagataaccgcgttgccattgctgaagctggtgcaatacctctccttgttggtcttttgtctgtgcctgactcccgcactcaagaacatgccgtgacagcgctcctgaatctttccatatatgaaaacaacaaaggaagtattgtttcttcaggagcagttccaggtatagttcatgtgctgaagaagggaagcatggaggctcgggaaaatgcagcagcaacacttttcagcctttcagtaatagatgaaaacaaggttacaattggatctttaggagccataccaccactagtgacactgctaagtgagggtaaccaaaggggtaagaaagatgctgcaacagcactcttcaatttgtgcatttatcagggcaacaagggaaaggcagtgagggctggcgttattcccacgctgatgcgactactgactgaacctagcgggggaatggtggatgaagcattagctattttggcaatattggctagccatcctgaagggaaggctactattagagcttcagaggcagtgccggttttagtagagtttattgggaatggctcaccaaggaacaaagagaatgcagctgccgttttagttcacctctgttctggagatcaacaatatcttgcacaggcacaagagctgggggtgatgggtccactgttagaattggctcaaaatggtacagacagaggcaaaagaaaggctggacaattgctagaacgtatgagcaggttagttgagcaacagcaggaagttccaatacaaactgaaactcaagctcagaacgaggatacccaaccacctttgattactaaccccgatgattcctaagatgtcttattatactttgttcattttgtctttttgttctctttaaagtgttgaaagaagcatctgtttggaggaaagggtggaagatcaccttcctactccataagttatttgtttgtttgtgtgatattcagcagagatgtaatgcaaaaaacttgtgaaagtgggcaagaagaaatcgaagcaaatgggcaagcttgaagtggaaaatgtataatttgtaacatgcactgtattctaatcatcctcagattttaatgaagagatgttttgtttattcgtaccgcatcacataatgatagagatgttataaaagtataaagtcattcatttgtctaccgcatcagatgatgttagagatgttataacagtataaagtcaatcatttgtcttttttaaaaaaaaaaaaaaaaaaaaaaaaacctagaaatttatcctttcgaaaatgttagttcgcgccgtcatattagagttattatgatcaagtgatttgaagttgaattcttgtcc

SEQ ID NO: 143 - DNA, 1488 bp, Glycine max
  Clone ID: PAT_MRT3847_139372C.1
tacggaagacgacagaagcttggtgtaagtgttgttcttccgatttggttcaatcaaatcaatgatgttgaggaggaggggttctgtgacctccttctattccaaattcatcgattctcacaatcttaattgtgggcgttcctcttcgaatccccatcgcgtcgccgcttctgcaacttcattcgatatctcttccgcttctgcgtctaaagctacgaccgactttgtgtcgttgacccgccactatggaaggtgctattgggagctctccaaagctcgtctcagcatgcttgtggttgcaacatctgggactgggtttgtcttggggagtggtagtgctgttgatctttcggcactttcttgcacttgcttgggtaccatgatggttgctgcatctgctaactctttgaatcaggtgtttgagatcaataatgatgctaaaatgaagagaacaagtcgcaggccactaccctcaggacgcatcacaatacctcatgcagttggctgggcatcctctgttggattagctggtacggctctactagctacgcagaccaatatgttagctgctgggcttgctgcttccaacctaattctgtatgcatttgtatatacacccttgaagcagattcatcccataaatacatgggtgggagctgttgtcggtgctattccaccacttttgggatgggctgcagcttctaatgatatttcactaaatggaatgattcttccagctgctttgtatttttggcaaataccacattttatggccctagcctatttgtgtcgtgatgactatgctgctggagggtttaagatgtactctcttgctgatgcatctgggcatagaacagcattggtggctttaaggaactctatatatctaatccctttggggttcttggcttatgattggggtttgacttctggatggttttgtcttgagtccgctgcacttacacttgcaataagcgctgcagcattttcattctatagaaaccgtaccaaagaaaaggcaaggagaatgttccatgccagtcttctttacctccctgtgtttatgtctgggcttttgattcaccgtcgttctgaaaacgaacaattcttagaagacaaagcaaagggttttgtgaaatctgcatcctctacggagtcttcagagttggatgatgataacggcgatcaaaatatcaaggccaggcgtccctatcggactgaagcgcgtcctcccgtatcgtatgcctctgttgcaccttttccctttttgcctgctccatcatataacttcccttgatatctgtcagttatacggattttgtatgacttcaacattttctcggccaagttttgtttggttaagttgatatattcattgaaatgatacattctaatttgtctgtttaagccgttaaggttgttttatgtgccacaataaaaattgaagatgcatctgtaatctgaaataaatgagattttgtttctttt

SEQ ID NO: 144 - DNA, 445 bp, Glycine max
  Clone ID: PAT_MRT3847_139958C.1
aattcggctcgagctccgagccgaatcggctcgagtgcgagaagacgacagaagggggaaatactcagaagatgatgcaaaggccgtcatggtacagatactaaatgttgttgcattttgtcatctacagggtgtggtacaccgagatcttaagccggagaattttttgtatgctaaaaaggatgaaagttctgagttgaaagctatagactttgggttatcagattttgtcagaccagatgaaaggcttaatgatattgttggaagtgcatattatgtggcccctgaagctctccatagatcttatagcacagaggctgatgtgtggagtataggtgtgatagcatatattctattatgtggcagtcgtccattttgggctcgaacagagtctggtatttttagggcagttttgaaagctgatccaagctttgatgaaacaccg

SEQ ID NO: 145 - DNA, 1637 bp, Glycine max
  Clone ID: PAT_MRT3847_140022C.1
ctctcaaacaccgaaccccacattattcgggaagagtaagtaggtgtctctcactctcccaccgaatccacattctaaagtaatacgccggagaatgacgtcacactcccactacccacccgacttagacgccgactccgtcacctcctccccacgctccgatcacttccacgacgcgccgccccgcatccgcttcatgtgcagcttcggcggcaagatcctcccccgcccccacgacaaccagctccgctacgtcggcggcgacacccgcatcgtcgccgtcaaccgctccatcactttctccgccctcattctcaaactctccaaactctcaggcatgagcaacataacagccaagtaccagctcccgaacgaggatctggacgcgttgatctcggtcaccacggacgaggacgtggagaacatgatggacgagtacgaccgcgtcgcacacaatcagaacccgcgatcggcgcggctccggctcttcctcttccccgaaggagaagactcccgcgccagcagcatcagctcgctcctaaacggctcagccaagcgcgaaaactggttcctcgacgctttaaacggcggcgtttcgggcctcgaacgaggccgctccgaagcctcttctatggtctctgaagtacccgattacctcttcgggttagacaactccgaagaaataacaaatcaccaacgcgacccgagacccaaacccggacccattattcaagataacgtttccgtttcagatccgggttcgcccgccccggttgtctcgtccccttattgttccacgtcatcagcgccgcccgtgccctctctcccgaaccttccctatgttaaaaccaaacctttaaacttaaatccggttcctgatactgactccaaggaaaatcaaaccgaacctgaaacggaacctcacccgaacctgaacctgaaccaaaacccgaacatgtattcaaataaccctgttgttcactaccctccagaagctgcttattcggcgcattcagtaaacccggttccggtttactatgtttccggtccggttcgaccgggatccgtgccggttcctatgcaaaccccttatcactacgttcaacaatcgtatcatgctgtggtgccacctcaggttcctatcgggtaccatcctttggttccgggttcgggtcaagtatatggagcgggcgtgaggcacatgaccccactgcaaccttacagcccctccaccacggcggtggttcatgacggtttgaaacagcacgtgtatcatgccgtgccaaattcgggtccggttccggttcacccagttattccgatgacgggtttggatgaaccgcagagaggtggagcgtaatttgtgacgggtcggggccccaattcacttaataactgatcccatttttatttagtggatgggtgctgaatttttactaccataccatcatgcaaatggtaatttatgtctatatatatacaagtgccttcactatcttttgttccccttatatgttgaatgcattactagccaaaaatggtaattacataaaattgtttgagcaaatcatttcaggttgtatattaaaaaggaaaaatgttgataaattatatttcgttatcctaccaaaaaaaaa

SEQ ID NO: 146 - DNA, 263 bp, Glycine max
  Clone ID: PAT_MRT3847_140192C.1
ctctctctctttctctttctctctcatccagatcttgcaaaaaaaaaaaaaacccaatggcagcgagcgctcccactccacgcgaagatttcgtgtacatggcgaattggcggagaaggccgagcgctacgaggagatggtggatttcatggagaaggtctccgcctccgccgaaagcgaggagctgaccgtggaggagcgaaacctcctttccgtggcctaaaagaacgtaatgggagctcgccgggcctcctggcgaataa

SEQ ID NO: 147 - DNA, 1559 bp, Glycine max
  Clone ID: PAT_MRT3847_140374C.1
gaaataaatacaaacagtaatcttataccaaaaactaatattgttagttgttttatccacggtgtactaaataaacaggtaagaccgtaagagagatttgaattaaaaaaggcaaaatgtaccaaaaataattaaaaaaggtaaaaaccaaagacttattattatcagcaaaattagaagattaatgattaaattgattgattttcttaaccttcttctcacactctatacaaactctcgtagcatttcggcatccaaactaactctctcatcttctacagcattcttctgcaattcaaatcaaattttcaaaccatggcttcctccaccaacgctcttcctcccaccggcaacggcctcatcgtgagcttcggcgagatgctcatcgatttcgtccccaccgtctccggcgtgtcccttgcggaggctccgggcttcctcaaggcccccggcggcgcccccgccaacgtcgccatcgccgtcgcgaggctcggcggaaaggcggcgttcgtcggaaagctcggcgacgacgagttcgggcacatgctggctggaatcctgaaggagaacgacgtgcgatccgacgggatcaacttcgaccagggcgcgcgcaccgcgctggcgttcgtgaccctacgcgccgacggagagcgtgagttcatgttctacagaaaccccagcgccgacatgctcctcacgcccgaagatctcaatctcgaactcatcagatctgcaaaagtattccattatggatcgataagcttgatcgtggagccatgcagatcagcacacctgaaggcaatggaagttgccagggaagcaggatgcttgctctcttatgacccaaacctgcggctacccttgtggccctccgccgaggaagcacgtcagcaaatactcagcatatgggacaaggctgatgtaatcaaggtcagtgatgtggaactggaattcctaaccggaagtgacaaaattgatgatgcatctgctctctccctgtggcaccccaatttgaagttgctccttgtcactcttggcgaacatggctctagatactataccaagaatttccatggatcagtggaggcttttcatgtcagcacggtcgacacaactggcgctggtgattcctttgttggtgctctattaagcaagattgtcgatgatcaatccgtacttgaagatgaagcaaggttaagggaagtactcaagtttgcaaatgcgtgtggagcaattacaactactaaaaagggagcaattcctgctcttcccacagaggctgatgccctcaacctgatcaaagaggcatagaaatttaatgctagtagcttttggttttctttatatatatgtcttcatccttttcctttcgcgttggacttgcttgctatcaacttcagatggattttgtttcttggttttctttgttttatttacccctcattctgcattaacggtaatatcatatgatttggggttttgccaaatgatttctttcaaattctgagattgagattattggttgaatgaaaatttgagtccttatcaggtcggtccac

SEQ ID NO: 148 - DNA, 1288 bp, Glycine max
  Clone ID: PAT_MRT3847_140375C.1
ggctcgagcttctatctctgcaattcaaacacaaaaaccatggcttccactaatgctcttcctcccaccggcaacggcctcatcgtgagcttcggcgagatgctcatcgacttcgttcccaccgtctccggcgtgtccctcgcggaggctccgggattcctcaaggcccccggcggcgcccccgccaacgttgccatcgccgtcgcgagactcggcggcaaagcggcgttcgtcgggaagctcggcgacgacgagttcgggcacatgctggccggaatcctgaaggagaacgacgtgcgatccgacgggatcaacttcgaaaagggcgcgcgcaccgcgctggcgttcgtgaccctacgcgccgacggggagcgtgagttcatgttctacagaaaccccagtgccgacatgctcctcacgcccgaagatctcaatctcgaactcatcagatccgcaaaagtattccattatggatcgataagcttgatcgtggagccatgcagatcagcacacttgaaggcaatggaagttgccagggaagcagggtgcttgctctcttatgacccaaacttgcggctacccttgtggccctcggccgaggaagcacggcagcaaatacttagcatatgggacaaggctgatgtgatcaaggtcagtgatgtggaactggaattcctaactggaagtgacaaaattgatgatgcatcggctctctccctgtggcatcccaatttaaagttgcttcttgtcactcttggagaacatggttctaggtactataccaagaatttccgtggatcagtggaggcttttcatgtcaacacagttgacacaactggcgctggtgattcctttgttggtgcactattaagcaagattgtcgatgatcaatccatacttgaagatgaagcaaggttaagggaagtactcaagtttacaaatgcgtgtggggcaattacaactactaaaaagggagcaattcctgctcttcccacagaggctgatgccctcaagctgatcaaagaggcatagaaatttagtgcttgtagcttttggttttcattttatatatatcttcatccttttcacttttgtgttggacttgcttgctgtcaacttaagatggattttgtttcttggttttctttgttttatttttaccgtattctgcattaacggtaatatcatatgatttggggttttgcataatgatttctttcaaattttgagattgttggttgagatgaaaaatttagtccttatcaggtcagcccaaaaaaaaaaaaaa

SEQ ID NO: 149 - DNA, 1585 bp, Glycine max
  Clone ID: PAT_MRT3847_140671C.1
ggctcgagaaacaaaacacacaaaccaattttaaataaccaaaaagaaaccacaagtttaaaaataaaaccgcaacaacatgattggtagttgagtacaacgcggcatgttataattggttgcaagatgttaccgaaggtttaatgcgacacgtggaccccattcactggttggaaatccagtttattctccaccctcacgcacgtaatcatatccctggagtcaagttcaagcatcgataggaccaaaaaagtaaaacagagaaaggggagggacatatttgacatttcacaaccgcgttcttttctacggagcctcgaccaagaagaatcgcagtgagaagaagagggggtcagagtgagaaagagaaagagagagagagagagaattcgtaaaccctaatttcggaaagatcggcgatgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataatatgaaaggagattattatcgttatcttgctgaatttaagtcacgcaatgagaagaatgaagctgctgatcagtctatgaaagcatatgagtctgctaccgctgcagcagatgctgatttaccttccacacatgccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagagtgagtccgatggatgatggaatcttccataggattcgatgcatgcgtttgggaatgaaacatgagggccgattacttatctgtgtattagctagagatagggattctattgtttcctctttgtttcctgttggattgcccaatacttcccgataggggaaagagatactccatttgtgctatatttatggtatgtttttatttgtgtggtgtctggaaatggcctatttcattcccaatccgtttcctccagtctctgggggatttgattgatgagaattgcttatggtgggtgtatttccttttccaatgaaatgctacaacatttactgcaatgttggagattgattcttcgattgtttaatcttgacttccattctgacc

SEQ ID NO: 150 - DNA, 1979 bp, Glycine max
  Clone ID: PAT_MRT3847_140672C.1
aacatgaaataaatagggtaattttttttaactaagaatagggtcaatataattttattacgttttaaagaatatcaatgcaattaaccattcaaaatatcaacgatcaatagatttgttgcccaaacaaacaacacaaggggcaatgacacaatcatatctaactttgaattaatatataacttaatctaggaaagaaactattaaagaatgaccgcgtaaaatccaaagcacgaatcatcatcaatttatcatcatgcatgtattttcctccttccttcttgttcttggacaataatgttgcctcctcaaccacagcaagctgacttttgtgcaacttcccctgccgttgcctgatctttttggttgtcgattttaattcctgctggctctgccttagagtcagtgtcagcaagcctttgttttatatctcttgcaatagagaagaaaacttcctccacatttagatctgtctttgcacttgtttcaaagaatttgatgccatactcatcggccagtgcttggcccttggaggtaggcacaacccgtttgctttcatccatgtcagctttgttccccaccagtattttgttaacattatctgaagcatgctgctcaatgttacgaatccaattcctgatattgttaaatgaagattcgtctgtaacgtcatagactagcaatatgcccatagcaccacgatagtaagcagttgtaattgttcggaaccgctcctgacctgcagtatcccaaatttggagcttgagagaaagagagagagagagagagagaaactgagagaaattcgcaaaccctaatttcggaaagatcggcgatggctgcctccaaggatcgcgagaacttcgtctacatcgccaagctcgccgaacaggccgagcgatacgaagagatggtggaatcaatgaagaacgttgcgaatctcgacgttgaactgactgtggaggagcggaatttactttctgttgggtacaagaatgtgattggtgctcggagagcatcgtggaggatcctgtcttccattgagcaaaaggaagaaacaaaagggaacgagttgaatgcgaagcggattaaggagtacaggcagaaggttgaattggagctttcaaacatctgtaatgatgttatgacagtgattgatgagcaccttatcccttcggctgcagctggtgaatccactgtgttttactataagatgaaaggagattattatcgttatcttgccgaatttaaggcaggcaatgagaagaaggaagctgctgatcagtctatgaaagcatatgagtctgctaccactgcagcagaggctgatttacctccaacacatcccatccgattgggtctagctttaaatttctcagttttctattacgagatcttgaactctccagaaagagcctgtcatcttgcaaaacaagcttttgatgaagctatttctgagcttgacaccttgaatgaggagtcatacaaagacagcaccttaatcatgcaacttctcagggacaacctaactttgtggacttctgacatcccagaagatggagaagatgcccagaaagtgaatggcactgccaagcttggtggaggtgaggaggcagagtgagtccgattgttgatgggatcttccttaggattcgatgcatgcgtttgggaatgaaacatgagggccgttacttatccgtgtattagctagagatagggttccattgttttctctttgtttcttgttgattgccccatacttcccgataggggaaagagatactccatttgtgctatatttatggtatgtttttatttgtgtggtgtctggaaatggcctatttcattcccaatccttttcctccagtctctgggggatttgattgatgagaattgcttatggtgtatttccttttccaatgaaatgctacaacctttactgcaatgttggagatttattcttcgattgtttgatcttg

SEQ ID NO: 151 - DNA, 1273 bp, Glycine max
  Clone ID: PAT_MRT3847_141088C.1
gctgcgagaagacgacagaaggggaggaacgtgaaaggcatagcagcgttgatttcaccatcgctgtggttttctttttctctattgaggttgtcattgggagcactcaacctaaccattcaagttgtgaaaccacatcgcaagaaaattcacaagcgatggatccgaagctgaaagaggtttctcagctcttcgatcgcttcaaggcttcgtttctccggaacgacttcgataactgttccaatctcctttctcagctaaaggtgttacttacaggtttcagaagcctgccaccgttgtttgcagatacacctaatgcagttcatgaattaacaatagcaagggatatatatgagcatgctgttgtccttagtgtgaaaattgaggatcaagatgctttcgaaagggatttcttccagttgaagccttattatacagatgcctgcaatcgtcttccaccatctcctcaggagtaccctatactgggtctcaacctgttgagactacttgtgcagaataggattgctgagttccatactgagttggaattgctttcatctgctgctcttgagaatccttgcattaagcatgccgtggagttagaacaatcttttatggaaggggcttacaatcgtgtcttgagtgcacggcagacagtgccacatgatacatacgtttatttcatggatcttttggcaaagactgtcagagatgaaatagcaggttgcagtgagaaggcctatgactatctttcaattaaggatgccaagcaaatgttgctgttctcctcagaccaggaactcctggaatatattaaagaggagcatcctgagtgggagattaagaatgatagtgtctttttccaaaaggcaaaagaatctgcaccttgcaaagaaataccctctctgcagctcatcaaccagacacttagttatgctagggagttggagaggattgtctgagtcgaaatgcaatggcggcttttgtgtttccaaaatttttaggtgtctggataatagttactaatattttgaaattgttcatttctgattcaatatggaactataaaattgttcacctctgtattttgatcatttaggtggcagtatggttgcttatattttatttttcttgacttgtgctctggaaaaagaaaaactcttccgtacttatccacctttttatgttgaggattatatgattcatgaagctgtagtctaaatttcaaacccatagaaaggttcatatcaaattatggggatataatttctgg

SEQ ID NO: 152 - DNA, 1220 bp, Glycine max
  Clone ID: PAT_MRT3847_141090C.1
gatcatcgctgtggtttttctttttctctgttgaggttgtcattgggagcactcaacctaaactattcaagttgtgaaagcacatcacaagaaaattcgcaagcgatggatccgaagctaaaagaggtttctcagctcttcgatcgctttaaggcttcgtttatcaggaacgactttgatacctgttccaatctcctttctcagctaaaggtgttacttacaggtttcagaagccttccaccgttgtttgcagatacacctaatgcagttcatgaattaacaatagcaagggatatatacgagcatgctgttgtccttagtgtgaaaaatgaggatcaagatgcttttgaaagggatttcttccagttgaagccttattatacagatgcctgcaatcgacttccaccatctcctcaggagtacccaattctgggtctcaacctgttgagattacttgtgcagaataggattgctgaattccatactgagttggaattgctttcatctgctgctcttgagaatccttgcattaagcatgctgtggagttggaacaatcttttatggaaggggcttacaatcgtgtcttgagtgcacgacagacagtgccacatgatacatacgtttattttatggatcttttggcaaagactgtcagagatgaaatagctggttgcagtgagaaggcctatgactatctttcaattaaggatgctaagcaaatgttgctgttctcctctgaccaggaactccttgaatatattaaagaggagcatcctgagtgggagattaagaatggtagtgtctttttccaaaaggcaaaagaatctgcaccttgcaaagaaataccctctctgcagctcatcaaccagacgcttagttatgctagggagttggagaggattgtctgagaagaaatgcaatggcggcttctgttcccaaaatttctaggtgtctggataatagttgctaatactgtcttttgaaattgttcatttctgattcaatgtgaaactataaaattgttcacctctgtattttgatcatttaggtggcagtatggttactttttttttttaacttgtgctctgggttttccacttttttatgttgaggattatatgattcatgaagctgtagtctaaatttcaaacccatagaaaggttggttgatatcagtgttgccaaatagcggctatcatgctatagcatagtggttttt

SEQ ID NO: 153 - DNA, 280 bp, Glycine max
  Clone ID: PAT_MRT3847_141452C.1
ggggaagaatgaaacctttttgaaatgatgattatcaacccacaaaaaggaaattttccatatgaggatgatgaccatgatcttaattaaaaaaggggtttaaatgcaacgcccatccttggaaggggaacaaaaacaaaattttgtgcccttggaacaaggagggcgggtttttttttcatgctaactttgggggcaccaccctttaatatttgttcttggggacccagcacttgcaagttgaagcactgaataaaagatgcaagaagtgttgccattc

SEQ ID NO: 154 - DNA, 373 bp, Glycine max
  Clone ID: PAT_MRT3847_141685C.1
tttttaaacagcattaacatcatacaaagatggggaaagagcgtacacagtaattgaatacggaacacacatttgcacgacatgtttcttgagctgtagaattagaaataaacatacaatatacgtacaccgattggagggataaagaaatgatgtgcaaaaaccaaaggttgtctttatgcttctgaatatataggacctaaagttgcactatctcgtttgaaacgtatattcttacaaccttggtattcaccttgattgctgattgcttaaaccctattatacttggcctatatggaacatattgaagatgtgttaaaacctgtgcgatgagaattaaactatacttgtgcaaatcctatggataacaggg

SEQ ID NO: 155 - DNA, 484 bp, Glycine max
  Clone ID: PAT_MRT3847_14188C.1
gttacttgcggaaaaaagctccacaggcaaggaaaaaacaacaccgagccaaaacaagtccctatttacaccaaactagcctacatattaggccttcgtgtttctccacatcacaggagaatgggaatagggatgaagcttgtgaagaaaatggaggaatggttcagggataacggggcagagtatgcatacatggctacggagaaggacaacgttgcatccgtcaagttgttcaccgacaaatgtgggtactcaaagtttcgtaccccctgcattctcgcgaatcctgttttctcgcatcctgctagaatctctcacaaagtgactatcattgaactctctccgagcgatgccgaaatactctaccgcagcaagttttccacaacggagttcttcccgcgcgacgtagactccgttctccgtaataagctctccttaggcacttttcttgccgtccccaaaggcttgtaccgggctgacacgt

SEQ ID NO: 156 - DNA, 535 bp, Glycine max
  Clone ID: PAT_MRT3847_141898C.1
acgtaagctcggaattcggctcgtgtcacaaatgtaaaaaaataataaaaaaacccgagaaagagtgaagtagaaataaaacctaggaaattaaggataatggaagtagcaaaggtactgcacatgaacggtggcgttggagacgcaagctatgcaaacaactcctttgttcagcaaaagttgatttgtttgacaaagcccttaagagaagaagccataaaaagcctctattgcggcacactccccagaaggttggcaatggcagatttgggttgctcttctgggcaacatgctttaattgtcgtgtcagacttcatcaaaactgtggagaagctttgcctagaattgaaccataaatctccggaatacaaggttttttttaacgatcttcctgggaatgacttcaacaacatatttaagtcccttgacagcttcaaacagaagttgtgtgaagaaatggaaagtgggattggtccatgctacttctttggtgctccaggttctttctatggcaggattttctcaaaccaaagtg

SEQ ID NO: 157 - DNA, 238 bp, Glycine max
  UNSURE (1)..(238): unsure at all n locations
  Clone ID: PAT_MRT3847_141941C.1
  unsure (1)..(238): unsure at all n locations
tgctcgtatatgtacgttgtcattggttgntgatgtttggtacaaccaattcatgtgtttccgttatggatggaatttaccccaaagtttttgagaattctgatggtgcacgaacatcaccatctgtggttgctttctaccagaaaggggagcttcttgtaggttccccagctaagcgtcaagctgtaactaacccaacaaacactctctttggtaccaagcgtttgattggtaggcg

SEQ ID NO: 158 - DNA, 520 bp, Glycine max
  Clone ID: PAT_MRT3847_142333C.1
ccacgcgtccgcccacgcgtccggaatgatgcagcattgcggcccttggccaagtgctctgaactgctcgtactgaaattaggcctgtgctcaagtatttctgacaaaggtcttgcttttatcagttcaagctgtggaaagctgattgagcttgatctctatcgctgcaattctattaccgatgatgggctggcagctttagctaatggctgcaagaagattaagatgctaaacctatgctactgcaacaagattaccgacactggtttgggccacctaggctctctagaggagctcacaaaccttgaactgaggtgcttggtccgcataacaggtattggaatctcatcggttgccatcggctgcaagaacctgatagagatagacttgaagcgttgctattctgtcgatgatgctggcttgtgggctcttgcccgatatgcgctaaaccttagacagcttactatatcctactgccaagtcactggcctgggcctgtgtcacctgttgagctccctga

SEQ ID NO: 159 - DNA, 590 bp, Glycine max
  UNSURE (1)..(590): unsure at all n locations
  Clone ID: PAT_MRT3847_142358C.1
  unsure (1)..(590): unsure at all n locations
ccacgcgtccgggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaagtcttcaagagcggcatcaacgcgacgccggtgatccagtgcagcnaggggcccttcgacaagtacatgct

SEQ ID NO: 160 - DNA, 484 bp, Glycine max
  Clone ID: PAT_MRT3847_142490C.1
ttagccgagagaggaggcgccgtatagataaaactacagaaattggagaatggaagtagcacaggtactgcacatgaacggtggcgttggagacgcaagctatgcaaacaactcctttgttcagcaaaaggcgatttgtttgtcaaagcccataagagaggaagccataacaggtctctattgcaacacagtcccgagaagcttggcaattgcagatttaggttgctcttatggaccaaacactttgtctgttgtgtctgaattcatcaaaactgtggagaaactttgccggaagctaaaccataaatctccagaatacaaggtctttctgaatgatctccctgggaatgacttcaacaacatctttatgtcccttgacaacttcaaagagaaattgtgtgatgaaattgaaactggggttggtccatgctacttctttggggttcccggttccttctatagcagggttttcccaaatcaaagt

SEQ ID NO: 161 - DNA, 632 bp, Glycine max
  Clone ID: PAT_MRT3847_142514C.1
tccgggaaaacagtgtacaagagtacaaccttttcaactccgaaggcgagccacgatgtcaggaagaggaaagggaggcaagggtttgggaaagggaggagcgaagaggcaccgtaaggttctgagggacaacatccaggggatcaccaagcctgcgattcggcgcttggcgaggcgtggcggcgtcaagcgtatcagcggtctcatctacgaagagacacgtggcgttctcaagatcttcctcgaaaacgtcattcgcgacgctgttacttacaccgagcacgctcgccgcaaaaccgtcactgccatggacgttgtttatgccctcaaaagacagggcaggaccctttacggtttcggtggttagttaggacattatggtaggctcttactcttattagtatcgaatcatatgttgctagatggatcttcacattgtaatggctgttgttgtttaatttctgttcccagcttatttttcttttagccgcgcttattaactgatcacttcttttgagtgataatgtgactagagatttttatttatttatttatttctgggtattgcgaacttgagggtggaaacattattataaaatgaaaaggaagtgcgtcgccgtttgcattgaatc

SEQ ID NO: 162 - DNA, 541 bp, Glycine max
  Clone ID: PAT_MRT3847_14254C.1
aaacaacacactgaactctcttcactgaaacgacacacacaaaaaaaagctttagtttaggatgacccaagtgaggaacaagcaagtggttctaagagattatgtcaccggattccctaaagaatccgacatgaacattgttgaaggcaccataatattgaaggttccagaaggttccaatgatgtccttctaaaaaatctctacttgtcatgtgatccatacatgcgactcctcatggccaaggaccgttctttcggagatggctccttcacccttgcctctccattgaaaggatatggtgtgtctcaagtgctggaatctggacgtccagattacaagaaaggtgatttagtgtgggggattactaaatgggaagagtatagcttggtcccctcatctctcatacatttcaaaattgagcacactgatgtcccactttcctactacactggaattcttggtatgccaggaatgactgcttatgctggtttctttgaggtaggttctcccaaaaaaagagacactgttttcgtttcagct

SEQ ID NO: 163 - DNA, 1886 bp, Glycine max
  Clone ID: PAT_MRT3847_142712C.1
ggctcgagaaaatatctctctctcgaaaagctagtttccccaattattgtgtcaactacataagctgggttcgtgccgtttcccccatctggggttggcttccttctgggtttttccgtttccggggatactcctctttctcttcaaatggaatgggtttctaggtttggattaggagaccacatccttttctgttggcttactggctgagggggtgtgtcttttcctccagttgtggagagaaagctgcattttgttccatggattattgttttgctccggctacttctgatggggctgaagtaatatgggaaacgagtcccgtgcaaatgcttcttgattatatgcttctcagcggctccaccagtccacgaatgtcctgctcagcagttctccatctgacaactcttcaaagagagtgtgtaactagtaataactgtgtatttgtgtgtatgtttttatgatcatataataatagatatgtttttggcatgccagttatgagtgctactattactactactactaccttaaactagaacaatgaacaggggaattgaagttctttctccagcctcatacctccgaagttccaattggctgttccaagaaagcttggggaccaggtggactccacaggagaacaagctctttgagaatgctttggctgtgtttgacaaggacactccggaccggtggctgaaggtggcggccttgattcccggcaagacggtcggcgatgtgatcaaacagtatagggaacttgaagaagatgtgagtgtcattgaatcagggtttattccacttccagggtacactgctgctgattcctttacattggagtgggtcaacaatcaaggatttgatgggctcaggcagttttatggtgttactggcaaaaggggtgcttccactagaccatctgagcaggagaggaagaaaggtgtgccatggactaaagaggagcacaggcaatttctgatgggtctgaagaagtatggtaaaggagactggagaaacatctctcgcaattttgtgaccacaagaacaccaactcaggttgcaagtcatgctcagaagtatttcatcaggcaactaagtggaggaaaggacaagaagagatccagtatccatgacatcacaatggtgaatctcccagaagcaaaatctccttcatcagagagtaacaacagaccctattcaccagatcactcagtgaaggatgtgaatccaccatcccagaatcaaagattgtctactactatggtaattaaacaggaacatgattggaaattgccatgtgaaactgtgcctatgcttttcaattccacaaatggaaacatgttcatgacaccactttgtgggatttcttcatatggatctaaaccacttcaggagcagtatttcctcagtggatgccagtttggaccttatgatacaattatgcaaatgccgtccatgcaaaatcaatgaactatatagaatgcagggattaaagttaaggtactaaaatgctaaaccttattcattgatgttggattgatttttagatgcttaagggtggttttatgtaaatatttcaaggattcacgagtttccttatcactcaatctttgaagagccttcatattgtattctgatattaaatgtgctggcaccaaagatgcaatatcagagtttggcagtgatatgcatcttccacctaggcagaaaggattatctgtaaaacgtataggacgagaggagttaccttgagtttgtgattattcacttttttttaaatgcttgatgcttcaaataaatataggcctttgcagctttgctaacgaatgcaagtttttattagaattcaattttgaagatgcattgtgtactaataatatact

SEQ ID NO: 164 - DNA, 820 bp, Glycine max
  Clone ID: PAT_MRT3847_142931C.1
ctcgagccgaatcggctcgagctcaacttggcatggtatcaggcatcttacttcagatcttctatggccttattggaagctggactgcttatctagtcagtgtcctctacatagagtacggctcgaggaaggaaaaggaaaatgtcagcttcaagaaccacgttattcagtggttcgaggtccttgatgggttacttggtcgatattggaaagcagtggggctagccttcaactgtactttcctcctatttggatctgtgatacagcttatagcatgtgcaagtaacatctattacataaacgacaaattgtataaacggacatggacttatatttttggagcttgctgtgcattcactgtgttcataccttccttccacaattaccgtatatggtcttttttgggccttggaatgaccacttacacggcttggtaccttgctattgcagccatccttcatggccaggtagaaaatgttacacactccggtccaacaaagctaatactatacttcactggagccactaacatactctacacgtttggaggacatgctgtgactgtggagattatgcatgccatgtggcagccccgaaagttcaaatccatctactttctggccactttgtacgttttcactctaacgatcccttctgccgtcgccgtttattggtctttcggtgatcagctccttgaccactcaaatgcattctctctgctccccaagaatgttttccgtgacgccgccgtcatcctcatgctcattcaccagttcatcacatttggatttgcgtgcaccccattatatttttgtgtggg

SEQ ID NO: 165 - DNA, 165 bp, Glycine max
  Clone ID: PAT_MRT3847_143114C.1
ggccggtcggctctccgaaccctacaagggcattggagattgctttggcagaacaacgaaagacgaggggcttgtttcattgtggagagggaacactgctaacgttatccgttacttcccaacacaggccctgaactttgcatttaagactaatttaagaaagct

SEQ ID NO: 166 - DNA, 1388 bp, Glycine max
  Clone ID: PAT_MRT3847_143255C.1
aagcaaagcacaaccacacttgaacctcataagcggagccacccctccctgcccccaaggaataactcttccgacagcaaccctgttcgtttataaccatcaaccaccttaaaccctgggtagctagctttttttttcattattgtgtcggcaatcggttgaggaaaaaaaaaacacagaggagggtgcaaaaagcagggtggtggatgatggaaggggtttcgagggaggctcagatgtcgattgctgcttcgtccatgtttcctggattcagattctgccctaccgatgaggagttgatttcttattacctgaggaagaagttggagggtcatgaggagagtgttcaagtcatttctgaggttgagctttgtaaatacgagccttgggatttaccagccaaatcattcattcagtcagacaacgaatggttcttcttctctccccgcggaagaaagtacccaaatggttcacaaagtaaaagagcaactgaatgtggatactggaaggcaactggcaaagagcgtaatgtaaagtcaggttccaacattataggaacgaagcggactttggtgttccacttagggcgtgcacctaaaggggaaaggactgaatggattatgcacgagtactgcattaatgacaaatctcaggaatctttggtcatttgtcgcctcaagaggaacacagagttccgtttgagcgatgcttcgaatagagcttcatcaagtcaaaggcatccggtgaattcacatgaaagtggttgtgctatctcaggaggtggtattgatcaaagggatgcttgtgagcaagacaaagaggttggatgtagctccaagagggacagtagcagttatggttctccttcaatggagcaaattgattctgtgtccgaatcgaatcagcgaccagttaacgaagctactttcactgaatcttcaggtcaaccaaaggaggggtatgaagaggattgttatgcagagatactaaaggatgatatcatcaaattagatgaatcatcagtcttggtagagagtcacacaagaccacaggatcctacacagatgcaacctgcaccacaaggcacagcacaacggagaataagattaagggttgggaattcaaagcattctcgtgcagtagttcgtttcccaagcacaatgcactcatcaaagaataccttctttgccagaacaaccaacagtttggtggtattagctttcttcgttttcactttgatggttctatattttttgtccttagtgagaggacaaaaacaagacaagtattgtggggaattttcgggtgtaaatcatgattagtgctacacaaagcgtaggcaatttgttaaactgcttctttcctattaatatgttgcattagcctta

SEQ ID NO: 167 - DNA, 305 bp, Glycine max
  UNSURE (1)..(305): unsure at all n locations
  Clone ID: PAT_MRT3847_14659C.1
  unsure (1)..(305): unsure at all n locations
ggtttaataaattatgggccttggttccaaanataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggttttaaaggatcaaagttaacgtacgggggaatggaaggaaatagtttttttatagggccacctaaattaaattaatgggcggtggtttaacaaggtggggatggggaaaaccttggggttaccaaatttaatggcttggaagaaaatccccttttggcaagttgggg

SEQ ID NO: 168 - DNA, 213 bp, Glycine max
  Clone ID: PAT_MRT3847_14773C.1
accacgcgtgcggccacgcgtacgctcacacctaactatgtattacggagcctcagggcagaatggtgtgaagccaatggcatatagccaccaaaacgacctaacgattcacaacctaataaaataacatcaagctactcttctggttagcaaaataagattgaaaggcttctacaaaagctcacatgagtgagtactgaagaccagagatca

SEQ ID NO: 169 - DNA, 268 bp, Glycine max
  Clone ID: PAT_MRT3847_14878C.1
ggctcgagcgcaactcagatggccttggatgcctgaatgtggacgacactaaagcagcccagccatgcacgcaccattttaaaagccaacacagaaagcacagaaccaccacagtggtgccttcctctgaacgataaattcatgggattctgaaactagtgatacatttttttgcatgaaggcagcttgttgaggaatgcaattagtgtattggaagatctacgtcaacatgtcttatgtaagcaacggtggaaggcaggcttccatt

SEQ ID NO: 170 - DNA, 636 bp, Glycine max
  UNSURE (1)..(636): unsure at all n locations
  Clone ID: PAT_MRT3847_1499C.1
  unsure (1)..(636): unsure at all n locations
tcgcatgccaccgccgtaccgtaagcctgtgnattgcctctagaagcggcgcggccctctttccttttttttttttttttttttttttttttttttttttttttcaaaaaaaaaaaaacttcagggcccttaataaaataggcattttggaaaacccttgaaaaaagggagggacaaactaaaccggcccagtccttccacatttcataacaaacttgagggcctaaaatcccagtcccaaagagattttaccaacaaaccccttttcctttaaaaaaaatttgggggaaaagttcatttttaattaccagaaaaatatttttactggccatccggtttcggggctgcttttttaatttaatctgctccatcgccctgcatggcaaaggcccaaagggggaggttatcacaaaggagttgcatgaccaaagggctatccttgaatgactcctctcccagggtatccaattcagcaatagcttcatcaaaaccctgttttgcaaggttgcaggcccaatccggaaaattaaggatttcgtagtaaaatccaaaaaagttaaaagcagggccaaccctatttggatgagtagggaggcagttcggcattccaaatgtcctgtgcggttttttatgcaa

SEQ ID NO: 171 - DNA, 494 bp, Glycine max
  UNSURE (1)..(494): unsure at all n locations
  Clone ID: PAT_MRT3847_15347C.1
  unsure (1)..(494): unsure at all n locations
aagaccgccagtatgcattagccgagatttgatcaatactgacagttgtgtgtgaaactcatagtttgcctctggcacaaacatgggttccatgtaagcatcggagtgtcttagcacatggcggtggtcataagaaaagttgctcaagttttgatggatgttgcatggggcaagtttgcatgtctataactgaggtagcattctatgtaatagatgctcatacatggggttttcatgaggcctgtgttgagcatcacttacaacaaggtcaaggagttgctgggagggcatttttgtcccacaacatgtgcttctgtggaaacatcgcccaattctgcaaaactgaatatcccttagtacattatgcactcatgtttggtttaaccagctgttttgcagtntgcttacaaagctctcataccggaaaagatgattatgtgctagagttttttctgcctcctgggatcacagactttaatgaacaaatagattgt

SEQ ID NO: 172 - DNA, 1059 bp, Glycine max
  Clone ID: PAT_MRT3847_15380C.1
aggagagttgtctctcttctcattaatagaaatcagcatggcatatctgatagatcaatcagctatgccaatgatttgaaacataaccaaatttggctttccgaaatagaagaggaagccaaaaaggggatacctcttgatatgtacctcattttaggagttgaacattctgtttcgtcatctgaaatcaagaaggcctatcacaaagctgcacttagacatcatccagacaaggctggccaatctttggcaagaagtgacaatggagatgatcagatatggaaggatattgttgaagaaataagcaaagatgccgataggcttttcaaaataattggagaggcatatgcagtcctgtcggacactgccaagcgttcacagtatgattctgaagaagaaatgagaaattcccaaaagaaacgccatggaaacagcatcaatagaaataatgtcattgatcaaactgacaataggagacactggaaagaggtttgaagatcaagtggtaactcatcttttaaagattctgaagctggcaggtcaagtaggcaataagaaaatctgtgttgaattttagtcagtgatgtgttttatcttatgcatttgagaccaatggcaatgcagttgaacaagctcggttcatcggttcttgggatttctttgggatattggaagaatttttcttttgacatgcgaaagagatcattggttgcattcgattgttgttttgttttttgtttttttttctactgaccattaatcagcttggatgacagcaagcaagtgaaaaggaagtttgaaattttgcattctgtctggtttgtcaggtgtgtaaagattttttttttttctttcttgaatgtgtgtatagatctatactatcagaaagttgataccgcatttgcatttgtgtaataccacatgaaaaattttgatgaccggaacatgtgctgccaaagatagagtacatttacattttagcaggaacaacataatttatatctatataaaaattatctagccgtcaaaaacccgaaacagaccaccagagcggggatc

SEQ ID NO: 173 - DNA, 2319 bp, Glycine max
  Clone ID: PAT_MRT3847_15714C.1
cggaattcccgggatcgacccacgcgtccgctagttcgtgctactattccactccacacaaataaaccctataaattctcactctccctcttttctctctcacactaataccaaactctctgaaaacaaaacctcatcatcatctaactcattcacatttttctctatcatctcgtttctactgtttcctcatggacactaacattggatctctatccctcgacgcgtgcaagcctgctaacaacgacgtcggttgtcccccgaacggagccgtttcagcaatcaaaccctccgtccccgcaaccacgatgacgtcctcggatgccacgctaggacgccacctagcacggagactcgtgcaggtgggggtgacagacgtcttctccgtgccgggtgactttaacctcaccctcctcgaccacctcatcgcggagccgcagttgaaaaacataggatgttgtaacgaactcaatgccgggtacgctgctgacggctacgcgcggtgcaggggcgtgggcgcgtgtgtcgtcacgtttactgttggaggactgagtgtaatcaacgcgattgcgggcgcgtacagcgagaatcttccgctgatctgtattgtgggtgggcccaatacgaacgattttggtaccaacagaatcttgcatcacaccattggattgtccgatttcagccaggagctcaggtgcttccaaacagttacatgctatcaggctgtggtgaataacatagaagatgctcatgaattgattgatactgcaatctcaacctgcctgaaagaaagcaagcctgtgtacataagcataagttgtaacttgcctggcattcctcaccccacattcagtcgcgagccggttccattttctctgtctccaagattgagtaacaagatggggttggaggctgcagtggaagcagcagcagagttcctaaacaaggcagtgaagcctgtaatggttggaggtcctaaactaagggtggctaatgcatgtgatgcatttgttgagcttgctgatgcatgtggctatccatttgctgtgatgccatcagccaagggactagtcccggagcacaaaccccacttcattggcacattctggggtgctgtgagcaccgcattctgtgctgaaatcgtcgaatctgctgatgcatacttgtttgctggccccattttcaatgactacagctctgttgggtactcactcctcctcaagaaggagaaggccatcatcgtgcagccggagcgcgttgtgatctccaatggacccgcattcgggtgtgtcctcatgaaggacttcctcagggaactcgcaaagcgtctcaagcacaacaacactgcttatgaaaattactcaaggatttttgtccctgagggaaagcctgtgaaagctgaacccagagagcctttgagggttaatgttctgtttaagcatatacaagatatgctgtctggcgaaaccgcggtgattgctgagacaggggactcttggtttaactgccagaagctgaagttgccaaaggggtgtgggtatgagttccaaatgcaatatggttcaattggttggtctgttggtgctacacttggttatgctcaggcggttcctgagaagcgagtgatttcttgcattggtgatggaagctttcaggtgacagctcaggatgtgtccacaatgctgcgaaatgagcagaagaccatcatcttcctgataaacaatggtggatacaccattgaagttgaaattcatgatgggccatacaatgtgattaagaactggaactacactggcttggttgatgcaatccacaatggtgaaggaaaatgctggaccactaaggttacatgtgaagaggagcttgttgaggcaattcagacagcaacaggtgacaagaaagattgcttgtgcttcattgaagtgattgttcacaaggatgacacaagcaaagaattgcttgaatggggctcaagggtttgtgctgctaacggtcgtcctcccaatcctcagtgaatttcaaacacttaattgagccattacaaatttgctggagtttctccctatttcaaacacttactcttgctgatagaaaaaagaaaatagaacaatttaatttcatgttttatttaacaaagacaataactaccatgagatttacttatatttatttttaaataaaattgagttttttaattagctttcgtacgagagaaattttccttttggaaatgctttttcagtttatctaaagtgttcaaatgagtgcactagattttagtaaatttctcatgggacaaaagttatcatcaatttttcc

SEQ ID NO: 174 - DNA, 229 bp, Glycine max
  Clone ID: PAT_MRT3847_15851C.1
cacacaactactacaagtacttccttaccatcaaaaccaacaacaactatggcaagttatcaaaagcactacgatgatcagggtcgcaaggttgacgagtatggcaaccctgagaagcacacccgcgaatacgggaaccctgttcatgctggtagtggcacctatgttgcccccataactggtgctggtggtttcagaggtgacatttataagccccctgattcccccc

SEQ ID NO: 175 - DNA, 721 bp, Glycine max
  Clone ID: PAT_MRT3847_15920C.1
gtaaattaatttctcgtatcgaaaatcatttccaccaccacaatttttttttatttccgtttactaaagattagtaagatcacaacactaacacagattttgattcgattcgattcgattcagtcgaggttttaagcagcagcaagatgtctgggcgtggaaagggaggaaagggattgggaaaaggaggagcaaaacgacatcgtaaggtgctccgcgacaacattcagggaattacgaagccagcgattcgtcgtttggctcgcaggggtggcgtgaagcgtatcagcggtttgatctacgaggagactcgcggtgttctcaagatcttcttggagaatgtcatccgtgacgccgttacttacacggagcacgctaggaggaagaccgttacggctatggacgttgtttatgcgcttaagaggcagggaaggaccctctacggatttggtggttagggtttttgcttgattttcctcgccagggaaaagtcttgctgtcaagaaaaacaaacgaggcatggattggggtagtttttttttattttttatggtggtgtttgtagtgaatggggaaaattaggagcaattttatgcttacttgttggtgtcaattatgtgatgtaactactccgttgaaatgtagaattattttggcttttaaaaatcgtttcgtaaatcaatttatagtttctatttaagttaaaaaaaaaaaaaaaaaa

SEQ ID NO: 176 - DNA, 1287 bp, Glycine max
  Clone ID: PAT_MRT3847_16358C.1
cggaattctagctccgatctcacgaaattgctcgaatcttagggctgaagcaatggatgtcgattcctcgatggtgccggagaccgatcacgatcccgccgtacagaaccacgccgccgatgacccggcgccggacgcggcggagggagaacagctaggggagccgccgtcgtccggaggcggatctccggagcagacgcagccggcgcctgcttcggcgccgcagagtccggtggtcggaccgaggctggcgcctagttacacagtggtgaatgcaattttggagaagaaggaggacggaccggggccgaggtgcggccacacgctaacggcggtggcggcggtcggagaggaggggaccccagggtacattggtccgaggttgattttgttcggcggtgccactgctcttgaaggcaattccgcggcgacagggactccttcatctgctggaaatgctggcatacgtttagcttgtgccacagctgatgtccattggtatgcacgcgtccgtaataaatggtctaggataactcccattggcgagcctccaaccccaagggctgcacatgtggcaactgctgtgggtaccatggtagttattcagggtggcattggccctgctggtttgtctgcagaggaccttcatgttcttgatctcacacagcaacggccacgatggcatagagttggtgttcctggccctggaccgggaccacgctatggacatgttatggctttggtggggcagaggtatctcatggcaatcggaggcaatgatggaaagagacctttggctgatgtatgggccttggacacagccgccaagccttatgaatggcgcaagttggagccagaaggagagggtccacctccatgcatgtatgcaactgccagtgcacgctctgatgggcttcttctgctttgtggagggagggatgccaatagtgttccattgtcaagtgcatatggacttgctaagcatagagatggtcgttgggaatgggccattgcccctggtgtctcgccatctccaagatatcagcatgcagcggtatttgttaatgcaaggctccatgtgtctggtggggcccttggaggaggacggatggttgaagattcatcgagtgttgcagtgttggacactgctgctggtgtttggtgtgataccaaatctgttgttaccagtccaagaacgggtagatacagcgctgatgcagcaggtggagatgctgcagttgagttgacacggcgttgtaggcatgcggctgctgctattggcgactt

SEQ ID NO: 177 - DNA, 239 bp, Glycine max
  Clone ID: PAT_MRT3847_16403C.1
ccctgttcatgctcctagtgtcacctatgtagccaccagaactgctgctcgtggttacagtgatgacattaataagcaacatgataccaccaatgcctacggcgtagacactgttagaagcatttctatggtggcttcgatggtgacactaataaacctcatggaattactggtgggtataatgatgactccatagaccttatgggactcccggtgtcttttgtataaaccccgatagg

SEQ ID NO: 178 - DNA, 500 bp, Glycine max
  Clone ID: PAT_MRT3847_16414C.1
ccacgcgtccgaattcttccaaaagaaactcctgataaatataaaaaggagggaaaaagaaaaacacttgcagcggcatccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttggtgcgttcttggggagacgaagggactaaggcgcagtgagcggacaagaatcagcatggatccgagcgcg

SEQ ID NO: 179 - DNA, 2155 bp, Glycine max
  Clone ID: PAT_MRT3847_16575C.1
taccggtcgcgaattcccggctcgacccacgcgtccgcaaagacacattctttcagcctcccttcaacacccttttggcccttcattcttccaagtctcaaatcgaagctcgaagacctgcgaagaacaaagggttgtttaaattctgtgtggttgttgttggaggttgaaatacaagttgccgcctcaagtgtgtgttaatcttaaatttcacaagcaagttgtatttttggagtattgtattatatgaccaaatattttagtgttttaggactagatattttgcttctggtggcaatttttctcttctccttctggttctcatcttttgtgttcttctttgtttctcacctttctgaggatttttccatcttagttcctggaggcaccaggaacctgaccaaataaataaaccttttttttcttctaatttttctgaagtttcattttttagtccaatggcaacttggatattatcagaatgtggcttgaagcctcttgctccagtaattcctagacctagaactggggctgctttgtccagcacctcaagggttgaatttttggacacaaacaaggtagtggcaggtcctaagtttcaacctttgaggtgcaacctcagggagaggaattgggggctgaaagtgagtgcccctttgagggttgcttccattgaagaggagcaaaagagtgttgatttaaccaatgggactaatggggttgagcatgagaagcttccagaatttgaccctggtgctccgccaccattcaacttggctgatattagagcagccattccaaagcattgctgggtgaaggacccttggaggtccatgagctatgtggtgagggatgtgattgctgtctttggtttggctgctgctgctgcgtatctcaataattggttggtttggcctctctattgggctgctcaaggcactatgttctgggctctgtttgttcttggtcatgattgtggtcatggaagcttttcaaacaactccaaattgaacagtgttgttggacatctgctgcattcttcaattctagtgccatatcatggatggagaatcagtcataggactcatcaccaacatcatggtcatgctgaaaatgatgaatcatggcatccgttgcctgaaaaattgttcagaagcttggacactgtaactcgtatgttaagattcacagcaccttttccacttcttgcatttcctgtgtacctttttagtaggagtcctgggaagactggttctcactttgaccccagcagtgacttgttcgttcccaatgaaagaaaagatgttattacttccacagcttgttgggctgctatgttgggattgcttgttggattggggtttgtaatgggtccaattcaacttcttaagctttatggtgttccctatgttatattcgttatgtggttggatttggtgacttatttgcaccatcatggccatgaagacaaattaccttggtaccgtggaaaggaatggagctacctcaggggtggtctaactactcttgatcgtgattatggatggatcaataacattcaccatgacattggcactcatgtcattcatcacctatttcctcaaattccacactatcacttagttgaggctactgaggctgctaagccagtgtttggaaaatattatagagaaccaaagaaatcagcagcacctcttccttttcaccttattggggaaataataaggagcttcaagactgaccattttgttagtgacacgggggatgttgtgtactatcaaaccgactctaagattaatggctcttccaaattagagtgaatattaaaattcttttctatatagacaagagaggcttatacacaattcttattgctttaaagattgtcttgagtttctccgaaagttactgcacttacttggagttgaatccttcattaataaagggatggatggatcatataatttcaattgtaactgcatgatagaatgtttaggttatatgtagttttatctttcttgaatagtgaattcctcaatataaattgattatattgaagtgataccttgaggcatgatcaaattgtcaatgtgtttgatcaaaactgaaagatctcgattaaatagaaatttaaaatagattttgttttgtagcc

SEQ ID NO: 180 - DNA, 2182 bp, Glycine max
  Clone ID: PAT_MRT3847_16577C.1
ggctcgagcgaagataccttctttcagcctcccttcaacacccttttggccctttattcttcaaagtctcaaagcaaagctcgaagacctgagaagaacaaagggttgattaaattctgtgtggttgttgttggaggttgaaacacaagttgccaccccaagtgtgtgttaatcttaaatttcacaagcaagttgcttttttggagtattatattgtatgaccaaatatttttgtgttttaggactagatattttgcttctggtggcaatttttctcttctccttctggttctcatcctttgtgttcttctttgtctctcatctgtctgaggatttttccatcttagttcctggaggcaccaggaacctgacccaataaacaaacccttttttttctttctaatttttctaaagtttcattttttaatccaatggcaacttgggtattatcagaatgtagcttgaagcctcttgctccagtaatccctagacctagaactggggcagttttgtccagcacctcaaaggttggatttttggagacaaacaaggtattggaaggttctaagtttcaacctttgaggtgtaaccttagggagaggaattgggggttaaaagtgagtgtccctttgaggattgcttccattgaagaggaggagcaaaagagtgtcgatgtaatcaatgggagtaatggggttgagcatgagaagcttccagaatttgaccctggtgctccaccaccattcaacttagctgatattagagcagcaattccaaagcattgctgggtgaaggaccctttgaagtccatgagctatgtggtgagggatgtcattgctgtctttggtttggcttctgctgctgcttatctcaataattggttggtttggcctctctattgggctgctcaaggcactatgttctgggctctgtttgttcttggtcatgattgtggtcatgggagcttttcaaacaaccccaaattgaacagtgttgttgggcatctgctgcattcttcaattctagtgccatatcatggatggagaatcagtcataggactcatcaccaacatcatggtcatgttgaaaatgatgaatcatggcatccgttgcctgaaaaattgttcagaagcttggacactgtaacacgtatgttaagattcacagcaccttttccacttcttgcatatcccgtgtacctttggggtaggagtcctggcaagactggttctcactttgaccctagcagtgacttgttcgttcccaatgaaagaaaagatgttattacttccacagcttgttgggctgctatgttgggattgcttgttggattggggtttgtaatgggtccaattcaacttcttaagctttatggtgttccctatgttatattcgtcatgtggttggatttggtgacttatttgcaccatcatggccatgaagacaaattgccttggtatcgtggaaaggaatggagctaccttaggggtggtctaactactcttgatcgtgattatggattgatcaataacattcaccatgacattggaactcatgtcattcatcacctatttcctcaaattccacactatcacttagttgaggctactgaggcagctaagccagtgtttggaaaatattatagagaaccaaagaaatcatctcctcttccttttcaccttattggggaattaataaagagcttcaagactgaccattttgttagtgacaagggggatgttgtgtactatcaaactgactctgagattaatggctcgtccaaatcagagtgaagattaaaattcttttttatatagacaagagagacttatacacaattcttattgctctaaagattgtcttgagtttcttacttagagttgaatccgtcattaataaagggatagatggacggatcatataatttcaattgtaactacatgatataatgtttaggttatatgtagtttatcattcttgaacagtgaatcctctgtataaattgattatattgaagtggtaccttgagtcatgatcaaattgttaatgtatttgatcagaactgaaagacctcgattaaatagtaatttaaaataaattgttttatagaatgttgcggtgttttcttaccagttaccatcccctatttaatttatatactccctattttattcttcaaaaa

SEQ ID NO: 181 - DNA, 1662 bp, Glycine max
  Clone ID: PAT_MRT3847_16889C.1
tataatagcagtttaagaaattgaattggacaaagagcgccgagtaattaatgtgaaaggaatgaatgatttttgtattgcaaaataaattagtgtacttcacatgacggattttcacgagcaacaataagcatagagagaaatttggcattgcagtgcatcatcgcattgattgagttggaagatgggtagcaaaggcaaacgcaaagagcaagaatcaataataacgagggttatggctcacggaggtagatacgtgcaatacaacgtgtacggaaacttgttcgaggtctcctccaagtatgtccctcccattcgccctgtcggtagaggcgcatacggcatcgtttgtgctgctgttaattgcgatacgcacgaggaagttgccataaagaagattggtaacgcctttgacaacatcattgacgctaaacgaactttgagggaaatcaagctccttcgccacatggaccatgaaaatataattgccattagggatatcatacgacctcccagaaaggatgccttcaatgatgtttacattgtttatgaattgatggacactgatcttcatcagattattcgttctgaccaacctcttaacgatgaccactgtcagtactttttatatcagctgttacgggggctgaaatatgtgcattctgctaatatcttgcaccgtgatcttaagcccagtaatttgcttctcaattcaaactgtgaccttaaaattgcggactttggtctggcaaggacaacatctgaaacggatttcatgacggagtatgttgtcacacgatggtaccgagccccagaattgcttcttaattgttcagagtacacctccgcgattgatgtttggtctgttggttgcatatttggtgaaattatgaccagagaacccttgtttcctggaaaagattatgttcatcaactgaggcttataacagagttattaggttcacctgatgatgccagccttggatttctccgaagtggaaatgccaaaagatatgttcgacagcttccacaatataggaagcaaaatttctccgctagattcccaaatatgtctcctgaggcattggatctactagaaaagatgcttatctttgatcccaacaaacgcattacagttgatgaagcactatgtcatccatatctttcatcacttcatgacatcaatgatgaaccggttggtcctgggcaattcaattttgattttgagcagccaacatgcactgaagagcacatcaaggagctcatctggagggaatcggtgaagtacaatccagatccacccagtcagtaattctttcttgaatgatgattcccttattactcttgggtgtagacatccagagagagataagtgattgatatgattagtaatgtattgtgacaaaaagagagatattgagaaatgagaggtgtgtaagggtggtgagagaatccttgttcttctttcttattagtataaatgtatcaagataaacttctttcaccttaaatacagtgcctgttcattattcagataagttgctgcacacagaaagtcagaaactttgttcttgtaatctagtcctaagcatttagaatacaaaggaaaatgaatattcattaggaatccaattgaatattgctagcattcagacaagttat

SEQ ID NO: 182 - DNA, 448 bp, Glycine max
  UNSURE (1)..(448): unsure at all n locations
  Clone ID: PAT_MRT3847_16934C.1
  unsure (1)..(448): unsure at all n locations
ccacgcgtccgcccacgcgtccgcggacgcgtgggcggacgcgtgggcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaggagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcangtgattttgtcgtgggagcaccaaaagcagaaagaactggnntttttcttctctctc

SEQ ID NO: 183 - DNA, 2206 bp, Glycine max
  Clone ID: PAT_MRT3847_17090C.1
tataaaacaaaaaaaggttgacagaagagagatacagtttttacagaagttaggagagaaagagagagagtacagatctgtttgaccaaaacctcttacaaacacatacaaatcagacagaagactaaaagagtgaagagaacaaacagagcaatggaaggaggaggagctgctccgccggccgacaccgtgatgtccgacgcggcgcctccgccgcagcaagcgatggctatggggatcgagaatattccggcgacgctgagccacggtggcaggttcatccaatacaacatattcggaaacatattcgaagtcaccgccaaatacaagccacccatcatgcccatcggaaaaggcgcatacggcatcgtttgctcggctttgaactcggagacgaatgagcacgttgccatcaagaagattgcgaatgcatttgataacaagattgatgcaaagaggaccctccgtgaaatcaagctgcttcgtcacatggatcatgaaaacgtggttgcaatcagggatatagtgtctgcttcttcttcttctctattcctatttttccataacaacaccgccgattcattgcatcaccgtcactaacttcatcatcataaaacattttcatataaataaatatattcattcattcattcattcacataataatcattaactatcattctctcatatcactctcacttactaaataagacagacaaaagaaagaaagaagagaacaacagagcaatggaaggaggaggagctgctccgccggccgacaccgtgatgtccgacgcggcgccaccgccgcagcagcctccggtggcgatggggatcgagaatattccggcgacgctgagccacggtggcaggttcatccaatacaacatattcggcaacatattcgaagtcaccgccaaatacaagccacccatcatgcccatcggaaaaggcgcatacggcatcgtttgctcggttttgaactcggagacgaatgagcacgttgccatcaagaagattgcgaatgcatttgacaacaagattgatgcaaagaggaccctccgtgaaatcaagctgcttcgtcacatggatcatgaaaacgttgttgcaatcagggatatagtgccaccacctcaaagggagatattcaatgatgtttacattgcatatgagttgatggacactgaccttcaccaaatcattcgttcaaatcaagcattatcagaggagcactgtcagtattttctgtatcaaatcctccgtgggttgaagtacatacattctgctaatgttctgcatagggacttaaaaccgagcaaccttctcctaaatgccaactgcgacttaaaaatttgtgattttggactggctcgtgtcacctctgaaactgattttatgactgaatatgttgttacgagatggtaccgtgcaccggagcttctgttgaactcttctgactacactgcagcaattgatgtatggtctgttggttgtattttcatggaactgatggatcgaaagcctttgtttcctggcagagatcacgtgcatcagttgcgtctacttatggagctgattggcaccccatcagaggctgatttggggtttctgaatgaaaatgctaagagatacattaggcaactgcccctttaccgccgtcaatctttccaggaaaagtttccacatgtccatcctgaagctatagatcttgtagaaaaaatgttaacttttgatcctagaaaaaggattactgttgaagatgcactggcgcacccatacttgacatctctgcatgacatcagtgatgaacctgtgtgcttgactcccttcagctttgactttgaacaacatgctttgactgaggaacagatgaaagaactgatataccgagaggctctagcatttaacctcgagtatcagcagtagtgatagacttgttatcattggatttggatcgtgtgatgtctgtgtccatagatcaagggatttcattgtgtatatatatctatcatctgaaaccaggtgatcttggagttgaattatttccatcagaggcatgattggtagactgaaacaatcataaggtatttgtattggctttttgcttcatattattgtccaattcattggctgcagccaactgataaatcttttcttggtctcaaatttctgcttttatggatttgaagttccctctctctgaacc

SEQ ID NO: 184 - DNA, 1804 bp, Glycine max
  Clone ID: PAT_MRT3847_17186C.1
gagagagagagagagagagatctatctatctatcaagatggcgttgttggttgagaaaacaagcagtggaagggagtacaaggtgaaggacatgacgcaagccgatttcggaagattggaaatcgagctggcggaggttgaaatgcccggcctcatgtcctcccgcaccgagttcggcccctctcaacccttcaagggcgctaggatcaccggctccctccacatgaccatccaaaccgccgtcctcatcgagaccctcaccgccctcggcgccgaggtccgctggtgctcctgcaacatcttctccacccaggaccatgccgccgccgccatcgcccgcgacagcgcctccgtcttcgcctggaagggtgagaccctccaggaatactggtggtgcaccgagcgcgccctcgactggggccccggcggcggccccgatctcatcgtcgacgacggcggcgacaccactcttctcattcacgagggcgtcaaggccgaggagatctttgagaagaccggccagttccccgacccggcttcctccgacaatgcggagttccagatcgtgctgagcatcatcagggatggcttgaagaccgatcccaagaggtaccacaagatgaaggacagaatcgtcggtgtctccgaagaaaccaccaccggtgtcaagaggctctaccagatgcaggccaatggctccctcttgttccctgccatcaacgtcaatgactcggtcaccaagagcaagtttgataacttgtatggatgccgtcactcgcttcccgatggactgatgagagccactgatgtgatgattgccggaaaggtagctgttgtgtgtggctacggagacgttggcaagggttgtgcttcggccatgaagcaagccggggctcgtgtcattgtcaccgagattgatcccatttgtgcccttcaggctctaatggagggtcttcaggttctcaccctggaagatgttgtctccgaggccgacatcttcgtcaccaccacagggaacaaggacattatcatgcttgaccacatgaagaagatgaagaacaatgccatcgtgtgcaacattggccacttcgacaacgaaatcgacatgctggggcttgagacctgccctggtgtgaagcgcatcaacatcaagcctcaaacagacagatgggttttccccgataccaagagggggatcatcgtgttggcagagggtcgtttgatgaacttggggtgtgccacgggacaccccagctttgtgatgtcgtgctccttcaccaaccaggtcattgctcagcttgaattgtggaaagagaagggttctgggaagtatgagaagaaggtgtatgtgttgcccaagcaccttgacgagaaagtggcttctctccaccttggccagcttggagctaggctcaccaagctttccaaagaccaagctgattacatcagtgtgcctgttgagggtccatacaagcctgctcactacaggtactgatccatcctattgggggagaataaacctaaactatcctatcaattcccgaggcgtcattgttacactttcctttttggatttttcccattacaatttacatttgtggtagcataggagcttcttttttctttttttagtaggatcacaatgccattgggctgaaggttaagaccaaaattactcattgctttcaataaggctttggctgcggctgtctgggttatgatttagcagctttcatattaatttgttcctttccatctttgatatccgaaacataataagcaaaaaaatattgttttttaaaaa

SEQ ID NO: 185 - DNA, 1433 bp, Glycine max
  Clone ID: PAT_MRT3847_17304C.1
ctacactttcgagttcgaactaaagaaaaaacagtaaagaaagaagaagaaaaaaaaaagatggtttcgtcagtttcgtgggtgagaggcaagtgcgtcggtaagggcgcgtttggggttgtcaacgtggcggtttcgaaaagagataatcgcgttttcgcggtgaagtccgtggattgcggaagggggctttctggtcaggtggaggcgttggagaacgagattgggattctgaaacgagttacctcgccgcacgtggtggcttatatcggcgacgatgtcacgtgcgagggaacggcgtcgttcaggaaccttcatttggagtacatgccaggtggcaccgtcgctgatttggaccgcgctgacgtggacgagcggttagtgaggcgctacgcgtggtgcctcgcgaccgcgctgcgtgacgtccacgcgcaaggcttcgtccactgcgacgtgaaagggaggaacgtgcttctctccggcgacggcgaaatggcgaagctcgccgacttcggcgcggcggtggaaattgaatcctctccggcgatgttgctgttcccgcgggggagtccgatgtggatggcgcccgaggtggtgcgccgggagcggcaggggccggagtccgacgtgtggtcgctcggatgcacggtgatcgagattgccatcgggaaaccggcgtgggaggaccgcggcgtcgacacgctgagtcgaatcggttactcggacgagttgccggaatttccaatccagttgtcggagctagggaaggattttctcgagaagtgtcttagaagagaaccgagtgaacggtggagttgcgatcagttgcttcagcatccatatttgcttccctactacgcccttgttgaatcgtcgcctcggtgcgttctcgaccgggttgactcggagttgaattccgagtcagattataacgaccgtgatcatcaagaagacgtgtttataaaatttaccaacagcgaagaaaaatcagttattaaaaatagaattagtaaatttgcgacagagtcgagggtaaattgggaaacgcagggttggatagtggtgagggaaattgagtccaacggaaaaccaacgacaacgggaacagaaacagaaatagaggaaggagcatgtacgtgtgagtgtgatggtgttggttcgagcaaagaaggggtaaattgggagtttcacaatgtggcggggactggtatggaatattcggattctgtaggggtaaatcggggaataggaaagttgggtgggagtaacaccgctggagggggtggtggttggagctgtcggtatgggtgtgggtgggaaaagttgggtaggaatagaggaatattcagcatttacagcttgtattgtaaaaatttcatgttgtgtaatttaatattcttaatgtatatcaatatatattatgcttttggatt

SEQ ID NO: 186 - DNA, 560 bp, Glycine max
  Clone ID: PAT_MRT3847_17306C.1
cgtagctcgtttttcggctcgagaacactttcgagttcgaactaagaaaaaaaaaaaggaaaacaaaatggtttcgtgggtgagaggcaagtgcgtcggtaacggcgcgtttggggttgtgaacgtggcgatttcgaaaagagataatcgcgttttcgcggtgaagtccgtggattgtggaagggggctttctggtcatcaggtggaggcgttggagaacgagattgggattctgaagcgggtggcttcgccgcacgtggtggcttatctcggagacgatgtcacgtgcgaaggaacggcgtcgttcaggaatcttcatctggagtacatgccaggtggcaccgtcgctgacttggaccgcgctgacgtggacgagcggttagtgaggcgcttcgcgtggtgcctcgtgtccgcgctgcgtgacgttcacgcgcaaggcttcgtccactgcgacgtgaaagggaggaacgtgcttctctccggcgacggcgaaatcgtgaagctcgccgattttggcacggcggtggaaattgaatcctcgccggcggagatgttattgt

SEQ ID NO: 187 - DNA, 2593 bp, Glycine max
  Clone ID: PAT_MRT3847_17614C.1
atattatatgcttcattgtttggtcagaaatttttgcagacccaaattaatgttcacctttggtcaagcaacacccaccaaaaaacactttgatttcccattgccgcatattttgtaaaggcaatcttattcttatggtaaaagggaaaaaaaaaatattcattagtcggtaaggggaaagtgagaagcacaaaattgaggcatggttatatagaagtctcagttttagtttaataggcacatcacactcacatctattgaagttcataattccacctcttgtgttttttccaaggctttgccaacaacaattctttggcttagagttatagagcatggtggggagcattatgggagtggttcacaatgcatacacaaatggaagtgttggtgtacaaaattgtaatggggtggaggagaagcttgattgtttgagaaggcttattgggaagggtgatggtgaccctttgagaattgtgagtgttggagctggtgcttggggaagtgtttttgcagctttgctacaagacacttatggccaatttagggataagatacagatcaggatatggagaagggcaggaagggcagtggatagagccactgctgagcatctctttgaggttatcaactcaagggaggatgtgttgaggaggttgatccggcgttgcgcttatctcaaatatgttgaggcaaggcttggtgataggaccctctttgctgatgagattctcaaagatggtttttgcttgaacatgattgatacaccactttgtcctttgaaggttgtcacaaacttgcaagaagctgtttgggatgctgatattgtggtcaatggcttgccttcaacagaaacaagagagatctttgaagagattagtaagtattggaaggagagaatcacagtgcctataattatctctttgtcaaagggtatagaggctgcattggagcctgttccacatattataactcccacaaagatgattaaccaagcaactagagtgcctatggagaacatactctatcttggtggtccaaatattgcctcagaaatctacaacaaggagtatgccaatgcaagaatctgtggagctgagaaatggcggaaagctctggcaaagtttttacgccaaccacactttattgtctgggataacagtgacctcgtcacccatgagatcatgggtggcctgaaaaatgtctatgcaattggagccggaatggtagcagcccttaccaatgagagtgctactagcaaatctgtctactttgcacactgcacatcagagatgatatttatcactcatttgttggctgaagagcctgagaaacttgcagggccactattggctgacacttatgtgactttactaaaaggtcgtaacgcatggtatggtcagatgttagctaagggtgaattaagcccagacatgggtgacagcatcagtggcaaaggaatgattcagggtgtctctgcagtggaggcattctttgaacttttgagccattcaagcctgaatgtgttgcacccagaagaaaacaaaccggttgctcctgttgaactctgccccatcctgaagacactgtataaaatattgatatccagggaacagtcatcagaagctattctccaagctcttagggatgaaaatctgaatgatccccgtgaacgcattgagattgcacaaagccatgctttctacatgccttcacttcttggacaaccttgaacgcattgagattgcacaaagccatattatctacaattaattattttattatttcataatagacgtgggataaatttttccactcctgtattgttgaaattaagaagtttatttgtgaaacaaacaaacacactgaactgactcggaaaaaaaattgacatatgcagaggccatcagttttagtacaaaattgagtaaaaataggaaatttaagttttttggatctttacaaaattttgatatcaaggggccaggtcatctccaggatattttgaaagccttgagggatgaaaatttgaatgatcctcgtgaacgaattgagattgcccaaagccatgttttctaccagccttccctttttggacaaccctgattgttttctcattggcaaaagccaaatgtggatgcaactatatatggaagcatttgtcaactcaaagagaatatttaaatgagcatgaatgtattgttttgtgatggattttgtattacattgttgtatgtatatatgtcaaaatataagccactaagcaattggactaataactcccaaaaacactcactacagtactgcctgatggacactacaacattgtggccaaaaatgagaggaacactgtttttggaagaaaaaaaaatcattaatggaatggaataagtgtggaagggatacaaagggagtggaaggaatgaaacaaagctagctttattcttgcttggaagattgatgagggattaggaatggaactaaattattttgtatggaagttaaattataaagatcttgaatgaaatgtaatatgcttaattatgaacaaaatttattcctccaattccacctcaattttgaagaacaaaaa

SEQ ID NO: 188 - DNA, 482 bp, Glycine max
  UNSURE (1)..(482): unsure at all n locations
  Clone ID: PAT_MRT3847_17878C.1
  unsure (1)..(482): unsure at all n locations
gacaatgtggtttggtgaaagtgaggcaaatgttcgcgagatatttgacaaggctcggcagtcagctccatgtgtgcttttcttcgacgaacttgactctattgcaactcaacgaggcagttctgtaggggacgctggtggtgctgccgatagggtgttgaaccaactcttaacagaaatggatggtatgacagctaagaaaacagttttcatcataggggcaacaaacagaccagacattatagaccctgcattgctcaggcccggacgtctggatcaattgatttacatccctttaccggatgaaagttcacgtcttcaaatcttcaaggcatgcttgaggaagtcaccaatctcaaaggatgttgacctatcagctcttgcccgttttactcatggattcagtggtgcagacattacagaaatttgtcaacgagcgtgcaaatatgccattanggaagatattgaaaagggtattgaga

SEQ ID NO: 189 - DNA, 162 bp, Glycine max
  Clone ID: PAT_MRT3847_18209C.1
ggtatgcagttgttgtggttctcatcatttgcatttacatatcaccatttgcctagtcatggggtcgccaaggttggttggtgcctcatgagatcgttcacttggcaatccgtacggctgctcaaagtatagatgtctcggtgaacatggttttcactttct

SEQ ID NO: 190 - DNA, 928 bp, Glycine max
  Clone ID: PAT_MRT3847_1894C.1
cataattccatcgtctaaatttcacacaacaattcaattcatagccagacagagataaacgaaaaattccacttcggagtgtgagctaaataaaagcctcacttattgaaattagctagccggcgataaaaacaagcacagagctaatttcacaaatctaaaacgtgacaaaaaaaaaaaaaactaatgtcatgtgttacagtatttagtatttagtatttacacaaaaataaataaggtttggcatattcacagaaagggaagagattccaaattcttagtcatgattgatcaacaatcaccaaacgtgaagcgagcgttcctgcggaagcgaggaacccttgagtccagcacttctagtctcgtgaaaatcctgtatgaccttgatgagaaaccgcgctttctttgcagcatgacaagttccatccgtgagaagcgaataaagcaaaggcatcaacgaaggctccttagcgagaaccgccacaacctccgctccaacattgacgcaaagcgacaacaaaatcgaagcagagtgctctttcccctcgcgtgacgtggcagatcgcagcatccctacaatcaaccgcaacgccgaaccttgcagtatctcacgcgccccatcaacgttctccgccagcgcggcaagaaccgccaaagattcagtcacaagctcgtccttattcgaagaagctataatgtcaagaagcgccggaacagcaccagcagcgataaccctttgatgattcctaggaagcaaaagtaatccgaaaatagcaaccacagcattctttctcccacaggttgttccttctttaactaactccaccaaagccggaatgacatcagggttttcccctattaacttgcgaaattctttcaccgaagaaagataaaatattgtagcagccgcgacttgacgagcttcaag

SEQ ID NO: 191 - DNA, 2535 bp, Glycine max
  Clone ID: PAT_MRT3847_19228C.1
aagaggataggtcagcgcctcgtcaggtcaattcccgctcttcaacaattgaaaatagttcaccctgccgccccaacccaacatcgtctttctctctccaatatctctaccctaatccaccctttctgaacaaaaataaaaaaataaaaaaaaacccatcgatttcttggacctccatgacttctttgtctacccatcacacctatagccgaaagcaaaaatctctcggcctcctctgcaccaattttctgagtttgtacaacaaagaaggtgtgcgcctggtcggtctcgatgacgcagcttcgcggttaggtgtagaaagacgtcggatctacgacatcgttaatgttttagagagtgtcggtgtgctaaccagaaaagctaagaatcagtatacttggaaaggattttgtgcaattcctgctgccttacaagaacttaaggatgaaggtttgaaggagaatcctggatcatttgatgactccaatgacaatgcaaaagtgtctgatgatgaggaggaggaagaagaaacatttcctaatattaacattgggagtcagagtgagaaggaaaatcctgattacactgctactgtcaaatcctccaagaatgaaaacagaagggaaaaatctctggcattgcttactcagaattttgtcaagctttttgtctgctctaattttgaaatgatctcccttgacgaagctgcaaagttgttgcttggaaatgccaacaatagaacaaaagtcagacgtctatacgatattgcgaatgtgttatcctccatgaacctaatcgagaagacccatacaacaaacacaagaaaaccagcattcaggtggttgggtgtgaggggaaaaacatggggtggatcagttgacttggctcaaaattcaaatgtcaaagagtcacggaaaaggatgtttggaactgacattggaaacataagttttaaaaggaacaaagttgatttgtccatggatggccagaattctaaaatgcaaaatcaacacgaaaatattagtccacgagctcagttagagaaaatcatcataaaaaaagatgctaagcagacttcagagagctatcagtttggccctttggctccagcttatgtgcccaaagttggaacccatgaaaataatagtctgaaacaggtgcatgactttgaaaacctctcatatcaccatagtcctcaatatcaaaatcaaggttctaacgttgaaaaatctatataattaccacatcgaagtaagtaaataattgcagctttctccagataatagtagcttttctagaactttattattgcattgttcagtgtatgttcaaaaaattgtggcatattctcaaaatgaaatgatccattactgaatgcatgttctccatgcgttactgtattctcaaaagaaaatgatccattattgaatgcatgttctccatgcgttagtgtatacttaatagaagatgatccattattgattacatgtcatctttgagattgggtattgctaccgtatgccgatttaaaaactgtaaattataaattattgttaacatgacttttaagataattttattaaaattaataattaataattgatcataaataatggtttctgattgtatgtttacactttcaattcatagttgttttggattacaaagtttgtggggtattaaaaggtttgaattaggggtaacaaagcatgatgaacctactagattcatatgcctagctaatcttgcttaacacaccaagttggtgagtcaaaggtaggttgtggttggttgatccaatgcatttttttgttaaaaatttgtttacctttctaagacaccggaacctatttcccggaaagtgatgcaaatgttgcaattttttgagtgatttttagtctaacaaattgtttaattcaccctaggccttctaccttcacgtggcattgctctgtcaggctttcgtccattgtagaaaattctcactactgcctcctgtaggagtgtaggctgtgtcttagttccagtgtggctgatcatcgtcttggtctcttggatcaagattgtcgccttggaaagttattgtctcgccaactagctaatcagacgcgaactcctcagacggattcctccaaactatcattaaagattagtaaaattatatttttatttttacagaaatcaaattgatataaatttttttaaagataaaattaatatttttcaaattttatatgtattttaaacatatcttaccttaaaatttttattagggtttcattgttgttcataacttgtattgagattgattgatcagaaatttataataaattatggatgaatgaattagtattttttttaataaatatttgacgggtttggtgggtcaattcactattttatgtcttccaactcatttttaaccgtgggtcaatctaacttgccttgcttaaagtggtagcttgaatctaagggattatttttactaaattgttgtaattcactttaaaaataaaaaactaatgtagtttttgt

SEQ ID NO: 192 - DNA, 2187 bp, Glycine max
  Clone ID: PAT_MRT3847_19229C.1
cgctcttcaacaattgaaaatagttcaccctgccgccccaacccaacatcgtctttctctctccaatatctctaccctaatccaccctttctgaacaaaaataaaaaaataaaaaaaaacccatcgatttcttggacctccatgacttctttgtctacccatcacacctatagccgaaagcaaaaatctctcggcctcctctgcaccaattttctgagtttgtacaacaaagaaggtgtgcgcctggtcggtctcgatgacgcagcttcgcggttaggtgtagaaagacgtcggatctacgacatcgttaatgttttagagagtgtcggtgtgctaaccagaaaagctaagaatcagtatacttggaaaggattttgtgcaattcctgctgccttacaagaacttaaggatgaaggtttgaaggagaatcctggatcatttgatgactccaatgacaatgcaaaagtgtctgatgatgaggaggaggaagaagaaacatttcctaatattaacattgggagtcagagtgagaaggaaaatcctgattacactgctactgtcaaatcctccaagaatgaaaacagaagggaaaaatctctggcattgcttactcagaattttgtcaagctttttgtctgctctaattttgaaatgatctcccttgacgaagctgcaaagttgttgcttggaaatgccaacaatagaacaaaagtcagacgtctatatgatattgcgaatgtgttatcctccatgaacctaatcgagaagacccatacaacaaacacaagaaaaccagcattcaggtggttgggtgtgaggggaaaaacatggggtggatcagttgacttggctcaaaattcaaatgtcaaagagtcacggaaaaggatgtttggaactgacattggaaacataagttttaaaaggaacaaagttgatttgtccatggatggccagaattctaaaatgcaaaatcaacacgaaaatattagtccacgagctcagttagagaaaatcatcataaaaaaaagatgctaagcagacttcagagagctatcagtttggcccttttgctccagcttatgtgcccaaagttggaacctctgaaaataatagtgtgaaaaaggtgcatgactgggtacagcctcgcacaggagcatcgtcctcaatatcaaaaccaagcttggtcttcaacaaccagctcttgaatcctgaaaaagtcatggatgaagccttattacatacttgggctgaaaaagtcatggatgaagccttattacatacttggtcctggttaaggtgtatggagaagggattccaaactcattttaaccattggtcaactaacttgaaggaggaactctcatagaggggtttgacatagctggtcagctgtattgtattgtacttgtcttttagttgggtttgacttttcgttgggtttgacttttcattgcctatattatctgttgtacacttcagtacacctacagctgattcttatttataatatataatataaatttttgctgagcaaaaaaaaaaaatgtttaatgagctcattttaaactcaagtttgttcatgaacccaattcaaaaaatcaattatcgaatttacaaaatcaacacgaaaaatattagtccacgagctcagttagagaaaatcatcataaaaaaagatgctaagcagacttcagagagctatcagtttggcccttttgctccagcttatgtgcccaaagttggaacctctgaaaataatagtgtgaaaaaggtgcatgactgggacagcctcgcacaggagcatcgtcctcaatatcaaaaccaaggagtcacacgtgaaggagcctattgcccgactgttgtgtgatgtattggattattttcaacttgatggaaacttgggaagttaactatctcaaaagctttaaaagatctattttcccactacatggaagcatggaaatcttggtactctgaagctgctgggaaaaagtcaacgaaaactttataattgacttgtccaaagtcagtccagataattgtagcttttctagaaaataaatgatccattactgagtgtatgttccacatatgttggcatattctcaaaatgaaatgatccattactgaatgcatgttctccatgcgttactgtattctcaaaagaaaatgatccattgttgaatc

SEQ ID NO: 193 - DNA, 2116 bp, Glycine max
  Clone ID: PAT_MRT3847_19587C.1
ggctcgaggacgcattcgctaatttcaccaatttctattttcataactttctctgcagtctcttcacctttatgttaatgatattatgtgtttagagagaaagagaacaagcatagttgagcttgattgtgttcttcaacattagaacaagaaaagaaagacaacaacatggaaggaggaggagtagaagttgatgcctctgctttcagagaatgcttgtctctgtcatggaaaaatccttacgttcttcgccttgctttttctgctggaattggtggccttctctttggctatgacactggagtcatatctggggctattttatatatcagagatgatttcaaagcagtggataggaagacttggcttcaggaagccatagtgagtatggctcttgctggagcaatcgtaggagctgcagttggtggatggattaacgatcgatttggaaggagaaaagctattcttcttgcagacacactcttctttattggttctgctgtcatggctgccgctaccaatccatctattctcattgttggtcgagttttcgttggccttggtgttggaatggcttcaatggcatcccccttatacatctctgaagcttctccaactagagttcgaggagctttagttagtctcaatggctttctcataactggaggacaattcctctcctacctcatcaacttggccttcacaaaagcaccaggaacatggagatggatgttaggagcagcagtagtaccagccctgatacaaatcgtattaatgatgatgctgccagaatcaccgcgttggctgttccgaaagggaagagaagaagagggtaaagaaattctaaggaagatttatccaccccaggaagttgaagcagaaattaatactttgagggaatcagttgaaatagaaatcaaggaagcagaggccacagataacatcagcatagtcaaaatgctgaaaactaaaactgtgagaagaggtttgtatgcaggaatgggccttcaaattttccaacagtttgtggggatcaacactgtgatgtactacagtcctaccatagttcagttagctggttttgcatccaaccgaacagcacttcttctgtcactagtcacatctggtctcaatgcatttggttctattttgagtatatacttcatagacagaacagggaggaaaaagcttgtgttgttcagtttgtgtggtgttgtgttctcccttgttgttctaaccgttgtgttccatcagagtacaactcactccccaatggttagtgcactcgaaacctctcacttcaataacacttgcccggattaccattcagctgcgaaccctggtggatgggattgcatgaagtgcctgaaggcttctccaaattgtggcttctgtgcttctggagccaataagctcttacctggggcatgtttgatctccaatgacaccacaaaagatcagtgccatgaagaagatagactatggtacaccgtggggtgtcctagtaaatttggatggcttgcaatagtagggcttgcactctacatcatattcttctcacctgggatgggaactgtgccatgggttgtcaactctgagatttatcccctaagatatcgaggaatatgtggaggaatggcatccacatccaattgggtctcaaatcttattgttgctcagtccttcctatcattgacacaagctattgggacctcatggacatttatgatatttatattcatcaccatagctgccattatctttgttattattttcgtgcccgaaaccaaaggacttccaatggaagaagtggagaagatgttggaaggaagagatctcaacttcaagttttggcagagaagttctcactgtggagaagaagtaccaccacaaaagactcaatcaaattaagtctattgtgttgcatcatttgtaatattggagtattaactaaagaagtataggtaataaaatcgtagaatgtagctattagattctaagtatatacaataaaatcgtagaatgtagctattagattctaagtatatacaatatcttgtttgtgtgaatttttttcttatcaacaaatattattttgttaattttgttacaaatt

SEQ ID NO: 194 - DNA, 1590 bp, Glycine max
  Clone ID: PAT_MRT3847_19765C.1
cctgtgccgaattcggcccacgcgtccgcccttccatttcaactccttctcgcgcgatagattgctctttctcctctgctcctccctttcccattcctcctttccctctcccctccgctcccccaatttcccccaaactttctccctccgccgcttcgccgccgcccctctcgctcgccctccgccgccgcctccgcccctggacgccatggcccagaaaatcggaaagtccacgcgccgccccggcgcgtcctccaaggcccgcgtctatgccgatgtcaacgtcgttcgccccaaggaatattgggactacgagtccctcaacgtccagtggggggagcaagatgattatgaggtggtgaggaaggtgggtagggggaaatacagtgaggtgttcgaaggtgttcactgcacggacggtgagaaatgtgtcattaagatcctgaaacccgtgaagaagaagaagatcaagagggaaatcaaaatattacagaatctttgtggagggcctaatattgtacagttgcttgacattgttagagaccaacagtcgaagaccccaagtcttatatttgaatatgtcaataacactgattttaaagtgctctatcctacattgtcagactacgaaatacgatattatatttatgaacttctgaaggcactggattattgccattcacaaggaatcatgcatcgtgatgtgaaaccacataatgtaatgattgatcatgagcagcgtaagcttcgccttatagattgggggcttgcagagttctatcatcctgggaaagaatataatgttcgcgtggcatcaagatatttcaaaggtcctgagcttcttgttgatcttcaagactatgattactctctagatttatggagtcttggttgtatgtttgctgggatgatattccgtaaggagccattcttttatggacatgataactatgatcaactggtcaaaatagctaaggtacttgggacagacggattaagtgcatatttagataagtatcgaatagagttggacccacatcttgcagcacttatcgggaggcatagccgcaagccatgggcaaagttcattaatgtagaaaatcatcacatggctgttcctgaggctgttgactttgttgacaagttattacgctatgatcaccaagaacgtcccacagcaaaagaagccatggcccatccatacttcaatccagttagaaatgcagaaagtagtagaactcgtgcacattgagttgctggtgcttgttgtgatatggtgttcgttcttgtcagggggccttcaacagtctgaactgttatttctagtggaacttgcttttagtagattcccctgttctgttgtgaaactcatttcaattagttctttatctaatcgttttgtttctggtttttaaaattatttttgggtggaaaattcagctctcaacaattttatttgattgtgtgccaaaatttggaaatgaaatgttgattcaatttcagtaaaattatacgcttgtgttcttttatgtaatactgttaaatcaaaaaaaaaaaaaaaaaaaaaaaaaaaactcgagactagttctc

SEQ ID NO: 195 - DNA, 509 bp, Glycine max
  Clone ID: PAT_MRT3847_20044C.1
tcgacccacgccgtccgcaagacaagaaagaaagaaagaaaaaggtagagaaggagagagagagagagagaaagaaaactgaaaaaaaaaaaaaaaagataagactaattaactacatttttggtttggtttttcttcatctcgcaggagacacgaagagacaagttacatcacatgagatgtcaggtggtggatgcagcagcatagtgtggttcagaagagatctgaggatagaagacaatccagcactgacagcaggagtgagagctggtgctgttgttgcagttttcatatgggcacctgaagaagaaggacaatactaccctggcagggtctctagatggtggctcaagaacagtttggctcaccttgattcctctctcaggaatcttggcactcctctcatcactaagcgatccactgatactctttcttctctatttgaggttgttaagtccactggagccactcaactcttttttaatcattaataagaacctctggcactt

SEQ ID NO: 196 - DNA, 1516 bp, Glycine max
  Clone ID: PAT_MRT3847_20045C.1
ccacgcgtccggttccttctaacctatccttctcatagtgtgtccattctgtcaaagcctttgggctttttcgtacaactaggtagtgaaagcaacaatactagaatttttgatggaaaatactaataatttaccccaaaaacaccaatattgggagaaagaaatacaaccaaaacttaaaaagtcatcaactcaataatcgtgctgtgctttcacctatttatggcttaaaatctcctgttaaacaagttagaaagaaaagccaagacaagaaagaaagaaagaaaaagggagagaaggagaaagagagagagagagagaaaactgaaaaaagaaaaaaaaagataagactaattaacgtttttttggtttggtttttcttcatctcgcaggagacacgaagtaaagagacaagttacatcacatggttaaaacttgttaaaagagttttgtgtgtgtgtgtgtgaaagtagtttaaggttgtgggggtggttgaagtttttagctttagctttgcagagatgtcaggtggtggatgcagcagcatagtgtggttcagaagagatctgaggatagaagacaatccagcactgacagcaggagtgagagctggtgctgttgttgcagttttcatatgggcacctgaagaagaaggacaatactaccctggcagggtctctagatggtggctcaagaacagtttggctcaccttgattcctctctcaggaatcttggcactcctctcatcactaagcgatccactgatactctttcttctctatttgaggttgttaagtccactggagccactcaactcttttttaatcatttatatgatcctctgtcacttgtcagggatcaccgagcaaaggaggttctgactgctcagggcataacagtacgttccttcaacgcggacttattatatgaaccatgggatgtgaatgatgcacatggccgaccattcacaacttttgctgctttttgggaaagatgtcttagcatgccttatgaccctgagtcacctcttctcccacctaaaaggataattccaggtgatgcatcgaggtgccctagtgatacattgctgtttgaagatgaattagagaaggcaagcaatgcacttcttgctcgagcgtggtcacccgggtggagcaatgctaacaaggcattgacaacattcataaatggtccactgattgagtactcaaaaaaccgcaggaaagcagacagtgccactacctcacttctctcaccccatttgcactttggtgagttgagtgtcaagaaggtcttccatctagtccgcatcaaacaagttttgtgggccaacgaaggaaacaaagcccggtgaagagagcgtgaacttgttcctcaaatctataggtcttagagaatattcaaggtacattagtttcaacccaccctacactcatgaatgaaaaggcctttttctaaggcccacctttaagttcttttcccttggggttggtaaaaccgaagggctatttttaa

SEQ ID NO: 197 - DNA, 496 bp, Glycine max
  Clone ID: PAT_MRT3847_20986C.1
ccacgcgtccggcttcttctccccctccggaacggattccggtaccagaggttcttcggggttcggtttcgagggtgagcggatcgagatggcggcgtcggatgttgagtaccgctgcttcgtcggcggcctcgcctgggccacggacgaccactcccttcacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggatacggtggtagaagcggcggctactgaggcggcggtggctactgtggtggtggtggc

SEQ ID NO: 198 - DNA, 1500 bp, Glycine max
  Clone ID: PAT_MRT3847_21549C.1
acctttgcaaaccctttccaacaattagcaaaacatttgttaaacgatggaagtaatgtgtggtgccaaagttggcaatatggtccataaggccaagccttatgtgttaactgtggggttgcaatttgggatggctgggacatacctcttcaccatggccagtttgaaccatggaatgagccgtttggtgttcattgtgtatcgcaatgccattgctgcattggcccttgctccctttgccttgatctttgaaaggaaagttagaccaaagatgacatggactgtcttcatacagatattagtacttggatttcttgagccagtggttgaccaaggattcactttcttggggatgcaatacacttcagcttcctttgcatccgctgttatgaatgccgtgccctctgtaacctttgtgcttgcagtaattttcaggttagagcatataaaaataagggaattacgcagtcaagcgaaagtaattggaaccttagtaacctttgctggggctttgttaatgacactatacaaaggccctcaattcgacctatttcatcattcaaacacaacccaccaacaaggtggaagccacactcagaatcactcacactgggtcgcaggaactctcttcatttgcctgggttgcctggcttggtcttccttctacatattgcagtccataacggtgaaaaggtaccctgcggaactatcactctcatcgttgatatgcttggcgggtgctttgcaaagtgccgtggttgctctgattgcagatcataaccctcgagcatgggctatcggttttgactacagcctctacggtcctctatacactggaataatgagttcaggaatagcatattatatacaagggttggtaatgcaaagcagaggtccagtgtttgtaacatctttcaatcctctttgcatgatcattgttacagctttgggctccttccttctaggagaacacctctacttgggaagcatcattggaggcatcataatcgcagtgggtctatactctgtggtgtggggaaaaggcaaagactataaagatgacacgtcatcaccagcaacaacaaaagaaacagaaacaatgcagcttccaattaccttaccaaataataaataacagacactttgtgttaacttatagaaaagaaaaattacatagtaattcgatcgacttatgttggcggaagtgaccgatgatagcgtaatttgcaaatcatatagtgatttgttgtgctggtgtgggcactatatttagccatgttaagttgaaacacgactttgtttaagttaatactaatttgttagaaagtgttttgctatcgttaattattccaagagtttaaattgttaatcaatgtgtaattttattttcttcctgcttttgtattttttttatcatgatatatgatatattagtgcggaatatttatcacgatgaaatcagatagctggtttaataaaaccaaactcaattccactctc

SEQ ID NO: 199 - DNA, 266 bp, Glycine max
  UNSURE (1)..(266): unsure at all n locations
  Clone ID: PAT_MRT3847_21599C.1
  unsure (1)..(266): unsure at all n locations
aaaaaatcattnttttagctnttngctttttctcagttgcccccctcttcccnattgttagttctaagcanaagattctaacaccaatagtccaatagcatagatatacatgtattttctttgctcttgagaactatcccaattattgagtgtgtcacctctccaatattttgatttagccttttctnttctcttttggttggtcatggtggttatttcacctcctcttagatctgaagagtttcataaggggtttgctntgncca

SEQ ID NO: 200 - DNA, 1800 bp, Glycine max
  Clone ID: PAT_MRT3847_22087C.1
gtaacgctctctttcttgaataagcgacaattcaaaatgtcgacccagaatcgtcgctcgtcgttttcctcctcaacgacgtcgtcattggccaaacgccatgcatccgcctcaacgacgtcgtcgtctgctgccgctcctacaaacatggccaagaagcgtcctcctctctccaacctcaccaacaccgttgctcaccgcaactcttcctcttcggttccatgcgcagctaaatttgccaagaccaagaaagaggttgttccggcgtgttcagggaacaaaagacccacattggcgaatgttaaacccgctagcgcagttatttttccgaaggctaattctttccctgtaagggatgaagctccaccaactcctcctcctccggttgccaccgttactgttccggctccggtggtggatgtttcacctagtaaatcagatacaatgtcggtttctatggatgagtcaatgtcttcttgtgactccttcaagagccctgacattgaatatgtggacaatattgatgttgcagccgttgattcaattgagaggaaaacattcagcaatctcaacatctctgattctacagaagggaacatatgtagtagagacatacttgttgagttggagaagggggacaaatttgtcaatgttgataataattacgcggatcctcagctctgtgcaacctttgcttgtgatatctacaagcaccttcgtgcatctgaggcaaagaaaaggccttccacagacttcatggagaaaattcagaaggagataaactccagcatgcgtgctatattgattgactggcttgtcgaggtggctgaagagtatagactagtacctgatacattgtatttgacagtaaactacattgatcggtatctatcagggaatgtgatgaacagacaaaggttacagttacttggtgttgcctccatgatgattgcctctaaatacgaggaaatttgtgcacctcaggtggaggaattttgttacataactgataacacatacttcaaagaagaggttttgcagatggaatctgctgtcctgaattttctcaagttcgaaatgacagccccaacagtaaaatgtttcttaagaagatttgttcgtgcagctcaaggagttgatgaggtcccttcgctacaactagagtgcttgacaaactatattgctgaattgtctctcatggagtacagtatgcttggttatgctccatcacttgtagccgcttcagcaattttcctggccaaattcatacttttcccttcaaagaaaccatggaattccacattacagcattacaccttgtaccagccttctgatctgtgtgtctgcgtaaaggatcttcaccgtctttgttgcaacagccccaattctaatttgcctgcaattagggagaaatacagtcagcacaagtacaaatatgtggccaagaagtactgccctccttcaatacccccagaatttttccagaattgagcagagatgacagtctaatttttggttgggataggcttagattgatataacttcttgtctccagagaagatgcttctcttacactgtacaatgtagtagccaaccaacccttccatctcaattagaattcttgtatctgcttttattgacgtgcatactcttatgcccacaaattcacaaaaaaataacgcttcaagaagcaacttgtattattagctaagctactgcttcagtagcatcattaatggctaaaaggagccaacgcctaatttttttttccaggtataaaatctaggtgcattacctagt

SEQ ID NO: 201 - DNA, 1815 bp, Glycine max
  Clone ID: PAT_MRT3847_22149C.1
atctttgtggggactgcggcggagcatcgttggacctcacatattgacatgtgtcagttgaagcgcgttagtgacggaatctgatggacacacctttaaaaggaggcaagttgagtcccgtcaccccctgtgccccgctttattgcatctcagaggccaattctttcgccgcttcttctctctttccaacgcttccccctgtggtgttctcgtgttgctggtaacaatatggttgttgacgctttgaatgaggatttgagaatcaacggagcagttgaaccgttgcctgaggactttgatgcaacagctgtaatcatagatcccgtgcctttggcagttgtagacaatggcattgtcaaggaggaggcgcagatcattaaaggaaaagagaaaagagaaatagtactgggaagaaatattcatacctcgtgtctagaagtcacagagcccgaggcagatgatgaggtcactggggaccgggaagctcatatggcaagtgtgttggccagatacaaaagagctttgactgaaaggacaaagcatcatttagggtacccctataatttggatttcgattatggtgcgctcacgcaacttcagcacttttccataaacaaccttggagatccatttattgaaagcaactatggtgtccactcccggcagtttgaagttggtgttttggattggtttgcccgattgtgggaactggagaaaaatgagtactggggctatataacaaactgtggtacagaaggcaatctccatggcatcctagttgggagagaggtctttccagatgggattttgtatgcttcacgggagtcacattattctgtgtttaaagctgctcgaatgtacagaatggaatgtgagaaggttgatactctttggtctggggaaattgattgtgatgatttcaaggccaagcttcttagtcaccaggataagccagcaattataaatgtgaacataggtacaactgtgaaaggggctgtggatgatcttgatctggtcataaaaaaacttgaagaagctggattttcgcatgacagattctacatccattgtgatggggctttgtttggtctcatgatgcctttcgtgaaacgagctccaaaagttacttttaagaagcctgttggcagtgttagtgtttctggccacaaatttgtagggtgtcccatgccttgtggtgtgcagataacaagattggaatatgtaaatgctcttgccagggatgtggaataccttgcttctagggatgccacaatcatgggtagtcggaatggccatgctcccatattcctctggtataccttgaatcggaaaggatatagaggttttcagaaagaagtacagaaatgcttgcgaaatgcacactacttcaaaggccgccttgttgaggctgggattggtgcaatgcttaatgaactgagcagcacggttgtgtttgagaggccacatgatgaggaatttatacgcaagtggcagttagcatgcaaggggaatatcgcacatgtggtggtgatgccaaacatcactattgagaagcttgatgattttctgaacgagcttctggagaagcgtgctacctggtttcaagatggcaaggatcaaccctactgtatatcatcagacgtaggtgaaaagaattgcctttgtgctttgcacaagtaattgcagcatcccatctagtgtttattgctgtagttggtttttggagtgtttatccagtgtacgtcactatgttctatcaggactttgatgcaattaataacatttagaatcttctttgctgtccaaaaaaaaaaa

SEQ ID NO: 202 - DNA, 1832 bp, Glycine max
  Clone ID: PAT_MRT3847_2249C.1
gaaagcaagtttgttattcagagagagaactcggtgtggctggccgacagaaaattttctattggatgacaaggaagttggctatccattgcttagtgtaaagcgaagaagtgtgaacaaatatcctcagaagctgccttttcaaaagcaaatacatttcgatttataaaaaagattgtactagtagtagtagaaaccaatattaaaaaggaaagaaagaaaaataggagaaaaagatgaaaaatcacacatagaccctttcctctctcgatactataactgcgaatgcgtaggggacagtgagagccagatgtctcctctatatagttcgtaacgcctctttcttacctctcattcatgcattagcgatatttctcaatctctcttcttacccatttcctccccccctctttctcttttcttgttctgtttttattttcactgttctctgataacaacgttgttagttgtcaccatggttgttctgtctcagccagcattaaaccagtttttccttctgaaaacatgcaagcccacgcccttgttcgcggggattcctgtggtcgacctcacggaccccgatgccaagacccacatagtcaatgcctgcagggacttcggcttcttcaagctcgtgaaccacggtgttccgttacagttcatggccaatttggaaaacgaaaccctcgggttcttcaaaaaacctcaatccgagaaagacagggctggtccccctgacccttttggctacggcagcaagaggattggccctaacggcgatgtcggttgggtcgaatacctccttctcaacaccaaccctgatgtcatctcccccaagtcacagttcattttcagagaaggtcctcagaatttcagggcggtggtggaggaatacattagagcggtgaagaacatgtgctatgaggtgttggaattgatggctgagggattggggataacgcagaggaatgtgttgagtaggttgctgaaggatgagaagagtgattcttgcttcagacttaaccactacccgccatgcccggaggtgcaagcattgaacggaaggaatttggttggatttggagagcacacagacccacagataatttctgtcttgagatctaacagcacctcaggcctgcaaatctgtctcacagatggcacttgggtttctgtcccacctgatcaaacttcctttttcatcaatgttggtgacactcttcaggtaatgactaatgggaggtttaaaagtgtaaagcatagagttttggctgacccaaccaagtcaaggttgtcaatgatctactttggaggaccacccttgtgtgaaaagatagcacctttaccttcactcatgttaaaaggagaagagagtttctacaaagagttcacatggtgggaatacaagaaggctgcgtacgcgtcaaggctagcggataatagactcggcccttttgagaaatctgctgctgattaaggaggcaaagtgtgtcaaaattctactactcaattttggcacgtgttgttaggccaacttttttattttttattttttttgggtgtgtgtatctaggttccaaacagttgactttacttgagatatatagaaaatgaataggttgcttatgcacttccttttaatccttgttctttttcttgtttgattgaagtgtaatagtcactactgcccttctattatcaatgaaacgcaactctagtcacagcttttcattaatttttgcggtgtattatatcgaggaattaggataaacacgggaataaaatactcctattatttaatgataataaaaatatatattaaagtgcaaaaa

SEQ ID NO: 203 - DNA, 1291 bp, Glycine max
  Clone ID: PAT_MRT3847_22514C.1
gaatacaagacgtgtctataaaaagttaacatgacctgttccaatgggcaacaaagagagcaaggagagaggagatgtcggtggagcagaaagcagcagggaaggaggaggagggaaaactgcagaagggaattgcagagttctacgacgagtcgtctggcatatgggagaacatttggggcgatcacatgcaccacggcttttatgacccggattccaccgtttctgtttctgatcatcgcgctgctcagatccgaatgatccaagaatctcttcgttttgcctctctgctttctgagaacccttctaaatggcccaagagtatagttgatgttgggtgtggcatagggggcagctccagatacctggccaagaaatttggagcaacgagcgtaggcattactctgagtcctgttcaagctcaaagagcaaattctcttgctgctgctcaaggattggctgacaaggtttcctttgaggttgctgacgccctaaagcaaccattccctgacggccagtttgatctggtatggtccatggagagtggagagcatatgcctgacaaagctaagtttgttggagagttagctcgggtagcagcaccaggtgccactataataatagtaacatggtgccacagggatcttggccctgacgaacaatccttacatccatgggagcaagatctcttaaagaagatttgcgatgcatattacctccctgcctggtgctcaacttctgattatgttaagttgctccaatccctgtcacttcaggacatcaagtcagaagattggtctcgctttgttgctccattttggccagcagtgatacgctcagccttcacatggaagggtctaacttcactcttgagcagtggacaaaaaacgataaaaggagctttggctatgccattgatgatagagggatacaagaaagatctaattaagtttgccatcattacatgtcgaaaacctgaataaatggagaggcaggattacttttatagaatgaagcaagtttccaacaggtcgtttatttcgatagttgagaaacaagagaaaaaataaatgaaaggggttgttcgatttttattttagttttctacatatgcaatatctcctatgattggcgaaaatatattatctacttaaataagtggcacgagtatttataattaagtaattaaaaaagaagtattgtatatatagagatagaaaactaatatttgtgacttgtgaaaacatcgtaaaggtgataaagagaaatgttagttaacgccttttttaat

SEQ ID NO: 204 - DNA, 2681 bp, Glycine max
  Clone ID: PAT_MRT3847_22518C.1
tgaatacaagacgtgtctataaaaagttaacgtgacctgttccaatgagcaacaaagagagcaaggagagaggagatgtcggtggagcaaaaagcatcagggaaggaggaggagggaaaactgcagaagggaattgcagagttctacgacgagtcgtctggcatatgggagaacatttggggcgatcacatgcaccacggcttttatgacccggattccgccgtttctgtttgttgactattgaaggttgggcacccgtgagtgacatggccaccgtggtgaggatcccaacaatctcatgcatccacatccacacgttccgttcccaatcccctcgcactttcgccagaatccgggtcggacccaggtcgtgggctcctattcgggcatcggcagcgagctcggagagaggggagatagtattggagcagaagccgaagaaggatgataagaagaagctccagaagggaatcgcagagttttacgacgagtcttctggcttatgggagaacatttggggcgaccacatgcaccatggcttttatgactcggattccactgtttcgctttcggatcatcgtcctgctcagatccgaatgatccaagagtctcttcgctttgcctctgtttctgaggagcgtagtaaatggcccaagagtatagttgatgttgggtgtggcataggtggcagctctagatacctggccaagaaatttggagcaaccagtgtaggcatcactctgagtcctgttcaagctcaaagagcaaatgctcttgctgctgctcaaggattggctgataaggtttcctttcaggttgctgacgctctacagcaaccattctctgacggccagtttgatctggtgtggtccatggagagtggagagcatatgcctgacaaagctaagtttgttggagagttagctcgggtagcagcaccaggtgccactataataatagtaacatggtgccacagggatcttggccctgacgaacaatccttacatccatgggagcaagatctcttaaagaagatttgcgatgcatattacctccctgcctggtgctcaacttctgattatgttaagttgctccaatccctgtcacttcaggacatcaagtcagaagattggtctcgctttgttgctccattttggccagcagtgatacgctcagccttcacatggaagggtctaacttcactcttgagcagtggacaaaaaacgataaaaggagctttggctatgccattgatgatagagggatacaagaaagatctaattaagtttgccatcattacatgtcgaaaacctgaataaatggagagcccagtgcttgaggcatttctggcacagttttttccacttttattttaactttaagactgcacagagagaagcatataattcctgagtcaatatagaatttgtgaagtcagtccaaacttcagtttcaaagatgcctcgtggaacgcttgaagttgttctgatcagcgccaaaggaatcgatgacaatgattttctctccagcattgatccttatgtgattctcacatacagggcacaggagaaaaagagcactgtgcaagaagatgctggatccaagccacaatggaatgagagctttcttttcactgtctctgacagtgcatctgaacttaatctaaagataatggataaagacaactttagtcaagatgattgtcttggcgtggcaaccattcatctggatccagtgtttgaagcgggtagcattccagaaactgcttacaaggttgtgaaggacgaagaatattgtggagagattaaggtggctctcacttttactgttgagaaaaatgaggagcaggattatgctgaacctgaagagagctatggtggatggaaagaatccagtggggaattttaaagtgaaaaaaagtatttacatacttccatggccattatgacccgtataatgaaaaatatgtagttttggggtacttttcggcaatttccattattgtgttttctggtgtgaagcaatggtgttgtgctgttaggttgctttcctccctttggatatatattaaagtacattatgtttgatatattgtctttaatgcattagttaacattttaaaaaaaaaaaaatattttattttgtttgaagttattattattggattcactaattagttatggaaaatgttattttggcccgcagtgaatacgctccgcgttgacatggaatggcctcacttcattcttgcgcagtggacttaaagccataaagggagctttggctatgcccttgataataaaaggatacaagaagaatctgattaagtttgccatcattacatgtcgaaagcctgaataaaaactggagccagagtatagcgttttcatagaatctagtgcatgttttactgtgacggggaaatgtataagagtatatataatgagcggttgtttaaataagaggaaaaaaaaaacgaattcaattgggtgggacctgggagtttttggtactgtctttgttcgttttttattttcgacattatattgtagccgaaaagaaataatcaagatcctattgagcgttaaaggggccgtatgatcaatatgaagatgtaagctaattcctgtttaatttccatttgaacaaaggcatcaataatagtacctcgtgttttattt

SEQ ID NO: 205 - DNA, 170 bp, Glycine max
  Clone ID: PAT_MRT3847_22786C.1
gtcgacccagcgtccgcccacaccaatggcatgctcagggcgcgctggtcccctcttctgcgcaaacccaacacccctcttgtctcccaaacccggtctctccctccagcttaaccctgtgcccacgcgcccttctgcctgccggacgcgcgcttctctgtggctcacgc

SEQ ID NO: 206 - DNA, 662 bp, Glycine max
  Clone ID: PAT_MRT3847_23153C.1
ggacgctgctaattaattattagtttcacttcaatgactcaaagggatcgtcgcaccctatcattcccggcggttcacccatgcgaagccatttctccgccgacacttgtcacctctctaatcactctctcccaatccatatgcaatttccaaccccaatcattccccacccaacgaaggaacgccagggaaacaatacgccaaataagcattgtcttaatgttccttcaagaaattcgactaatccccaactccactatcctctctttggcggaactccacttcaccttacaaaaaatccactttttattgcaagattgcaccctccaaggctcgcgcctcctcctgctcgccaaatcgcaacacgtagcgtccctgttccccgccctccttcgctccgtggccacctctctggacgtcttgcctcttcaccagctccacttgtgccccgaagtcagggagctggccgaccttgttaccaagcaagccagcaaggccaagttccagctggaccccagcgacgcacgtgccaccaaaaccctccacacgcttctgcgccagttctccatgggcaccgaacctgacctcacttccatgcagggaatcctccactacctccaaattagaacctggacagattgcaatacggagattaaattctt

SEQ ID NO: 207 - DNA, 2190 bp, Glycine max
  Clone ID: PAT_MRT3847_23468C.1
ctaagttgcctgtttttggatcccgcaaacaaatagcacatggttttggaaacccctacataaacccctccctgtcgctccatccacagtcacactcgcggtcacagacacacgtcaaaatatccaatcatttcacatggaaagtgccactcaagtcggtgcggcggctcagcccagctcagcttcagcgtcggtgattccctccgccttcgacggcaccctgggccgtcaccttgctcgccgcctcgccgagaccggtgtcagggacgtcttctccgttcccggcgacttcaacttgacgctcctcgaccacctcatcgccgagccgagtctcaacctcgtcggctgctgcaacgagctcaacgccggctacgccgccgacggctacgcgcgcgccaagggcgtcggcgcctgcgtggtcaccttcaccgtcggcggactcagcgtcctcaacgccatcgccggagcttacagcgagaatttgccagtgatttgcatcgtcggaggacccaattccaacgactacggcaccaaccggatcctccaccacaccatcggtttacccgatttcacccaagagcttcggtgctttcaggccatcacgtgttttcaggcagtggtgaataacttggacgatgcgcatgaacttattgacactgcaatttctactgctttgaaggaaagcaagcctgtttatatcagcataagttgtaaccttcctggaattcctcatccaacttttgctagagaccccgtgccattctttcttgcacctaaggtaagcaatcaagaaggattagaagcagcagtggaagcaacggctgctttactgaacaacgctgtgaagccagtgattgtgggtgggccaaaactaagggtagcaaaggcacaaaaggcctttctggagtttgcagaagcaagtggatatccaatagcagttatgccgtccgggaagggactagtaccagagcatcatccacatttcattgggacatactggggtgctgtcagctctagcttttgtggggaaattgtggagtctgctgatgcatatgtttttgttggccccatcttcaatgactatagctccgttggatactcgttgttgataaagaaggagaaagccataatagtgcagcctaatcgggtaaccattggcaatggtccttccttgggctgggttttcatggctgatttcttaactgcattggctaaaaaagtgaagaccaacaccgcagctgtggagaattaccggcgtatctatgtcccaccaggcattcctctgaggcgagagaaggatgaaccacttagagttaatgttctattcaagcacattcaagaactgctaagcggagatactgctgtaatagctgaaactggagactcatggttcaactgtcagaagctccatctgcctgagaattgcgggtatgaattccagatgcagtatggatccattggttggtcagtaggtgctactcttggatatgcacaggctgcaacagacaagcgtgtaattgcttgcattggtgatggcagttttcaggtaacagcacaggatatttcaacaatgattcgctgtggacaaaagaccatcatctttctcatcaataatggaggttatacaattgaagttgagattcatgatggtccatacaatgtgataaagaattgggactacactcgctttgtggacgctatccataatgggcaaggcaaatgctggactgccaaggtacgtacagaggatgatctgactgaagcaattgcaaaagctactggaccacagaaagattcactatgttttatagaagtttttgtacacaaggatgacaccagcaaagaattgctggaatggggatctcgtgttgctgctgctaacagtcgtcctcctaatcctcaatagaaaatcatttcctaattattggcctgttttgtgtattttgttgaatagagttccactactggatatttacaagagaaaaacgacaaaaatgaaaaataagttgaaataaatgtttgcttttccagatttgtatctggtctcgtgttgctgacttgttgacttgttgtaatcatgaactattattgctttgtaataatgtcttgtataatggaattgttaatgaatcaaagaggatatagccattgtatgtaaattcatgtaaaaaaaacacgattgatattgag

SEQ ID NO: 208 - DNA, 242 bp, Glycine max
  Clone ID: PAT_MRT3847_23929C.1
gtcaagcagttgaacgaccttcttacagagaagaacaaggacactgggtgggacgtgcctatccacgtcgacgccgcgatcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcat

SEQ ID NO: 209 - DNA, 211 bp, Glycine max
  Clone ID: PAT_MRT3847_24039C.1
tggcacctccaatctataatcctgcactcaatcctctgatggcccggcctctaatttggcctgctgcaccagcgcaagcttggtatccgcaacaagcagcatatccacaacaatcagctgtttcagttcctcccatagttgctgggctccaccacaacagccactattcccaattcagaatgtgcctactcctatgacatcagcagctgct

SEQ ID NO: 210 - DNA, 1262 bp, Glycine max
  UNSURE (1)..(1262): unsure at all n locations
  Clone ID: PAT_MRT3847_24409C.1
  unsure (1)..(1262): unsure at all n locations
cccacgcgtncgcccacgcgtncgnccacgcgtacgactacttttacaaaatatgcacgtttcttttcccacacactatcttcattcctataaacatcccttttttcataaccctcagagttcccttttccaaaatatccaccttttggggagaccaccggagatatgtacggacggagtgattcttacgaatccgatttggcgcttctggattcgattcgccgccacttgctgggagagtccgaattgatattcggagccccgaatttcggttcgggtcggagctccagtttcagcagcttggactcgtgtttgagtgatgattggggagagcttccgtttaaggaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatccgggacccggcgaagaacggcgctagggtttggctggggacgtttgagacggcggaggacgcggcgttggcgtacgaccgcgccgcctaccggatgagagggtcgagggcgctgctgaattttccgttgagggttaactccggcgagcccgatccggtgagggtgaagtcgaagcggtcgtcgtcgccggaaagtacggcggcgctgccggcgaagagaaagaaagttgtggtggtggggacggtgcaagagcaagtggggagtcaagtggcagagtgtacacgtggcgagcagttattggttagctgaggtggattctaaaactggtgttgtgtttattaaatacaataaatacaatacacttttgtaattatgtgatgtgcgtgtgtgtgtaaagcacttagctatattatagccatcatccaactcaattttggaacaaagaaaaaaaggtgaaggatgaggatagatgattttagcacatcaaatggtgagtggtgtgaccccacgggaagaaaaaaaaaagagggggttcaaagaagatgatgaggaatgacgggggtgaggaactgaggatatgtaatttggctttgtgaatactaccaaatttgtattgttcaaaaaaaaaaaaaaaaaaaaaaaaaaagaaa

SEQ ID NO: 211 - DNA, 915 bp, Glycine max
  Clone ID: PAT_MRT3847_247C.1
gcgatttacaccttcatatcaatgtggtttgttggtggcctgactgcctttcatttatatcttataagtacaaatcagactacatatgagaacttcagataccgatatgatcgacgggccaacccgtataacacaggagtgttcaataatttcttagagatattctgcaccagcattccccaatcaaagaacaatttcagggcaaaggtaccaatggaaccagtattacctgctcgatcggtgggtggaggctttatgagcccgagcatgggaaaagctgttgatgacatagagatgggcaggaaaaccgtgtgggccgacatgggtactgctcttgatccttctgaaggtcaattaaatgaccgcgtggctgtaaaggatggggaatttggtgagttgtctccagaaattaggacaacagtagacgaaactagtcaccgtgccggaatgcatcccaggagatccagctggggaagaaaaagtggaagctgggaaatgtcccctgaagttcttgctttggcagccaaggttggggaatcaaatcgaatgggtggaggtagcagcagtttgaccactgagaacaggcatacatagccactgaaattatattagtctggcaaagggttttatttgttgtaattaaacggtgttacatttctgatgcagtaaatcatcagcaaaattaattgtatttgcaatgtgggggatgagggctttggagggtgtttgttagtgttgttttcgccatattgtgcttctagggagttgttgtgttgttgtgagtgagcttttttcctttgccttgtgttgtatcacgcttcccaattaactatttgtcttaccaattaccaattctgtctttgctaaaaaaaaaaaaaaaaaaaaaaaattgggaattattcttgccactcagct

SEQ ID NO: 212 - DNA, 1369 bp, Glycine max
  Clone ID: PAT_MRT3847_25106C.1
cggagccaccatctcgcttcttccctttgctttgtttcttcacaggtcagagcgtcctccactcacattctctgatagcaaaaagtaggcgtaaggagaaaaaggatgaggtagagagaaggtgggagtggcagagagaagattacaaagaaatggggagatgggtgaattgtaggggcaatatattcccattcctggggatggtgatggctatgctagctcaaagtggaagcatggtggtaatcaaagttgccatgactgatggaataaacaaatatgtcatggttgtgtactctttggcactctccaccatcttgcttcttccctttgccttgtttcttcacaggtcagagcgtcctcctctcacattctctgcactttgcagtttcttcttgcttgcattctttgggagttcaggacagataatggcttatgttggcatagatctaagctctcctactcttgcatcagccatgcttaatctcattccagctttcacttttatacttgctctcatttttaggatggaagaagtacattggagacattccagcagccaagccaagttcttaggaacaatagtatcaattgctggagcatttgttgtgatactgtacaagggcccacccatctttaagacacattcgtcaaactcttcgaacaaatttctattttcgcagcaactaaactggatcttgggagggatgttctgtgctggcgattctatagtttgttccctgtggtacatatatcaggcttcggttgcatacaaataccctgctgtaacaaccatagtattcttccaactcttattttcaaccattcagtgtggagtatttgccttaattgtagttcaagatcaaacggaatgggagctgaagttagatattgggttgattggcattgtatatcaggcaattgctgcaacattgatacgttacatcttatgcacgtggtgcgtccttaaagctggacctctgttctgttctatgttcaagcctgtggcaatcatcttctccgttttcatgggtgcaatttttctcggggatgacttaagccttggaagtttgattggtgcggttataatcgtgataggattttatgccgtactgtggggaaaatccatagaagataacaagattgagaaaggggttgagaacttggagtcatcgtgccataatgttcctttattacaaaataggacgtaacaggtaggttgaatatttgacatggagaacaatgtgatattgcaaaacccttaaaaagttagttagaagttgtaatgtttatgtattggtttttcatgtatctatttttaataataataatatttttgagaaaaatgttttccaaaaatattttttagccc

SEQ ID NO: 213 - DNA, 276 bp, Glycine max
  Clone ID: PAT_MRT3847_25202C.1
aaaatgcttgaaaagtttcaccttgttggtattcctcctgctcccagaggtctgcctcaaattgaggtcacatttgacattcatgctaatgggattgtgactgtctctcccaaagacaagtccactggtaaagaacaacaaataactattcggtcatccggtggactctcggatgatgagattgaaaagatggtcaaagaagcagaattgcatgctcagaaagaccaagagagaaaggctctcattgacattataaacagtgctgacactaccatc

SEQ ID NO: 214 - DNA, 587 bp, Glycine max
  Clone ID: PAT_MRT3847_25688C.1
gacaacacacattcccatcatcacaccaacaacaacacaccatgctcacagttctgcttctcttctcactccttcttaccacctctacttcccacaacataatatcataccctcatttccaacaactcaatgtcaaacaaatcctcacagaaaccaaactcaacccaacaaatacctacaaacacctccaacaccaaaaactcaacattgccaccgaagcatcttcaccggcaaaatataaactgaagctagttcacagagacaaagtccccacgtttaacacctcccacgaccaccgaacccgattcaatgcacgaatgcagcgagacaccaaaagggtcgccgccctccgccgccatctggccgccggaaaacccacctacgccgcggaggcattcgggtcggacgtggtttccggaatggagcaaggaagcggagaatacttcgtgagaatcggagttggaagcccacctcgaaaccagtacgtggtcatggactcaggcagcgacattatatgggttcaatgcgaaccctgcacccaatgcttccaccaatccgaccccgtttaaccccggcgatccttcttc

SEQ ID NO: 215 - DNA, 730 bp, Glycine max
  Clone ID: PAT_MRT3847_25700C.1
ctcgagccgattcggctcgagtaccgagaagacgacagaaggggggagagaaacagttatgcataaagagcaataagaacaaagagtgaaaggatgaggtagctagagagggtgggagtgagtgggcagagagaaggtttcaaagaaatggccacatgggtgaatggttggggcaaattactaccatttctggggatgttgatggctatgctaactcaaagtggaagcatggtggtaatcaaatttgctatgactgatgggatgaacaagtatgttatggttgtatattcaatggcactctccagctccatacttctcccctttgtcttgtttctacataggtcagagcttcctcttctcacagttcctgcacttggaagcttctttttgcttgcactctttgcgagttcagcacatataatggcttatgttggcatagaactcagctctcctactcttgcatcagctatacttaatgtcattccagctttcacttttgtacttgctctcattttcaggatggaagaagtacattggagatattttagcagccaagctaaagtcttgggaacaatagtgtcaattggtggagcatttgttgtgatactgtacaagggtccacccatctttaggacacattcatcatacacttcaaacaaactttaattttcgggacacccaaactggatcttgggagggatatttttggttgctgattctttccttagtt

SEQ ID NO: 216 - DNA, 1732 bp, Glycine max
  Clone ID: PAT_MRT3847_25891C.1
gttgtaaaaaagattcatgttcagttagtatcttgtgaaggcgatcgaatactagaaagaaacaaatcgatcaagcttgaaagataggaagaatttaagaaatgggtgaggaggaaatagatgattctcccttgattcaaggttttccttccggcgacgtgccatttaggagaactggtaatgtagagagggcagtagcacatataataactggtgtgataggggcaggggtgctgtctctagcatggtctgtggcacagttagggtggattgctggtccttttatcatcatagtctttgcaggaacaacctttctttcagcaaaccttctttctgactgctacagattccctcatcctctctatggcaacattaggtgcccctcctacattgatgctgtcaaggtttacctaggagactcaaggcaaaaggtgtgtggagtgctggtgcatgcgagcttatatggtgccaccacggcctatgtcattacatctgccaccagcatcagagcaatactgaaatcaaattgttatcacaaggaagggcatcaggctccttgtaaatatggggatgcagtatatatgatgctgtttggactagttcagatcataatgtcattcataccagatctccacaacatggcatgggtttcaattgttgcggccataatgtcctttacatactcatctattggacttggacttggcatcacaacagtaatagaaaatggaagaattatgggtagtttaacaggagtaccggcttcaaatattgctgacaagttatggttagtcttccaaggaattggtgatattgcctttgcctatccatacacagtcatcctccttgagatacaggacactctagagtctcctccaccagaaaacaagaccatgaaaaaggcctccatgattgctatcctcattacaacattcttctacctctgctgtggatgctttggatatgcggcttttggaaatcaaacaccaggaaacctcttgacagggtttggattttacgagccttactggctcattgactttgccaatgcttgcattgttcttcacttggtaggaggatatcagatttacagtcagccgatatatggtgctgttgacagatggtgttcaaaaagataccccaacagtggatttgtgaataatttctaccaattgaaactgcctcggttgccagcttttcagctaaacatgttcaggatatgttttagaacagcttatgtggtttccacgactggacttgcgatcctatttccttacttcaatcaagttataggagtgttaggagccttaggcttttggccattggctatatatttcccggtagagatgtactttgtgcagaggaaagttgaagcttggtctagaaaatggattgtcctcaggaccttcagctttatttgctttctggtgtcattactgggtctcattggatcacttgaaggaatcataagcgagaaactaagctaatgaagggtgcttcatttgtttgagtttaatgtcttgttgctcatatcttccatgtaattcagtttcatgctaattctattactattgagagttaataaaggggataccaattatgtggggatgtgtcaaaatgaaggtggtgttgagcatggtatagttctgtttggtgaagaactccctttaaaggtgtaatgctacataaacaactctctatgcacataaacttgtattgatactggattatt

SEQ ID NO: 217 - DNA, 2263 bp, Glycine max
  Clone ID: PAT_MRT3847_26125C.1
ggctcgagacgtaagctagctttggcatctttttcccctttttcctccaagcctataactatattcaacccaatctgcactggactcaagtgtaaaaagacattttcctgatcttctgctgtgccaagaaagcagtaatctccatgagcttctattgaattgatactttgatcaagatggatgggaaaaactctcttcaaataactagaagtggtattggtgcttatgatgatgatggacatgccaaaaggactgggaatttgcagagtgctgtagctcatatcattactgctgttattggttctggtgttctttctcttgcatggagcacttcccaattaggatggattggagggccattttccttgctttgttgtgcaattgtcacctatatttcttcattcctcctgtctgattgctacagaactcctgatcctgtcactgggaaaagaaactactcttacatggatgctgttagagtttatcttggttataaaaggacatgtgtagctggcttccttcaatttttgactttgtatgggactagtattgcttatgtactaaccacagcaaccagtctgagtgcaattctgagatcaaattgctatcacaagaaagggcatgaggctccttgcaaatatgggggcaatctgtatatggcactgtttggacttgttcagattgtaatgtcattcataccggatctccataacatggcatgggtttcagttgttgccgcacttatgtcctttacatactcattcattggactaggacttggcatagcaacagtcataaaaaatggaagaattatggggagcttgacaggaataccaactgataaaattgctgacaaattttggttggtcttccaagcacttggtgacattgcctttgcctatccatactccattctccttcttgagatccaggacactctagagtctcctccaccagaaaatcaaacaatgaaaaaggcttccatgattgcaatcttcattacaacattcttctacctgtgctgtggatgctttggatatgcagcttttggaaatgatacaccaggaaacctcttgacagggtttggattttttgagcctttctggctcattgaccttgctaatgcttgcatcattcttcacttggtgggaggatatcagatttacagtcaaccaatatacagtactgttgacagatgggcttcaagaaaattccccaacagtggctttgtgaataatttctacagagtgaaacttcctttgcttcctggttttcagctaaatcttttcaggttctgctttagaacaacctatgtgatctcaaccattggtcttgcaatctttttcccttacttcaaccaaatcctaggagtgttaggagccataaacttctggccattggctatatatttcccagtagagatgtactttgtacagcagaaaattgcagcttggagtagcaaatggattgttcttagaacattcagctttgcttgctttctggtcactgtaatgggcttggttggctcacttgaaggaatagtaagtgccaaattaaaatagctgaaagcctgaaaggttgtttatgccactccccttagtaatgcttactctatttgagtttgtagattgatggttatataatgtttcatataaaaaagtttaaagctgaatgctagtgttattgagagtaagatagagtacaagcaattgtgggggatttcagaaagtgaataaagtggtactgccagtgccattggaataatacaagttttgtttgatgaagaactcacctcaaaggagagaattctaacaaatttgtagtttgatattaatgtaattgtactgtatcatcaaatagattatatcaaattttaaattaatgattattcatatcttccatgtaattcagtttcgcattaattctattactatttactattgagagttaataaaggggataacaattatgtggggatgtgtcaaagtgaaggcgttgtggacgtggaatagttctgttgggtgaaaaactccctttaaagaaagtgtaatgctacacaaacaactccacataaacttgttgataactgctaaatatctgtgaatttataggaattaattagtcaaattttggcttaaaattagttatttagcagttatttgtaattaaaagtgagaaaattaatttaaattgaatttctggttgcagatacgaaaaataaggtcgcatttagcaaaagtggcacagaaaggaagaaaaaaag

SEQ ID NO: 218 - DNA, 1879 bp, Glycine max
  Clone ID: PAT_MRT3847_26127C.1
ggctcgaggacatggtcctaaagtctggcctgagatgaatataaaatggactaatcttcttctggcttgttttcttcagaatcatgggggttacacagagttacaaattgctgcaaatggaataacttgttttcttcagtggcttctctctacctctcacctgaaatcaacttgtaatcttcatgagcttgcattgaattgatactttgataaagatggatgggaaaaaatctctacaaataactagaagtggtactggtgcttatgatgatgatggacatgccaaaaggactgggaatttgcagagtgctgtagctcatatcattactgctgttattggttctggtgttctctctcttgcatggagcacttctcagttaggatggattggagggccagttgcattgctttgttgtgcaattgttacctatatttcttcattcctcctgtctgattgctacagaactcctgatcctgtcactgggaaaagaaactactcttacatggatgctgttagagtttatcttggttataaaaggacatgtgtagctggcttccttcaatttttgactttgtatggtactagtattgcttatgtactaaccacagcaactagtctgagtgcaattctgagatcaaattgttatcacaagaaagggcatgaagctccttgtaaatatggtggcaatctgtatatggcactgtttggacttgttcagattgtaatgtcattcataccggatctccataacatggcatgggtttcagttgttgcagcacttatgtcctttacatactcattcattggactaggacttggcatagcaacggtcataaaaaatggaagaattatgggaagcttgacaggaataccaactgataaaattgctgacaaattttggttagtcttccaagcacttggtgacattgcctttgcctatccatactccattctccttcttgagatccaggacactctagagtctcctccaccagaaaatcaaaccatgaaaaaggcctccatggttgcaatcttcattacaacattcttctacctgtgctgtggatgctttggatatgcagcttttggaaatgatacaccaggaaacctcttgacagggtttggcttttttgagcctttctggctcattgaccttgctaatgcttgcatcattcttcacttggtgggaggatatcagatttacagtcaaccaatatacagtactgttgatagatgggcttcaagaaaattccccaacagtggctttgtgaataatttctacaaagtgaaactgcctttgcttccaggttttcagctaaatcttttcaggttctgttttagaacaacctatgtgatctcaaccactggtcttgcaatcttttttccttacttcaaccaaatcctaggagtgttaggagccataaacttctggccattggctatatacttcccagtagagatgtactttgtacagaacaaaattgcagcttggagtagcaaatggattgttcttagaacattcagctttgcttgctttcttgtcactggaatgggcttggttggctcacttgaaggaatagtaagtgccaaattaaagtagctgaaagatttatgccactccccttagtaatgcttactatatttgagtttgtagctagattgatggttgtataatgtttcatgtaaaaaagtttaaagttgatgctaagattgttgagagttagatagggagtaagcaattgtgggggatttctgaaagtgaataaagtggtactgtagtctttggaataatacaagttttgttttatgcagaactcacctcaaaggagagagttcaaacgaatttgtagtttgatattgatgttattgtgctgtatc

SEQ ID NO: 219 - DNA, 675 bp, Glycine max
  Clone ID: PAT_MRT3847_26404C.1
aacttagccaactatatcttgggagtaagcatgccaggaaaaattcctatagaattaggaaatttaattagcttagcgctcttgaacatggcatataactactttgaaggaaaaataccaattgaaattggctctcttcagaagcttcaatacttttatgttgcaaaaaacaacttaacaggagaagtcccaccatccatagggaatctttcatccctgattgagctctcggtaggtttgaacaacttagagggaaagattccacaagaagtttgtagcctcaaaaacttgtcactgatgtcagtgcctgtcaacaaattgtctggaaccataccctcagaggtttttagcctttcctcactaacaaatttgctggacttatcacagaactccttgagtggtagtttaccaaatgtagtgagcaagttaaaaaatcttgagaagatggatgtctctgaaaatcatctgtctggtgatattcctggaagcattggagattgcacaagcttggagtacctttatttgcaagggaattctttccatggaatcatacccaccactatggcttcactgaaaggtcttagacgtttagacatgtcacgaaaccacttatctggatcaattcctaaaggtctgcaaaatatttctttcttggcatacttcaatgcatcattt

SEQ ID NO: 220 - DNA, 1215 bp, Glycine max
  Clone ID: PAT_MRT3847_26633C.1
aagatggaacgaagtggcggaatggtaacggggtcgcatgaaaggaacgaacttgttagagttagacacggttctgacagtgggtctaaacccttgaagaatttaaatggtcagatttgtcaaatatgtggtgacaccattggattaacggctactggtgacctctttgttgcttgtcatgagtgtggcttcccactttgtcattcttgttacgagtatgagctgaaaaatgtgagccaatcttgtccccagtgcaagactacattcacaagtcgccaagagggtgctgaagtggagggagatgatgatgacgaagacgatgctgatgatctagataatgggatcaactatggccaaggaaacaattccaagtcggggatgctgtgggaagaagatgctgacctctcttcatcttctggacatgattctcatataccaaacccccatctagtaaacgggcaaccgatgtctggtgagtttccatgtgctacttctgatgctcaatctatgcaaactacatcagatcctatgggtcaatccgaaaaggttcactcacttccatatgctgatccaaagcaaccaggtcctgagagtgatgaagagataagaagagtgccggagattggaggtgaaagcgctggaacttcagcctctcggccagatgccggttcaaatgctggtacagaacgtgctcaggggacaggggacagccagaagaagagagggagaagcccagctgataaagaaagcaagcggctaaagaggctactgaggaatagagtttcggctcagcaagcaagggagaggaagaaggcatatttgattgatttggaaacaagagtcaaagacttagagaagaagaactcagagctcaaagaaagactttccactttgcagaatgaaaaccaaatgcttagacaaatattgaagaacacaacagcaagcaggcgagggagcaatagtggtaccaataatgctgtgtaaacttatagatggagtagatatagagagagagaaagaggaaagaaattaaacattcgttgatgattctttctaggtgtgcgtttggaatacaatgaagtaaaggatgaaccttaagacatgctttgtcctaaaatagtgtgatctgatgtaccattgttgatgagtaatgtaattatcatacacagttttttacagtctcattttaattaataattatcaaactacttgatt

SEQ ID NO: 221 - DNA, 1875 bp, Glycine max
  Clone ID: PAT_MRT3847_26634C.1
ctcgagccgaatcggctcgagtacggctgcgggaacaacaacaacggaagaaagagagagagagagagagagagaggtgtgaagttggtgaaggtttttgagaagaaagatggaacgaagtggcggaatggtaactgggtcgcatgaaaggaacgaacttgttagagttagacacggctctgatagtaggtctaaacccttgaagaatttgaatggtcagagttgtcaaatatgtggtgataccattggattaacggctactggtgatgtctttgtcgcttgtcatgagtgtggcttcccactttgtcattcttgttacgagtatgagctgaaacatatgagccagtcttgtccccagtgcaagactgcattcacaagtcaccaagagggtgctgaagtggagggagatgatgatgatgaagacgatgctgatgatctagataatgagatcaactatggccaaggaaacagttccaaggcggggatgctatgggaagaagatgctgacctctcttcatcttctggacatgattctcaaataccaaacccccatctagcaaacgggcaaccgatgtctggtgagtttccatgtgctacttctgatgctcaatctatgcaaactacatctataggtcaatccgaaaaggttcactcactttcatatgctgatccaaagcaaccaggtcctgagagtgatgaagagataagaagagtgccagagattggaggtgaaagtgccggaacttcggcctctcagccagatgccggttcaaatgctggtacagagcgtgttcaggggacaggggagggtcagaagaagagagggagaagcccagctgataaagaaagtaaacggctaaagaggctactgaggaaccgagtttcagctcagcaagcaagggagaggaagaaggcatacttgattgatttggaaacaagagtcaaagacttagagaagaagaactcagagctcaaagaaagactttccactttgcagaatgagaaccaaatgcttagacaagtacattcatgttatcattgtcatcatcataacgttatatatacatgtctctagctcatcactgtcaccatgatgatgcaattgttctttaagtgggctgcctgatcttatttactttcgataaaattgacacaccaaaaccttttaaaatggaatcatgactaactcttgtctattgttgacttgtactctaaaaatttgttttagaaaggaacaaaggggatattcatgttatataaaatatgtccattatcattagtaacatattagactttagataggactttgtgatatcatatcaaatatggtttaggaaactgtgtgttggttcaagtggaaggaattcaagttcttttaaggatgttttactgggttatactgagattaatttgcatggaaaaaataccaagattcatatgcttgtaacttctcctatgtgccaataccaaaccataatttgcatactatgtgtcacttttgtctggctttattttgctcaatcaggcaattgctttgcagatattgaagaacacaacagcaagcaggagagggagcaataatggtaccaataatgctgagtgaacataatgtcaaaagatggcagagaaaacttatagatggaatagatttagaaagagagaatacattagccagaaagagaaaaaaaaattggacattagttgatgattctttctaggtgtgcgtttggaatacaatgaagtaaaggatgaaccttaagacatgctttatcctaaaatagtgtgatctgatattccattgttaatgagtaatgtaattatcatacaaacaatttgtagtctcattttaattaataattattaaactacttgatt

SEQ ID NO: 222 - DNA, 497 bp, Glycine max
  UNSURE (1)..(497): unsure at all n locations
  Clone ID: PAT_MRT3847_26863C.1
  unsure (1)..(497): unsure at all n locations
ccacgcgtccgcaccaatacactacaccataccagaaggagcaaaaataagacgagatggcggacgagcgcttgcctcaaacggccggcgcccgcacggctctcgccagagctactggatcctcggcacggaaacgcgcccgcgatagttaggtgcgcctgtgggcccggccggctcgtcacttacataggcgcacgcacccccgcctggtgcgtcgtcgatcgctgctttgctggcgcgcggcggccctgtgtggcacagtagaggtctgctgaggacgacgaccggaggcgtgctgcgtggatggtcctcatggccgggatgctccccggcgtggagtgcgcgcggcggcggcgggtccggcagggcggtgcggtgatgggagcggaggcggcccgaggaggcacggngcggcggtcctccttctgcctgtacgcggccggccacggcggcgccggcaattctggcaagcggagcggcggcgtggtgcaacggca

SEQ ID NO: 223 - DNA, 202 bp, Glycine max
  Clone ID: PAT_MRT3847_27175C.1
caagagcgaggccgtgctctcctacgtctgcgacggaatcctcaaactcctcgacacgcgcctcgtcccctccgccgcctccggcgactccaaggtcttctacctcaagatgaagggagactaccacaggtaccttgccgagttgaagaccggcgctgaccgtaaggagggcgtcgtaatcacgctttccgacttacaaagc

SEQ ID NO: 224 - DNA, 708 bp, Glycine max
  Clone ID: PAT_MRT3847_27189C.1
tgatcttctactctctgggtatggcattgtccaaggatatatctgacgttaaaggagataaagcatacggcatcgatactttagcgatacgtttgggtcaaaaatgggtattttggatttgcattatcctttttgaaatggcttttggagttgccctcttggcaggagcaacatcttcttacctttggattaaaattgtcacgggtctgggacatgctattcttgcttcaattctcttgtaccaagccaaatctatatacttgagcaacaaagtttccactatatcgttttatatgttgatctggaagttgttgtacgcagcatactttctcatggctttaattagataaggatgttgaggaaggttaaagcaatgttcatagcacatttggcagaataaaaagaatatggtatgcatctaaatttattaaaacaataaaaactgtagagatgtgtgtaccctggatagtaatttgcgaaccattaaactctttttttaattgtgtgaagactttaattatatatattctcgtgaagactgacttctatatcatcaaatatttgtaagtgcatggaagtcaatctgatttgagggatgcttctagttcatatgtgaaggaagaaagaatagaggaagttcacttctgtgttcaagtgaaagaaaaaaaaaaaaaaaaaaaaaaaaaaaaaaaaaaaaaaaaaaaaaaa

SEQ ID NO: 225 - DNA, 355 bp, Glycine max
  Clone ID: PAT_MRT3847_27885C.1
aaccctccttcaaggtcaaaaaaaccaaccaaaaatctagggttttcacaaaaaaacttaggaaaaagctcaactcaagggccggacttattgaaagggacaaaaaaatctgggtctacttctacccattaaaaattcactacaacaaggtctaatgcatggaactaggggggggaggaccggggcatttggaaaaccatgttctggggctgggggcccaagtaaaaaaacccaagaaaattctgccccccaattttaaccccaagaggggtttgcccccttaggagacatgaagactctttgttgacccggggggggaggctcggctcgtgcggggggggggccgggggggccc

SEQ ID NO: 226 - DNA, 1829 bp, Glycine max
  Clone ID: PAT_MRT3847_28411C.1
gccggacgcgtgggctgcgagaagacgacagaaggggatcacgcaaaaggatggatgatggaagaaacaaagagaagggaaatatcaggaggtgcgagtaccggagccaaacgcgggtgtgtgtgtgtgtgagggagagagagatgcagttccattcagaaactccaaactaaacatccctggcgacaaccttaggaatctcgatcgctgaaaaaacctatgcagccccgaacacactctctgcattccaacttgtttaagtcatgcctttcgattcacccttctctcaataaatttttaatcagattcttggccaccgccacactcataataaagttttgtttttccaaataaagggaatggcgactcctgttgagcctccaaatgggatcagaactgaagggaagcattattattccatgtggcaaaccctgtttgagattgactcaaaatacgttcccatcaagccgattggtcgcggagcatatggaattgtgtgctcttctgtgaatagagagataaatgagaaggttgccatcaagaagatacagaatgcctttgaaaaccgggttgatgccctgaggactttgcgcgaactcaagcttcttcgccaccttcaccatgagaatgtgattgctttgaaggacatcatgatgcctgttcacaggaatagtttcaaggatgtctatctggtttatgaactcatggacacggatttgcatcagattattaagtcttctcaagctttgtctaatgatcactgccagtatttcctctttcagttgctccggggcttgaaatatcttcactccgctaacattcttcatcgtgacttgaaacctgggaatcttctaatcaatgcaaattgtgacctaaaaatatgtgatttcgggctagctcgtactaattgcagcaagaaccagttcatgaccgagtatgttgtcactcggtggtatagggcaccagagctcctactctgctgtgacaactatgggacatctattgatgtttggtcagttggatgtatctttgcagagcttcttggccgaaaaccgattttccctggttcagagtgtctcaaccagctgaagttgattatcaatatccttggtagtcaaagggaggaggatattgaattcattgataacccaaaggcaaagaagtatatcaaatcacttccttattctcctggaacccccctttcgcaactttatcctaatgcgcatccattggcaattgatcttctggcaaagatgcttgttttcgatccaacaaagaggatcagtgtcactcaagcacttcaacacccttacatggcccctctgtatgatcctaactgtgaccctccagccgtcattccaattgatcttgacattgatgaggatctaggggaagagatgataagggacatgatgtggaaagaaatgcttcattaccatcctgaatctgctatggagagtgcagggttgtgctaatgatatttacttcctttcatagttatgttcccttttgttggtgccaggatagttctaatatcataacttgcttcaaataattaggagggctttgtcatcagtgagctccttatatgttctgttttctatttattgaaagcagagagaaacagcaaaaagatgaccatcttaaaaaaaaatgtgttattgctgatgatgcattgtagtctttaaacgccatgttgagagattgattttgtactgaactttgtattgtagttgccttgttttgttgtacataattatgtttctgtgtctttcataaaccattttgtaaattaagtctaatgtttatcaataatgtgttattgtttg

SEQ ID NO: 227 - DNA, 365 bp, Glycine max
  Clone ID: PAT_MRT3847_28504C.1
aacatgaaacttgctgaagatgttgatttggaaaaaatagccaaggatactcatggttatgttggtgctgatctagctgctttgtgtactgaagctgcacttcaatgcatcagagagaaaatggatgtgattgacttggaagatgagacaattgatgctgaaatattgaactccatggcagtgacaaatgagcatttccagactgctcttggatcaagcaatccttctgctctacgtgaaacggttgttgaagtgcccaatgtcagctgggaagatattggtggtctgaaaatgttaagagggaactccaagagactgttcaatatccagtggaacaccctgaaaaatttgagaatttggaatgt

SEQ ID NO: 228 - DNA, 2516 bp, Glycine max
  Clone ID: PAT_MRT3847_29389C.1
ccacgcgtccgctctctataaaagcgcttccttctcatttggaacctattccattctctaaaccctaaacgactctatctctcttcgttttgttcttccttgcgctcctcctcgttcgttcgttctccctcgcgtagatcggcaatggcggagaccgagacgtttgctttccaggctgagatcaaccagctcctcagtctcatcatcaacaccttctactccaacaaggaaatcttccttcgtgaactcatcagcaacgcctctgatgctttggacaagattagatttgagagtttgacggacaagagcaagctcgatgctcagccagagttgttcattcatattattcccgacaagactaacaattcgctgaccattgttgacagtggcattggcatgaccaaagctgatttggtaaacaacttgggtacaattgctaggtctggtaccaaggaattcatggaagccttggctgctggtgctgatgttagtatgattggacagtttggtgtggggttctactctgcatatcttgttgccgaaaaggtcattgttacctccaagcacaatgatgatgagcagtacgtttgggagtcccaagctggaggttcattcactgtcaccagggatacctctggtgaggttcttggcaggggtactaagatcactctcttcctcaaggaggatcagctagagtaccttgaggagcgccggttgaaggatttgattaagaagcattctgagttcattagctacccaatttctctttgggttgagaagactaccgagaaggagatttctgacgatgaggatgaggaagagaagaaggatgaggagggtaaggtggaggatgttgatgaggagaaggagaaggaagaaaaaaagaaaaagaagatcaaggaagtgtcacatgaatggtccttggtgaacaagcagaagcctatttggatgaggaagcctgaggagatcacaaaagaggagtattctgctttctacaagagtcttaccaatgactgggaagagcatttggctgtcaagcacttctctgttgagggtcagttggagtttaaggctatactctttgttcccaagagggcaccttttgacctctttgacacaaggaagaagcctaacaacattaagctctatgtccgccgtgtctttattatggacaactgtgaggagttgattcctgagtatttgggctttgtcaagggtattgttgattctgaagatctcccactcaacatttcaagagaaatgttgcaacagaacaagatcttgaaggtcatccgtaagaacttggtcaagaagtgccttgagctcttctttgaaattgcagagaacaaggaggattacaacaagttctatgaggctttctctaagaacttaaagcttggtatccatgaggattcccagaacaagggaaagattgctgaattgctcaggtaccactccaccaagagtggtgatgagctgacaagcctcaaggattatgtgaccaggatgaaggaaggtcagagtgacatctactacatcaccggtgaaagcaagaaggctgttgagaactccccattcttggagaagttgaagaagaaagggtatgaggttcttttcatggttgatgccattgatgaatatgctgttggccagctcaaggaatttgagggcaagaagcttgtctctgccaccaaggagggtctcaaacttgacgagagtgaagatgagaagaagaagcaagaggagttgaaggagaagtttgacaacctatgcaaggtgatcaaggatgttttgggtgacaaggttgagaaggttgtagtctctgaccgtgttgttgattcaccatgctgtctggtgactggagaatacggttggactgcaaacatggaaaggatcatgaaagctcaagccctaagggacaacagcatggcaggatacatgtcaagcaagaagacaatggagatcaaccctgagaacccaatcatggaggagctcaggaagcgtgcggatgctgacaagaacgacaaatccgtgaaggaccttgttctgttgctgttcgagactgctcttctcacttctggtttcagccttgacgaacccaacacttttggaaacaggatccacagaatgttgaagcttggactgagcatcgacgaggatgcagctgaagctgatgctgatgctgatatgcccccactggaggaggaggctgaagctgatgctgagggcagcaaaatggaggaggttgattaaacttttatatcatgcggaacggagttggctatgttttttctctttttttcctttcggattgctctgacagtgtttaatggataattagctaattagctataatttcgtggttctatttgcgagttcttggttgtagctttttttttttagttggatttctggcgttttctgaaattcatgataattttctggatggctttgctaacttgtccatgatcacatctttaatcgtgttatttaaacaattaattcttttctaactt

SEQ ID NO: 229 - DNA, 2554 bp, Glycine max
  Clone ID: PAT_MRT3847_29390C.1
aagagaattaactgtgttgattgacacgataaaagatgatcatgtccaagttagcaaggcatcccctgagtgcaattgttgtcaacactgcagattgaaaattatcatgaattccacaaaacgccataaatccaactaccaaaaaagctactacaaccaacaactcaaaaatagacccgcgaaattatagctaattagctaaatatccattgaacactgtcatcaatccaaaataaaaaaaaggagaaaaaaacatagccaaaaaaggcattagagacgctactaacaagaaacgcatcatatttaattttaatcaacctcctccatcttgctgccctcagcatcagcctcggcctcctccagtgggggcatttcagcatcagcttcacctgcatcctcgtcaatgctcagtccaagcttcaacattctgtggatcctgtttccaaaagtgttgggctcgtcaaggctgaaaccagaagtgagaagagcagtctcaaacagcaacagaacaaggtccttcacggatttgtcattcttgtctgcatcagcacgcttcctgagctcctccatgattgggttctcagggttgatctccatggtcttcttgcttgacatgtaccctgccatgctgttgtcccttagagcttgggccttcattatcctttccatgtttgcggtccaaccgtattcgccagtcacaagacagcatggtgaatctacaacgcggtcagagaccacaaccttctcaaccttgtcacccaaaacatccttgatcaccttgcagaggttgtcaaacttctccttcaactcttcttgcttcttcttctcatcttcactctcgtcaagcttgagcccttccttggtggcagagacaagcttcttgccctcaaattccttgagctgaccaacagcatattcatcaatggcatcaaccatataaagaacctcgtatcccttcttcttcaacttctctaagaatggagagttctcaacagccttcttgctttcacctgtgatgtagtagatgtcactctgaccttccttcatcctggtcacataatccttgaggcttgtcatttcatcaccactcttggtggagtggtacctgagcaattcagcaatctttcccttgttctgtgaatcctcatggatacctagcttcaagttcttggagaaagcctcatagaacttgttgtaatcctccttgttctctgcaatttcaaagaagagctcaaggcacttcttaaccaagttctttctgatgaccttcaagatcttgttctgttgcaacatttctcttgaaatgttgagtggtagatcttcggaatccacaatacccttgacaaagcccaaatactcaggaatcaactcctcacagttgtccatgataaagacacggcggacataaagcttaatattgttaggcttcttccttgtgtcaaagaggtcaaaaggtgccctcttaggaacaaagaggatagccttaaactccaactgtccctcaactgagaagtgcttgacagccaaatgctcttcccagtcattggtgagactcttgtagaaagcagaatactcctcctttgtgatctcctcaggctttctcatccaaatgggcttctgcttgttcaccaaggaccattcatgtgacacttccttaatcttctttttctttttttcttccttctccttctcttcgtcaacatcctccaccttaccctcctcatccttcttctcttcctcatcctcatcatcagagatctccttctcagtagttttctcaatccaaagagaaattgggtagctaatgaactcagaatgcttcttgatcagatccttcaagcgacgctcctcaaggtactcaagctgatcttccttgaggtagagagtgatcttagtacccctgccaagaacctcaccagtgttatccctggtgacagtgaaagaacctccagcttgagactcccaaacatactgttcatcatcattgtgtttggttgtaacaatgaccttctcagcaacaagatatgcagagtagaaccccacaccaaactgtccaatcatactaacatcagcaccagcagccaaggcttccatgaattccttggtaccagatctagcaattgtacccaagttgttcaccaaatcagctttggtcatgccaataccactgtcaacaatggtcagtgtattgttagtcttgtctggaataatatgaatgaacaactctggctgagcatcgagcttgctcttatctgtcaaactctcaaatcgaatcttgtccaaagcatcggaggcgttgctgatgagttcacgaaggaaaatctccttgttggagtagaaggtgttgatgatgagactgaggagctggttgatctcagcctggaaagcaaacgtctctgtctccgccattgtcgatctacgcgagggagaacaacgagcgaaggaagaagagaaagagttgtttagggtttagaggaagaaaatgggaataggcaccgaatgaaagaaggaagaggttttatagagagggttcactactagggtttctagatcc

SEQ ID NO: 230 - DNA, 322 bp, Glycine max
  Clone ID: PAT_MRT3847_29691C.1
ggcaagttataaaaaccaatactattatcatggtctcatagttaacgactatggcaaccttgagaagaaaaccgacaaatacggcaaccctgttcatgctgctagagtcacctatgtatccaccataactgctgatggtggatacaatgatgacattaataagcaacatgattccaccactgcctacggcgtatacactggtagacagcattctagtgttggctccgatggtgacactgataaatattatggaactactggtggctataatgatgactccaacttacgtcatgaaactaccggtgtatatagtctacacact

SEQ ID NO: 231 - DNA, 3071 bp, Glycine max
  Clone ID: PAT_MRT3847_30033C.1
ttctttccacgcgtccgcccacgcgtccgcccacgcgtccggtccactggtttgagaaatttaattggttcattagcagtgagaactatttggttatcagtggacgtgatgcacagcaaaatgagatgatagtgaagcgttatatgtcaaaaggagatctatatatacatgctgatctgcatggagcttctagtacagttatcaagaatcacaagcctgcacaaccagttccacctctgaccctaaaccaagctggatgtttcaccgtctgccatagccaggcctgggattcgaaaattgttactagtgcctggtgggtttatcctcatcaggttagtaaaactgctcctacaggcgaatatctgacagtagggagtttcatgatccgtggaaagaaaaattttcttccaccacaccctcttatcatgggttttggcctactatttcgcttggatgagagttccttgggatctcatttaaatgaaagaagagtaagaggagaggaggaagcagcagatgattatgaagaaactggccctcttgaagataaatctgattcagagtctgagaaggatgtcactgatatagaacctgccactgacttggaaaggaatggtaatttgtcagcagattcacacaaacccctaccagaagacttccctgcagatccatcccaaactagtttggctactaccgatgccgaaactgcaatttcacaggattttcctgcgaaagagacaagtacattgaatatggttgatagggagatattatcaggcgcgggtggaaatggcttagcatctgtgacccctcaacttgaggaacttcttgatcaagttctggaacttggacccattgctaaatcaaataaaaaatatggaattgagaagtctcaaattgatttagacactgaacaatatcttgaacaaagcaaaactgcagtaagggataaaccttatatatcaaaagctgagagacgaaagcttaaaaaagaacagaaacatggagaagaagatttgaatgttgaacatggaaagtatgaatcaaagctaaaagatatttctgctaatctacaagcgaaagaagatcaaaatttgaaaaaaggtggtggtcaaaaaatcagccgtggacagaagggaaagcttaagaagataaaggagaagtatgctgaccaggacgaggaagaaaggagcatccgaatggcattgttagcttcttctggaaaatcaatcaagaaggaagagacatcatctgaaaatgatacattggaccaagggaaaaaacctggcagtggtccttctgacgctccaaaagtaccttctgatgctccaaaaatatgttacaagtgtaagaaggcaggtcgcacttatctcgggattgtaaggagcaaccagatggtcttttgcataggaatgcaattggtgaagctgaagaaaatcccaaatcgactgctattgacacttcccaagcagatagggtggcaatggaagaagatgatattaatgaccacatgggtagacgcctcttcaacaacccttgttttgttctgtgcaagtgatcttgaaaggaacaacaatggtgaagtctataaactttctcctgcttctgtctctactagcctttgttccaaactcttcttcaacaacccttcttttgatctgtgcaagtgatcttgaaaggagggaacaacaatggtgaagtctataaactttctcctacttctgtctctactagcctttgctcccttatgtcactgtaaaaagaaaataggaggttacctctaccctcaattctacgacggttcatgccccagagctcaagagattgtccaatccatcgttgccaaggcagtggcaaaagaaccccgcatggctgcttcgttgctcagactacatttccatgattgttttgtcaagggctgtgatgcatcggtgctgctagatagcagtgttttggctctagctgctagagattccactgttcttaccggaggaccaagctggggagtacccttgggcagaagggactctcttggtgcgagtattagtggctccaataacaacattcctgctcccaacaacacatttcagaccatcttaactaagttcaagctgaaggggcttgacattgtttatctagttgctctatctgggagccacactataggaaattcccgatgcaccagcttcaggcaaagactatacaaccaaacaggaaatggaaaagcagacttcactcttgatcaagtgtatgctgctgaattgcgcactaggtgtccaagatctggtggggaccagaatctctttgtcctagactttgttaccccaattaaatttgacaacttctattacaagaacttgttggccaacaagggtctcttaagttctgacgaaattctcttgacaaagaatcaagtatcagcggatttagtgaagcagtatgcagaaaacaacgatcttttctttgaacaatttgccaagtccatggttaagatgggaaacattactcctttaacagggtcaaggggagagatcagaaagaactgcagaggaattaacaagtgatgtagtgatatcattgtcatgtgacacgtgtgaaagttgcacctacattttacttttcttcctcttgtttactgcattaaaaaacaggagtgtcaattgatcaattctgtggtgagttgaggaagtcataagcagtgtcgtgatgttccttgaatatccttttgatagcgttgctgtgtgtttaaattaaatttatgtgcttagatgtttcaaggtcaggcttgaaatttgaattgatagctggaacttggaatttatgtaggtattcaagtttaaataaattttatatcatttctcatgttgaataaaattaattccaataaattttatttttccttgtcatagaattgattgttcaagtagtaggaatttatgtaggtattcaagtttaaataaaatttgtatcacctttcatgttgaataaaatagaattccaataaatttttattgcccaaaaaaaaaaaaaaaaaaaaaaaaaaaaaaaaaaaaaaaaaaaaaaaaaaaaaa

SEQ ID NO: 232 - DNA, 1081 bp, Glycine max
  Clone ID: PAT_MRT3847_30133C.1
acgaagctcggaattcggctcgagctaactggcaactaattaacgtgtttgggactcgcgagttgtgcattcctaacacccatttctgggcccaggcattggtgggttcttaccctttattattattattattggagatgactagaaagaggatacagatcaagaaaatcgacaacatcagttccaggcaagtgactttctccaagagaaggaaagggcttttcaagaaggctcaggaattgtcaaccctttgtgatgcagacatagctctcattgttttttctgcaactagcaagctctttgagtatgccagttcaagtatgcatcaagtaattgaaaggcgcgatagccattcagcaatgaatagactggatcgcccctcaattgagctgcagattgagaatgactccaatgaaatcctgcgcaagaaagtagaagataagaaccgtgagctgaggcagatgaatggggaagatctgcaaggattgacattacaagaactgcataaactagaggaacaccttaaaagaggtttgatcaatgtttcaaaagtaaaggatgaaaaacttatgcaagagatcagcacgcttaagagaaagggagtggaactaatggaggaaaaccaaagactgaaacaggtggtaccgagccttatccatgtacataggcaatcatcggaatccattcttagcaattcatctaaccttcctgaagatggtggtagcgacacatctctcaagttggggttaccttaagtattcaacaaaatgtagattattagaagtgaccgggttcgcttcctttatatatgttttaagtgtttcactcaaaaccagttgagtccagtgatgtttgctgtttaaaaacaactcctgcaaagtaagtaaatcctagggatgaggttctgcaggcagaattgcatgtacttgaattcgtattctattttcttttcgtagattgattcataggaagtgttatatatgcccgagttaatggtcaatgctttggccgtttcttactttctatactttgtcatcataaaaaaattattcttacctaaaaaaaaaaaataccccaggct

SEQ ID NO: 233 - DNA, 864 bp, Glycine max
  Clone ID: PAT_MRT3847_30135C.1
ctaactggcaactaattaacgtgtttgggactcgcgagttgtgcattcctaacacccatttcaggaagcccaagcattgggagatgactagaaagaggatacagatcaagaaaatcgacaacatcagttcgaggcaagtgactttctccaagagaaggaaagggcttttcaagaaggctcaggagttgtcaaccctttgtgatgcagacatagctctcatagtcttttctgcaactagcaagctctttgagtatgccagttcaagcatgcatcaagtaattgaaaggcacgatcgctattcagcaatccatagattggatcgcccctctattgagctgcagattgagagtgactccaacaacattctgcgcaagaaagtagaagataagactcgtgaactgaggcagatgaatggggaagatctgcaaggattgacattacaagaactgcagaaactagaggaacatcttaaaagaagtttgaccaatgtttcaaaagtaaaggatgcaaaatttatgcaagagatcagcacctttaagagaaagggagtggaactaatggaggaaaaccaaagactgaaacaggtgccgagccttatccatgcacatagctataggcaatcatcggaatccattcttagcaattcatctaaccttcctgaagatggtggtagcaacacatctctcaagttggggttaccttaaataatgaacaaaatgtagattatttagaagtgatcggtttcgcttcctttatatgtcagtcaaaaccaattgaatatcctgtgttgtttgctgtttaaaaacaactcgtgtaaagtaagtaaatccaaaggatgaggtcctgcatgtagaattgtgcttg

SEQ ID NO: 234 - DNA, 516 bp, Glycine max
  Clone ID: PAT_MRT3847_30144C.1
gtcccaacactctctcaacatatgatgtattggcacaacatgtctgcctttattatggtttatatttgagccacatgtataagacccttacattactacatgcatacattgttttattacttctacctaaactatagaccatatgctatatctctgcacatacatgaaaaggacactggacggacgcagggacatatgcagcaaatttattcaaagacaacattcttatatatatgcctgcatgcatgatgcacgatgcatctacttgtaactgggacctacaggaagcttgtccttaatgttggccataatcgcctttcttctcgttctgatcaccatgagatgggtcatgctgacgaagttccttactatatcctgctgcagtgtgcgcacccccagtgttgactccgtacccagttccagttaaataaccagggcctccctttggtacataaacagggcccccagtgcctgcataaccgaggccgcccgtgggtccccttgtgggaccagtac

SEQ ID NO: 235 - DNA, 552 bp, Glycine max
  UNSURE (1)..(552): unsure at all n locations
  Clone ID: PAT_MRT3847_30158C.1
  unsure (1)..(552): unsure at all n locations
ggagtcccgcggtcgacccacgcgtccgcggacgcgtgggcgcctcctcccctagcctcgccgagcgcttcctccgcctccgccgccgcgtcgatctcgctcgcgcagccggtttcttctctcgtcggtgggtgggggataggatggcgggacgcgggaaggcgatcggcgccggggccgcgaagaaggcgacgtcgaggagctccaaggccgggctgcagttccccgtcgggaggatcgccaggttcctcaaggccggcaagtacgccgagcgcgtcggcgccggcgctcccgtctacctcgccgccgtcctcgagtacctcgccgccgaggtgctggagctcgccgggaacgcggcgagggacaacaagaagacccgcattgtgccgcgccacatccagctcgcggtgcgcaacgacgaggagctcaccaagctgctcggcggcgccaccatcgccagcggcggcgtcatgcccaacatncaccagcacctnctccccaagaaggccgggtcatccaaggcgtcccacgccgacgacgacgacaactgag

SEQ ID NO: 236 - DNA, 235 bp, Glycine max
  Clone ID: PAT_MRT3847_3026C.1
caacgacgaggaacttaccgtggaggagaggaacctcctctccgtcgcctacaaaaacgtgatcggagcgcgccgcgcctcgtggcgcatcatctcctcgatcgagcagaaggaggagagccgcggcggctaggatcacgtcttcgtcatccgtgactaccgatccaagatcgagtacgagctcttctacctctgctacggtgtccttaagctcctaggtactggggttattgca

SEQ ID NO: 237 - DNA, 2262 bp, Glycine max
  Clone ID: PAT_MRT3847_30912C.1
cccacgcgtccgtacggctgcgagaagacgacagaaggggacaaccaattccattattaaagggataagcctcaaccttgcaacccaacacaaccaaaattcgctacttgttaagggctgcactataccagaatgtctcagggaagaggcagtgcatctttgcctattgtggtcactgtggtttcactactgtgccttttggaacgtgctaacgcagcaacttactccgttggaggacctgggggatggaccttcaacactaatgcttggcccaatggaaaaagattcagagctggtgatatcctaatcttcaactatgactcaacgacccacaatgtggttgctgtggacagaagtggatacaacagctgcaagacaccagggggtgctaaagtgttcagttcagggaaggaccaaatcaaactagcaagagggcagaactacttcatatgtaactaccctggtcactgcgaatctgggatgaaagttgccattaatgcgctgtgatatactagtagtgctcaatacttcttgaaatgaagtaactgttaagttaatggtcaattaactagcattagtaaatgttagtgtgtgatattgtatgtagtcttttttttatatgaagctgttatatatattaattactatagtttgtgaagcaagtgggagtgagctggcttggtagatcaattgttcctgtatttggtatgtgttgtgtggtgggagtatgataatggtccattagtcacgggctcttcttattagacattggatctgcatattttgaaattattcaagtctgagccaattatctgtatctagtgtctcggtgtcacagtgtgtggttgtattactgaatttgttgccttcaataaattaaattttctacaatgataaactcaaaaaaaaacgatgacaaaaaaatttggttggagctagctaagaggagttaaattaatcttatattgacgattattaatttattataattcgaagttgttacaaatgatcatataactaccctttacccaattatccatcacgtttgacataatatggtttgaatttcttataagaaacatgaaccatactcgcaaatactaattgaatgacatcagatatcataatcgattaattagtccaattatttgtctttactttccagtatatgctcaatttcagcttcttgtttttaaagatatgtacattaagcataggaattgttccctctgaattaatattttaccttggcatgtcatagatgggactgctaacatgaatggcctctttgatcagcattgagggatcagcagattcaggaagccctccattctccattagtgtagattcaatgaaaacagtggacaaaccaaatgttttctcaaagctcatttgtgaaatcagcattgacctctcatattcatcatagttgtcaatctccctgagattaaaaatggcggcatcaagttcttccctctttgcatctctataaagctctgagacatctttggtttgcttctttgaggggcagcaacagcaggatgatgattttggtaatttgggcatagaaggtggactgtagccataaagtgcttgtctattgaaaacacatccagttcccacatacataggtccttgaatgccatcaagtcctttcatgttaacatcaaagaaaactgtgttgcgattggcatatcgatcactacgatcaataccatcaaatctctggggaaactgcacataacacaaatctctgccaactactggatccatcagaaaacacattgcttcccgtacagccttgctattgttcacataatgatcacagtcaagattgagaatgaagggagcatttgtgagaactgcagacaccctcaccagtgcattttcagcaccagcctttttgtggtgttggtagcctggccttttctctctagaaacatacaccaacctgggaagttcatttccctctatgtcatgggcaccactgtgtccaaggaaaacctgaatcatgccagggtgatcacgtgagttgtttcctggccatgaagttccatcttgcatagtccatccttcatctggtgttttctgagcctttgctaccaaagcattaactcgcactttaaactcttcatactccctcttcattgctctacgttccttcacaaaagaaggttgtactttgtccttcaggtagtcaatcttctgagagaagtagaactcaggtgcgcgtggttcaattgaaaactttttgcaaaatgg

SEQ ID NO: 238 - DNA, 452 bp, Glycine max
  Clone ID: PAT_MRT3847_3128C.1
gtatactccacatacaaatatgcttaactagttatcaaatttgaagagcctcttttttttcccatactatttgaagtgcctctttgcctctaagttgaaacatttcattaattatacacggggcttgaaatccattattcttagacaacatagaaaaaccaaccaaaaccaacgttggggacttggttgcctgccactcctttcaagaagttcttatttgttgaagaaacaaatgtatgtaccttccttcaagttcataataactaaccaacaatctagggtattcacataagaacttggggaaaaagctcaactcaagcactgtacttattgaaatggacagaagattctggttctacttctgcccattaataattcactacaacaagtgataatgcatggaactagtgttgagaggactgttgcatttggaaaaccatgttctgtgtctg

SEQ ID NO: 239 - DNA, 301 bp, Glycine max
  Clone ID: PAT_MRT3847_31418C.1
ggggaaggagggaccataaattactggaggttcagggctaaaacaatacttaaggtttcttatcaaagcctattaagcggggttttaaacagcgttaacatcatacaaagatagaaaaagagcggccccagtaatttaatacggtccacacatctaccccacaggtttcgggagctgccaaattagaaaaaaacatacaatttcagggccccccgtgggggggaaaaaaaaatgatatgcaaaaaccaaagggcgccttaatgaaactgcatatacaaaaccccaaggggaaggcccccct

SEQ ID NO: 240 - DNA, 264 bp, Glycine max
  Clone ID: PAT_MRT3847_3144C.1
ttcccgggtcgacccacgcgtccgagctgcagctcaggtgcttgtctgaggctgcctcctcgttggcaaccggattgcctgctgctggtggatgtggtgatcaacagtattattacagagccatgctatgtgaacattactagtagcagtgctcataaaagctacaatcccatctccctttttttttccagtcatgtaaaacttccaaactgctccatggttcaaaactctgttcttcaatacatcatcaattatcgattatat

SEQ ID NO: 241 - DNA, 310 bp, Glycine max
  Clone ID: PAT_MRT3847_32234C.1
aaagcactaggatgatcaggggcccaaggttgacgagtatggcaacgatgacaatcaaaccgacgaatacagcaaccgtgctcgtgctgatagtgtcacctatgtagccaccacaactgctgctggtggttacagagatgacattaataagcaacatgataccaccaatgcctacagcgagcacactggtagacagcattctagtggtggatccgatagtgacactaataaacatgaaggaactactgatggctgtaatgatgacaccaataaacataatagaactggcagtgtgtatggtatagacgca

SEQ ID NO: 242 - DNA, 806 bp, Glycine max
  UNSURE (1)..(806): unsure at all n locations
  Clone ID: PAT_MRT3847_32783C.1
  unsure (1)..(806): unsure at all n locations
tttttttttttttttttttgtaaagcttttaaacttaggaaatcaaattagaaataaaagatgaaggaaaaaagtaaattttagttacataacataacatgaaaaatggaccgtgcctatctccatttaagtatcagtccaagaagcaaaaactggcaagtgagacaaagagatagcaggagaaggcctcatttgaaccgttggtgagggtagccaagaggtaacactggtaccaatggggttcacaatctttgtttccattggaggcattgggaacagaagcgagggaccccttttctcaggactagcctctcttgagctgcttaaacttgtcaccagcgatgacgtgtttgaaaaatgagtcccaattttgctagactcgtccagcatattatgctgcccagaacccaccgaatcaatcccaataagatcttgtagggccatagaaaatgcactgtttctgtaatttccacagttcattattttttggtcactgccattgccctttgcctgttgctgctgtgaagggtggttaaataaaaccatcttccactctgagtcgttttcattattgttgtttcctgcttgaacttgaaccgtttcctcattgttcacacttgttactacactcttgttgtagtctatgtccttgtttctaggatcgttatctttcttacgccttgcaagctccccnncgaggagattgctactnnnnatgattcnnnnnacancgtatnntgaaatgtcaaagtttgtgactgcnnnngcnccgcgaaatttgatcgnnnctacatcgtatgcttctg

SEQ ID NO: 243 - DNA, 707 bp, Glycine max
  Clone ID: PAT_MRT3847_33044C.1
gaggaccaagaagaagaaacaacctcaaaatccctttcttgtgtcgattagattactttcacaccagagtcgttcgagtacttcaccttctttctctctaagcgcaaaacctcgtactgtttttggcggttaaggatgtcggggaaaggagcgaaggggttgatcacaggcaaaacctccgccgccaacaaagacaaggacaagaagaaacccatctcgcgttcttctcgtgccggccttcagttcccagttggtcgtatccaccggcttttgaagtcaaggacaaccgctaatggtagagttggggccacagctgctgtctactctgctgctatcttggagtatctcactgctgaagtattggagctggcagggaatgctagcaaggatctcaaggtcaaacgtattactccccggcatttacaactagcaatccgcggggatgaagagttggataccctgataaaaggaacaattgctggaggaggagtgattcctcacattcacaagtctcttatcaacaagtcttccaaggagtagattactagtgaataatagcttgcttgatggaaaatttctctctactaattgtgtaatttttgcatggcacttgaaaaacaaagtagggccttttatttatgactttgttgcctgttgttgatcatggatataatatttagtctttctctttgcggtttctctttgtt

SEQ ID NO: 244 - DNA, 1244 bp, Glycine max
  UNSURE (1)..(1244): unsure at all n locations
  Clone ID: PAT_MRT3847_33047C.1
  unsure (1)..(1244): unsure at all n locations
atgctttcaaggatcttatgttcaagcgtattactccccnncatctacgtctagctatccatggggacgagcagctctataccctnataaaangaacaattgctgtaggaggagtgattcctcacatccacaagtctcttatcaacaagtcttccaagtattatattactggtgaatgatagcagcttgatggaaaatttctctactaattgtgtatttgttgcatgacacttgaaaacgtccgtacggctgcgagaagacgacagaagggaggagcaagaagaagaaacaacctcaaaatccctttcttgtgttcgattagatattgccttcacaccagagtctgagtcctctgagactttccttcagtccttcaccttctttctctctaggcgcaaaacctcgtactgtttgtggcggctaaggatgtcagggaaaggggcgaaggggttgatcacaggcaaaacctccgccgccaacaacaaagacaaggacaagaagaaacccatctcgcgttcttcacgtgccggccttcagttcccagttggccgtatccaccggcttttgaagtcaaggacaaccgccaacggtagagttggggccacagctgctgtctactctgctgctatcttggagtatctcactgctgaagtattggagctggcggggaatgctagcaaggatctcaaggtcaagcgtattactccccggcatctacagctagcaatccgtggggacgaagagctggataccctgataaaaggaacaattgctggaggaggagtgattcctcacatccacaagtctcttatcaacaagtcttccaaggagtagattactggtgaatgatagcagcttgatggaaaatttctctactaattgtgtattttttgcatgacacttgaaaaacacagtagggccttatgatatttatgactgtgttgctgctgttgatcatggatataatatttagtgtttctctttgttgtctctatcactgaaaatgttaaggataattcaatctggggttctgcacatgccggccttcacttcccccttggccgaatccaacggctttaggagtcaaggccaaccgccttcggtagggttggggccacagctcctggttgtccgtacccaccggccggtgaactccaggacaaacgtctaggatcgggcgggggacgcagcatggcttgattcctcacatccacaagtctcttatcaacaagtcttcccaggag

SEQ ID NO: 245 - DNA, 2933 bp, Glycine max
  Clone ID: PAT_MRT3847_33935C.1
ctcgagccgaatcggctcgaggtggatattcgtctgaattagtagatgcaagtgcgggtggtggtcccccattacacatataagcatgccttgcacggttgtattgacacatgatcaaggtagtgggctggtgggttggtcctttgcctatctctggaccttgcatttaactcctagaagaaaatatcatcaaaatctaagattcagtgccctcaatatttatgtgaaattggttttagctcaaaattgtttttttcattgtcattgttctatgtctgcattctgtttttctcaccttagatagtggaaggaaagcatttatttcttgcagtgagtacttaaaccttgtaatttctcgctcttcctttgaactccaggttccaacggatatccacttcctcttcttctcttcccatttcccttccaatctcctaatttctcttcagcttctgggttctccattttccttcgtcttctgcatctgcattccgtagattcagttctcgtcggaaaatggacgttcgccgaagacccattcctccctccggcgatcgccgacaaacccagaagctgaagaacaccgccaccaccgattcgcagactcttctgcctctctacctcaccaacgccctcttcttcgcggtgttcttctccgtggcctacttcctcctccaccgctggcgcgagaagatccgcaccgccactcccctccacgccgtcacccccgccgagaccgccgccatcgtctccctcgtcgcctccgccgtctatctcctcggcttcttcggcgtcgcctcccgcgcctccctcgacgagctctccgacgacgagatcatcctcaaggaagactcccgcgccccgggcccgtgcgccgcggcgctgtcggactcctgctcactccccaacaacaaaatccaagaccaattccctctgccacccagggctgtccacagtttggcgaaggaaaaacaacatattccttcgccaccacaagtggacagtcctgtctctgtctcagtctcggtctcttcctcctcggacgacgaggacgaggagatcgtgcaagccgtagtgtcgggctccatcccgtcctactcactcgagtcgcggctcggtgacacccgtcgggccgccaccatccgccacgaggtggtgcagagactgacttcccgatccctgtcaggtttacctctggaaggtttcaactacgactcgatattggggcagtgctgcgagatgccgatagggttcgtgcagatccccgtgggagtagcggggccattattgttggatggaaaagaattcaccgtgcccatggccaccactgaagggtgtctggttgcgagcaccaacagaggttgcaaagctatatacgtctccggtggggcctcctcggtgttgcttagggatggtatgaccagagcacccgttgttcggtttccctccgcccagcgcgccgcgcagttgaaattcttcttggaggatcctctcaacttcgattctcttgctgtcgttttcaataagtcaagcagatttgccaggttgcagaatattcagtgtgctattgcgggcaagaatttgtacatgagattccgatgcagcactggtgatgcaatggggatgaacatggtgtcaaaaggtgttcaaaatgtccttgattttcttcagagtgacttccctgacatggatgttattggaatttctggaaatttctgttcggacaagaaagctgcagccgtgaattggattgaagggcgtggcaagtctgtggtgtgtgaggccataattaaggaggatgtggtgaagaaggtgttgaagaccagtgtggaggccatggtcaagcttaatatgctcaaaaaccttacgggttcagccatggctggtgctcttggtgggttcaatgctcatgctagcaatattgtgtctgctatctacattgccactggtcaggatcctgcccagaatgtggagagttctcactgcatcaccatgatggaagctatcaatgatggcaaggaccttcatgtttccgtgaccatgccctccattgaggttggtactgttggaggtggcacacaactcgcatctcagtcagcatgtcttaatttacttggtgtcaagggtgccaacaaagaatctccgggtgcaaattctaggctactggccaccattgtagccggttcagtcctcgccggggagctatcgctcatgtctgctattgcagctggacaacttgttaagagccacatgaaatacaacagatctagcagggatatatctacaattgtccaatgaactggccacagtacacttaaacttgtgtcagagactaatattctaataagcaaaccatcagataaagacataaataacgagaaaaaaattggtattgatgatggtgggggtaaaagataaagtgatggttggcatcttccatgggcaaatccagctccccagaagcgtggggttggttggcattcattgaatatctgcttcgtgtgaggcattttctcttatggagattgtacagaggtacttgaattagagggtggaggtaaacaggagccacacttttgggattagagtttctctttgtttgaggcattttctgttatggagattgtacagaggtacttgaattagagggtggaggtaaacaggagcctcacttttgggattagagttttttgttgttttccaaaaaaaggaaaatcattttgtgttgtgtgttatcctcttgtttaaggcttactgcttcaataatgtggtattttagcgggctgtgtttttatgtgttgtaatctccatcttgttaatttgtaattgtagcaagagatgtctcccattgggatgtagagttgttaataataacagtttctggttgctcaaaaaaaaaaaaaaaaaactcgcgactagttctctctctctctctc

SEQ ID NO: 246 - DNA, 549 bp, Glycine max
  Clone ID: PAT_MRT3847_33965C.1
gtcgacccacgcgtccgatgaactcgattgcatttcttgtcatgggtgttgcggttaatgagaatgaggatgatgatgaagttggggctgatcaacctgcacaacagctgaagaggaagaaactatggggactccttgtttgccaccatgagagccccagatatgttcctttaccattgctgtatgcctgttttttcttagcgcacgtgcttgctgtccatgttaacaaggagtttgaattacagaggcaagtacgcgagaaaagcatattgaggatgcaaacaatgctctctgacatgctagtcagggaatcctctcctctgagtatagtatgagggactaccaacatcatggaccttgagaaatgtgatggggctgctcttttgtatgggggaaaagtgtggcggctacagaatgctccaactgagtctcacatacgtgatattgccttctggctgtcagatgtccacagggattccactggcctgagtactgatagcctacatgatgctggatatacaggagctgctgctcttggtgatatgattt

SEQ ID NO: 247 - DNA, 1753 bp, Glycine max
  Clone ID: PAT_MRT3847_34828C.1
tttttacagtaaaaaatttcccagagtttgattgcgttaaatacttaagtcctccagaagttctcatcgaaagtaataggtagtaacagtcatttagttaacatctagaaccatttcacatgatttggtatcagtgaggatccgggtaccatggttttttttgaaatttactgatatgaatgcttctattgccacaaaattatatccaatttgaacatgttcaaagttatacaaaattcttgttcaaaatgatctgcagattgttgtaatcatttttttctttgcacaaaaggacggggggggggggggggggggtataaaaagaatccttaaaaccatgattgtattgctttggaagttttgattgggcataattttcatacacaagtaaacctcttgcattagcttatcgtttaagccaagtacttttccaccttctctacctcttctacgctcccaatgtacagtggcactcgttgatgaatctctgttggttgaatgtcaagtattctctggtggccatctgacccttttccaccagcctgttctactatgaagctcataggagcacattcatacaggagcctgagtttcccattcttacttttcttgtccctggggtacccataaatgccaccatatagcagtgtcctgtggaagtctcctaccaagctaccaatgtaccttgcagaataaggcttgccgctaggacctgggtccttgagatcatcaatatatttcttaagcttgtcatcccacaactgataattcccttcattgaaagcataaattttgcctgctctaggtatttggaggttttcctgagtcaaaacgaattcgccatacatcgggtccaatgtaaacacaaacactccatttccaagggtgagaacaaagattattgagctagaatacatgcagtaaccagctgcaagaaggttgcttccgggttggcacacgttcacaacacatctttgttctgttgtgtcaagtgtggggtcatcaccaatgtcagcaagacactcatcattggggctgtatatcccaaaaatggacccagttgacactgcagcatcaatattggatgacccatcaagtgggtcaaacaccacaatgtagtttccagaataactctcttctactgccactggcacatcttcctcctctgatgctattatccctgtcctcccacttgacctcaagcagtttgagaaaacctcatttgaaacaacatcaagctttttctggtcttccccctgaacattgacagctccttgaaccccagtgaggttggaaatgttggctctttgcaccaaagaagcaatctgtttgcacgccatggaaatgctagacagcacaatagtgagttctgcatcaatcaccccagcttgctcctgcttcagcaaccagttagtgagtgtttgaagctcatatccacttctcttctttgtcccagtggttgcagcttcccccaccgccatgcacctaactccagaaccccccacatgccttctcctgccacttgaacttgacagcacttgtttagtgtcaaagacacatagttggaaggggcagagacgcgagggggaacgaggctttgagaaaatcaactgggtggatgctgttgctgctgccattgcaaccatggttgttgcaaaagtttacctttttggttgttgattttggcagtgtggtatggtgctagtggtggttacatggattgtgttctaaggcactgagagcaaagagatag

SEQ ID NO: 248 - DNA, 174 bp, Glycine max
  Clone ID: PAT_MRT3847_34899C.1
cgtacgtaagcggtgagatttgcggatctgtgaaatggcggattcttttcgggaggagaacgtttggattctggaattttcggagcatgccgtgcgttactaggagatggttgtgttcatggagaatgttgcaaagactgtggatgttgaggagttgacagttgtcgagaggaa

SEQ ID NO: 249 - DNA, 2997 bp, Glycine max
  Clone ID: PAT_MRT3847_35003C.1
gtcgacccacgcgtccgccacccctatcctctctctctctctgtgtcacatataaataaaacccttctccacccattcatattcattcactcattccgttccttcttcccttccctctcttcactatcactctctctctctctccatctctctcatccatcatgggagcagtgattctcccagatctcggcaccgagattttgattcccgtctgcgccatcattggaatagcgttcgccctcttccagtgggtcctcgtctctaaggtcaagctctccgctgcgagagacgcttcctccaacgccggcggcggcaaaaatggctacaacgattacctcatcgaagaagaggaaggcctcaacgaccacaacgtcgtcctcaaatgcgccgaaatccaaaacgccatttccgaaggagcaacctctttccttttcactgagtataagtacgtgggaatcttcatggtggcttttgccattttgatattcctcttccttggctctgtggaaggattcagcacaagctaccagccttgcacctatgaccaaactaaaatgtgtaagccagctcttgccactgctgttttcagcaccatatctttcctgcttggaggtgtcacatcgcttatttctggattccttggaatgaaaattgcaacttatgccaatgcaagaaccaccctggaggcaagaaagggtgttggaaaggctttcattacggcttttagatctggtgcagttatgggttttctccttgctgcaaatggtcttttggttctttacattgccatcaacttgttcaagatttactatggtgatgactggggtggtctttttgaggccatcactggttatggtcttggtgggtcttctatggctttgtttggaagagtaggtggaggtatctatactaaggctgctgatgttggtgctgatcttgtcggaaaggtcgaaagaaacatcccggaagatgatccaagaaatccagctgtgattgctgataatgttggtgataatgttggtgatatcgctggtatgggatctgatctttttggttcatatgccgagtcatcctgtgctgctcttgttgttgcttccatctcttcttttggggtgaatcatgagttgactgctatgttataccctctaattatcagttctgtgggtatccttgtttgtttgctcacaactttatttgcaactgacttctttgagatcaaggctgtaaaggagattgagcctgcattgaagaaacagctcatcatttccactgccttgatgactattgggattgcaattgttagttggattgcactcccaacttccttcactatcttcaattttggagtgcagaaagatgtcaagaattggcagctattcttgtgtgttgctgttggtctttgggcagggcttattattggatttgtaactgagtactatactagcaatgcatatagtccggtgcaagacgttgcagactcctgcaggactggtgctgcaactaatgttatctttggccttgccttgggatacaagtctgttattattccaatttttgctattgcaatcagtatttttgttagtttcacctttgctgccatgtatggtattgccgttgctgcacttggcatgctgagtaccattgccaccggattggccattgatgcatatggtccaatcagtgacaatgctggaggtattgctgagatggccggtatgagtcacagaattagagagagaactgatgcccttgatgctgccggaaacacaactgccgcaattgggaagggatttgccattggttctgctgcccttgtatcactggccctctttggtgcctttgtgagccgagctgctattacaactgttgatgtgttgactccaaaggttttcattggtttgattgtgggtgcaatgcttccttactggttttctgctatgactatgaagagtgtgggaagtgctgctctgaagatggttgaggaagtacgcaggcaattcaacaccattccaggattgatggagggaactgctaagcctgactacgccacttgtgttaagatctccactgatgcttccattaaagaaatgattccacctggtgctcttgtcatgcttacaccccttgttgttggaatcctttttggtgtcgaaacactttctggtgtcctagctggatctttggtgtctggtgtacaggtgatgtttcatccaccactatttattactagtttaataacctcaacaacttattggtctttgtcattctcctcttttattctttgcttctaagacatatttccattccatgtttacagattgctatttctgcatccaacaccggtggtgcttgggataatgccaagaagtccattgaggctggtgcttctgagcatgcaagaagccttggtccaaaagggtcagattgtcacaaggcagctgttattggtgacaccattggagaccctctaaaggatacatctggaccttcacttaacatccttattaagctcatggcggttgagtctcttgtgtttgctcccttctttgctacacatggtggcctactcttcaagatctaaaggatttgatagaaaaagagtatcgtccatcatttttctacaacgacagaacaaggaaaagccgtccctttaccaatgccttctcgtttttgtgttagtctttaactcatctgtcatgtcaattccattgtttttgaaaccttttcctcccccaccttgaaacaaagtatattttgtctcatgtagttttaagacaacttgattaggctgagtctgttgcgaaaattttccttgtatgatgacgatgatgtttaccatctcttccgcgtggtcaattttctaaatatattcctttccggatggttcaactttcttaatatttctttaccattttgtttttattgtattgtctgtttttaagagtgtttgcaattgaactaattcaattataactaaaaataaataattcaagatat

SEQ ID NO: 250 - DNA, 2817 bp, Glycine max
  Clone ID: PAT_MRT3847_35116C.1
ctgaaaatacagtacatttatttgatcttcttgatttgccttacaacaaggttgaggatttatacctcatttttcttgtaaataactcaataccactaagtctcccgtgttaaaatgaaagtccttcattcataggctccttttttttcaacagatgcttttattggtgtcaacattggttcagatatatctgacatgcccggtccaacagagattgttgctcttctgaaggctcaaagtatccaacatgtcagactctatgatgctgaccaagccttacttcttgcacttgccaacacaggaattcgtgtaactgtttctgttcccaatgaccagctacttggcattggtcagtccaatgccactgcagcaaactgggttactcgaaatgtcatagctcatgtccctgctaccaacatcactgccatatgtgttggatctgaggtcctaactaccctcccaaatgcagcccctattctagtctctgccataaatttcattcactctgctcttgttgctgctaatctagaccggcaaattaaagtctctagcccgcactcttcttctatcatccttgactctttcccaccttcccaagcatttttcaaccgtacatggaatccagtcatggttcccatgtttaaatttttgcaatcaacaggttcatgtcttatgctcaatgtgtatccatattatgattaccagcagtccaatggtgtaatcccactggattatgctttattccgccccctacctccaaataaggaagctgttgattccaacactctgctgcattatactaatgtttttgatgcagttgtggatgctgcttattttgcaatgtcagatttgaactttaccaatattcctattatggtgactgagtcaggatggccctccaaaggtgactcatctgaatctgatgcaactgttgataatgctaacacttacaacagtaacttgatcagacacgtcctgaacaatacggggactcctaaacatcctggaattgcagttagtacatatatttatgagctttataatgaagacttaagatcaggtccagtctcagaaaagaactgggggctattttatgctaatggagaaccagtgtataccttacacttgactggtgctggtattatatttgcaaatgatacaacaaaccaaaccttttgtgtcacaaagagtaatgctgaccctaagatgttacaggcagcacttgattgggcttgtggaccagggaaggtggattgctcccctttgctgcaaggtcaaccatgttatgaacctgataatgtagttgcacattctacatatgctttcaatgcatattatcagaagatggataaatcacctgggagttgcgatttcaaaggagttgccactgtcactaccacagacccaagtatggcaatacatactcccacataaatatgagttggatacaaatatctgtgtacatttatttgtaaagccactagaacaccatagctataggcaataagaaaacatgcatgtttcaggcttgcaccttaacacaataggtttgatagaattgcaagtaagatgaattatgatgaaacttgtttcaggcttactacacctttagtccctctgtatcttcaattcaagagtttggtctattcaattttaaactcctttcagatgtggttcaatcttaccacagacattttatttggtgacaaagagagctcacatggcacataattagcttatgtggcaccttagccattcaacacaatctatgtgccacttcagcactttgcatctccaaatttatgttaagataggaccacaattgaaagaatttaagattaatgagaccaaaactgttgcgactaaaaacaggggactgcaattttaaaattgaagtaattagggaaaatgatcctgtgacgttaagtatgagaatagtggtattcaaatcttgcttatcagtttgtttcagaagtatatttgttaaaattatggatgattatattaatgtattttgaaatgttacatgaacactttttgaatttcatttccttagcatccttttgacataattaattagtcagtatgaaaaaatctcttcaaattttgcagcttttttctttcttgtccattttctattggctcagatttgttatacattaaaataggtcttgcataatgaattttctatttaaaattacttagcattataatacaataaatatcagttatattaaaatgctaagtaattttctatttaaaattacttagcattttaatataactgatatttattgtattataatttttacaggtcatggttcttgtatatttcctggaaggtatgatttctggagtctatgttagtttgcttgttgtcattcctttccgaatcatatgctagtcttgttctaagatgtcttattaatgtatttttctcgagccgaattccgagaaagggacccagaacaaatggcacatcactggccccatctaattccacaagttcgggctgcttgtcacaataccacgacaatggtggatttttcacaagctcgttgattctagttctacttttgtgtgcagttgtgtaaaactaggcttatcttctgttcagctttggaatataattaatggtggcattctcttctgtcttctggaagattgcgtcgcaacatagttagtgttccttgctagaaattatttgagttgtccaattgatcaaaatgtatatcggcaattgtatcatgagttgtccattgaattttgtacaaacagaccagagtaattatttgacatcattgctgtaaacaaaaa

SEQ ID NO: 251 - DNA, 300 bp, Glycine max
  Clone ID: PAT_MRT3847_3536C.1
tcagtttcgcaatgcctcgtaagcgctttcaggagccgcaacccaaaacaggtctacaacatacccaggatttcctgaggaaaatagggttggggaaggagaactactacttctggaagcagattggaaaggctttgctttgcacctatgcagtgatcggggcagtgtgggtgtacaacgagacctcaccactgggttggtggacactgaagccaaagccaaaggaagagcttgagctggctcatttgtacgagcggcggcagtttccttacccgggcgatgaagaggcaatgcaagagt

SEQ ID NO: 252 - DNA, 2238 bp, Glycine max
  Clone ID: PAT_MRT3847_35389C.1
gtctcgagccgaatcggctcgagtgagctttcacttcttccaacttcttcatctatctacttctcttctcttctcttcccttcttctgttgtaaccaacaacaaataacacttttatccctcagaaattaaccatttttcgtttctgggttttctataattttgttgattttccattccttctattttctgctgctgctaggtagcagtggtatgtctagcttatgagttatgagctatgagcatctttctattttgaagagaagattggaatttttttctctttagagaaaggcttcttcctagtggttaggattttaatccatcaaattattgattgagacatgttgtgatacatgcgttcttgtagatgatggagtgggattttgtttcttcgatttgttagtctgaattatagggatttggctaagtcaaccttgggtcctccgttatgaacgaaacatttgacattttgttgaaggtgtcttcaactttgtgaatctgtgatgtgaattattcgcttgtgaagtctctaacaaaagcggaatttgcttgaaagattagactttgggctcgtgatgggtaacctcttatgaattttatgtttccttcaaattaatgtgtttccatcaaagaagacacagcagaagaatattccgttcggactttcaaacttttcggaatgactctatttgtaacagacacctgcaaaccagctccaacaatcgaggcatgcaaacgtttcttctgcaactatggcgattcaagatcaaaatggatttttcagatcacagggtggtcctccagaaggagctggtgtatctttgagttctgggcattctgtcacacatattcaacttaatgaccagttttcttgtgggaatgactatgctctgaaggtaaggaagccgtatactatcactaaacagagagagcgatggacagatgaagaacataagaagttccttgaagctttaaagctgtatggacgggcttggcgacgtattgaagaacatgttggcacaaagactgctgttcagattcgaagtcatgctcagaagtttttttctaaggttcttcacgatcctactgggaacaatacaaacacagtggagtcaattgaaattcctcctccaagaccgaaacgaaagccgatgcatccttaccctcgtaaactagttgagacccctaataaggaaatttcgatcccagaacaacctatgaagtctaattctctgaagtcgtcagactttgatcaagaaaaccaatctccaaaatcagtattatcaggagttggttcagacagcattgggtcctctgattcagataaaccaaatggaagtttgtcgcccatgtcatccattagtggcttccatacaagcagttttacacgtgccaaacccaaaacaacaacatctgaggaagaagctgggatggacactgattcaactcatgatgagaaacctcttatgaaattcaagcttcctccaaatggatgtgtttccatcaaagaagacaacacagcagaagaatcttccggtcggactttcaaactctttggaatgactctatttgtaacagacacctgcaaaccatctccaacaatcgaggaatgctaaagatacctctaaacattcgcgcgcaacgcctttcctcctccatggaggatggcaaattggaacttgttggacactctagagcaagtgaaacatcagcaatatccaagctaaaggtgagagtggaacctgaagcatgtgggaaagggtttgtgccatataaaagatgcatatctgttgtgacagctgatgatagagaagagcaatgtatccatctttccttgtagcttataccccactggatttttccttcaaaaagtgttccctttgtcatgatgagctgtaatggttgttttggttgctgctggatgtgagttggtatgatataggaaggaaaaaggggtggctgaaaattttgatatttccgttgaattgcactgcactgcacattctccagctgttcaaatccgtaaacttgccttttctatttttttgacttccaagtttcaacacattctccgcgggtccaagccgtgtctgtgcgcggcacttaggagctgtgtccgtgcttcctagtttaactgtgaataactgtgaattatatctagtgccttttttttaaaaaaaaaaaaaactttttatgctccctaagagtatgcaaagtgtaagtcacgtactaaaaa

SEQ ID NO: 253 - DNA, 271 bp, Glycine max
  Clone ID: PAT_MRT3847_35541C.1
ctactctcagcaacagcagtttctgccattcaaccatactggctaacattgactctgctgcgtatttgcaacaacaactaccattcaggcaactagctgttgtctacccccagcaatttcttccattcaagcaactagcttcattgaactctgctgcttatttacaacagcaacagctatcaccattcaaccagctagctgatgtgagccctgctgacttctagacacaacaatagttgttggtcgttctacctgcacgctgcgcctaacg

SEQ ID NO: 254 - DNA, 572 bp, Glycine max
  Clone ID: PAT_MRT3847_36480C.1
gaacatcgaccagatctccgcatctgtcgagaaagtcgtccccgtcctccacgccgacgtcgagccgttccgcgtcccgctgcctgcgagcccactgatatcaccgcaacgagagcacccgccgcagctgccaccgccccaaatcacactgcaggaagacagcgacgaggaagctgtcaaagaacaagctgcaaagatgcctcctaagacacagaagcagaaggagcagaaggaggaagaggagcatggcgctgtcttctccgtctccggtcccgtcatcgtggccgagaacatgattggtgttgccatgtacgaactcgtccgtgtcggccacgagaacttggtcggagaggtcattcgtatcgatgccgacaaggccaccatccaagtctacgaggagactgctggtgtgactgtcggcgaccccgtcttcaggtccggacagcccttgtctgtcgaactcggccctggtctcatggagaccatctacgacggtattcagcgcccttctaagggtatcgccgacgactccaacagcatctacatctccgtggtatcgatctgcccgccct

SEQ ID NO: 255 - DNA, 408 bp, Glycine max
  Clone ID: PAT_MRT3847_36525C.1
agcccacgcgtccgcccacacgtccgcccacgcgtccgcgcacacgtccgaccacgcgtctgcacataaacaccacaaatacttccttacaagcagaaccatcatgtaatatggcacattatcaaaagcactaagatgatcatggtcacaacgttgactagtatggcaacgttgagaaacaaaccgacgaatacggaaaatcagttcatgctgctactagttcctatgtacccaccagaacggctgctggtggttacagtgaagacattaataggcaacatgagagcaccaatgcctactgagtagacactgggagacaacattctagtggtggctacgatggaggcactaataaacatcaagggactactggtggctatgctgctgacaccaatagacatcatggaa

SEQ ID NO: 256 - DNA, 913 bp, Glycine max
  Clone ID: PAT_MRT3847_36598C.1
tgctcgagacttaattcaagttgaacctcttctgagctttgaccacgacaagaactaaaacttctccctcggcctcacatcacaacacaagaaagttcctattaatttccaccactttcccgctctcatctcttggaagcctcaaaagctgcaatctttcttcttccaatgttttttttccctggctctccgttgaaccttccatgtttcccagccccttttgattgttttccactagaagcagtgttttctgttaatagttaggaggttctaatggctgtgctgatgatttttcacatgtttgctgcaatatctttgcctgcttatggagatgctttcatcggtgtcaacattggtacagatgccaccaacatgccaagtccaacagaggttgttgcccttcttaaggctcaaggtatccaacatgttagactctacgatgccgacagagccatgcttcgcactcttgccaacacaggaatccgtgtaattgtttctgttcccaatgatcagatactcggcattggtcagtccaatgccacggctgcaaattgggttgcacgcaatgtcatagctcatgttcctgctaccaacatcactgccatagctgttggttccgaagtcctaacttccctcccaaatgcagctcctgtcctagtctcagcactaaaattcattcaagctgcactagtcgcagccaatctcgaccagcaaatcaaagtctctactccacactcttcttctgtcatccttgactctttcccaccttctcaggcatttttcaataaaacatgggaccctgttatggttcccttgctcaattttttgcaatcaacaggttcatatcttatgctcaatgtgtacccttattatgattacatgcaaaccaatggtgtgtccctctagactatgc

SEQ ID NO: 257 - DNA, 845 bp, Glycine max
  Clone ID: PAT_MRT3847_36609C.1
attccacgcctaaaatacccaaataccattcaactcttgtcatttttttcactttctctttttcaaaatactcttagtctctctctaaccttcttccagttgtctctaaacctcttgaaatccgtgatggataccaggataggttcactcgacgcggccaagcccgcctgcaacgacgtcgtatcgtgcaaccacaccaccagcgccgccatccagccctgcgtgccggcgacggtgatcaacggcgccggcggagactccactttaggcggccacctggcacgccggctggtcgaaatcggcgtcaccgacgtgttctccgttcccggggacttcaacctgacgctgctggaccacctgatcgcagagccggcgctgaacctggtcgggtgctgcaatgagctcaacgccgggtacgccgccgatggctacgcgcgcgccaggggagtcggcgcgtgcgtggtgactttcaccgtcggcgggctcagcgtgctcaacgccatcgccggagcgtacagcgagaacttgccgctaatttgcatcgtcggtgggcccaactccaacgactacggcaccagtcggatcctccatcacaccatcgggttacccgatttcagccaggagctaaggtgctttcagaccattacttgcttccaggctgtggtgaataacttggaagatgctcatgagttgattgatacagcaatctcaactgcgctgaaagaaagcaaacctgtgtatataagcattagctgtaacttgcctgggattcctcaccccactttcagtcgtgaccctgttcgttttccatgtctcaagatgagtaattaaaaggggttggaggc

SEQ ID NO: 258 - DNA, 2344 bp, Glycine max
  Clone ID: PAT_MRT3847_36610C.1
cgcctcgtgcccaaataccattcaactcttgtcatttttttcactttctctttttcaaaatactcttagtctctctctaaccttcttccagttgtctctaaacctcttgaaatccgggccgacccccccccaaaaaccattcacttttccacaagccttagttcttctcatttattctctttttcaaaatactttcactctctctaaccttccagttctcactaaacctcgtgaagctcgtgatggacaccaagataggttcactagacgcgcccaagcccaacagcaacgacgtcgtatcatgcaacctcaccagcagcgccgccatccagccctgcttgccggcgacggtgatcaacggcgccggctgtagtgactccaccttgggcggccacctggcccgccggctggtggaaatcggcgtcaccgacgtgttctccgttcccggggacttcaacctgacgctgctggaccacctcatcgcggagccggcgctgcacctggtcgggtgctgcaacgagctcaacgccgggtacgccgccgacggctacgcgcgcgccaggggagtcggcgcgtgcgtggtgacgttcaccgtcggcggcctcagcgtgctcaacgccatcgccggagcgtacagcgagaacttgccgctaatttgcatcgtcggtgggcccaactccaacgactacggcaccagtcggatcctccatcacaccatcgggttacccgatttcagccaggagctaaggtgctttcagaccattacttgcttccaggctgtggtgaataacttggaagatgctcatgagttgattgatacagcaatctcaactgcgctgaaagaaagcaaacctgtgtatataagcattagctgtaacttgcctgggattcctcaccccactttcagtcgtgaccctgttcgtttttcattgtctccaagattgagtaataagatggggttggaggccgcagtggaggcagcggcggaattccttaacaaggcagtgaaaccagtgctggtgggtggtcctaaactgagggtggcaacagcatctgatgcctttgtcgaactggctgatgcgtgtggttatgcgcttgctgtgatgccgtcggctaaagggcaggttccagagcaccatccccattttatcggaacttattggggtgctgtgagcactgccttctgtgctgagattgtggagtctgcggatgcatacttgtttgctggtccaatttttaatgactacagctctgtggggtattcacttcttctcaagaaggagaaggcgatcattgtgcagcctgatcgggttgtgatcgcgaatggacctgcttttgggtgtgtgctgatgaaggatttcctcaaggcactcgcaaagcgcctcaagcacaacaatactgcatatgaaaattaccacaggatatttgtccctgatgggcatcctttgaaggctgcacccagagagcctttgagggttaatgttctgttccaacatatacaaaatatgctgtctggtgaaactgctgtaattgctgagacaggggactcctggtttaattgccaaaagctgaaattgccaaaggcatgtgggtatgagttccaaatgcaatatggttcaattggatggtctgttggtgctactctgggttatgctcaagccgttcctgagaagcgagtgattgcctgcattggtgatggaagttttcagctgactgcccaagatgtatcgacaatgttacggtgcgggcaaaaaaccatcatctttctgatcaacaatggtggatacaccatcgaggttgaaattcatgatgggccgtacaatgtgattaagaactggaattacactgggttgattgatgcaatccacaatggtgaagggaaatgctggactgccaaggtgttctgtgaagaggagctagttgaagcaattgccacagccacaggacccaagaaagactccttatgcttcattgaggtgattgttcataaggatgacaccagtaaagaattgcttgaatggggctcaagggtttctgctgccaatagccgtcctcccaatcctcagtaatcttcagaatttatcctatgactaaattgctgcagttgccctttagctctatgaaagtgagaatcatttgagatgatgcccttgtagggaatttacctttgttaatggcttgaaacatttatgctaaactgactccccacttgtttgtgtaaattctttcacttttgttcacctttgtttatcacctttgttcatttcgattattcttaagtaaagcatcgttctttttatccaaaactgtttgctacattttgttaaacaggaaccgatttcat

SEQ ID NO: 259 - DNA, 496 bp, Glycine max
  Clone ID: PAT_MRT3847_3683C.1
gagtacagaaaacgcagttctcaccatttccctctcggtaatttccaattactactaattttgccatgctttcttcatcttactcttaatcctctttggtttagtttaattgttgtgtgtttgaatttacggtgcagattgtgagacttgttgttgttaactgaacttttctgagcaagaatgtctgggcgtggaaagggaggcaagggtttgggaaagggaggagcgaaacgacaccgtaaggtgctgcgcgataacattcatggaatcaccaagcccgcgattcggcgtttggctcgtaggggtggcgtgaagcgtatcaatggtctcatctacgaagagacacgtggcgtgctcaagatctttttggagaacgtgattcgtgacgccgttacctacactgagcatgctaggagaaagaccgttacggcaatggacgtggtttatgctctcaagagacagggaaggaccctctactgattgggggctagggttt

SEQ ID NO: 260 - DNA, 802 bp, Glycine max
  Clone ID: PAT_MRT3847_3684C.1
acactgagcacgctaggagaaagaccgttacggcaatggatgtggtttatgttctcaagagacaaggaagaaccctctagggatttggaggcaagttcgtttttttttttttttacggctgggggaagacgacagaaggggattggtaccgcgaaacgcacatttcactattcattctcgtttccctttcgactgtgattgtttgttaactgaacttttcgagcaaaatgtctggacgtggaaaggggggcaagggtttgggaaagggaggagcgaaacgacaccgtaaggtgttgcgcgataacattcagggaatcaccaagcctgcgattcggcgtttggctcgcaggggtggtgtgaagcgtatcagtggtctcatctacgaggagacacgtggcgtgctcaagatctttctggagaacgtgattcgtgacgccgttacctacactgagcacgctaggagaaagaccgttacggcaatggatgtggtttatgctctcaagagacaaggaagaaccctctacggatttggaggctagtttgttttttttttttttttttaatttttattgttaggtttcgtttgttttggaggtttatgtgggatgtaagagacccttgctattagggagatagggaaaaaaattgcaaggatttggtgtagtaagttgctggtggtgttttaggtataagggtttctataacatgtaatgtattgagctatattgctgccaagcttgtaattgtatcacaatatgttgctaatgtcagattcttgtttttctgtctgatttttattttg

SEQ ID NO: 261 - DNA, 915 bp, Glycine max
  Clone ID: PAT_MRT3847_3685C.1
ccacgcttccgtcacggttgcagaaaagagtacagaaaacgcagttctcaccatttccctctcggtaatttccaattactactaattttgccatgctttcttcatcttactcttaacttctttctctcacttcagaacctccgcgaattccttcctctcccaatacgaacctacctctctgctgagtacagaaaacgcagttctcaccatttccctctcgattgtgagacttgttgttgttaactgaacttttctgagcaagaatgtctgggcgtggaaagggaggcaagggtttgggaaagggaggagcgaaacgacaccgtaaggtgctgcgcgataacattcagggaatcaccaagcccgcgattcggcgtttggctcgtaggggtggcgtgaagcgtatcagtggtctcatctacgaagagacacgtggcgtgctcaagatctttttggagaacgtgattcgtgacgccgttacctacactgagcatgctaggagaaagaccgttacggcaatggacgtggtttatgctctcaagagacagggaaggaccctctacggatttgggggctaggtttttttattttattgttaggttcttttgttttggaggctaatctggatttgagaaacccttgctgttatggatatagtaaaaagaaatggcaaggattgggtgtgggaagttgccggtggtgttgcagtaacttgtaatgcagtctttagctgttattgctggcaagtttgtaattgaatcactatatgttgctaatgttagaatcttggtattagtatgattttcgcaaaaaaaaattgccacctgaaattgtgttgtggacttgtgggtaatgagctagtggattgttgtttagtgatttagcgttttcgaaatggatttagttgaatgtgctagc

SEQ ID NO: 262 - DNA, 1408 bp, Glycine max
  Clone ID: PAT_MRT3847_37654C.1
cagtaggaaccgctacaacacactactatgctagtgaagaattcaaaatcaagcagcacaagaccaagtcattcacttgtagccctcaagaagtgatttctggtggagactacaagcaatccacatattgtcaccttcttcttggcctatacttctctgaccaagttgagtttataacctcagcttttatctacagcatggtgcaagctttcaccacttttgaggaactttggagagaaatttgcaatgacataagagatggaactcttagctcaagaatcaagtcatccaaaatgagaaaggctgctttggatatcatctctccaagcccaaatttggcctcaaagttagaagattcttgcaaggagctagaaggggtggattggtttggtttgattccaaaactttggccaaatgcaaagtatgtttattccataatgacagggtccatgcaaccatatttgaaaaaacttatgcactatgcaaatgggttgcctttggttagtgctgaatatggctcaactgagagctggataggggttaatgttgaccctagtttgccaccagaagatgtaacatttgctgtggttcccactttctcttactttgagttcataccactccacaggaatgaaaaaaatttcagctcaggaggtgatgatttcattgaagacaagcctattccactgtctcagatcaaagttggacaagagtatgaagtagtcctcacaactttcaccggactgtacaggtgcaggttaggggatgtggtggaagtggcaggcttccacaatgggaccccaaagttgaactttgtgtgcagaagaaagctaattctgactataaacatagacaagaacacagaaaaggaccttcagctagtggtagagagagggtcccatattctgaacatgacaagtagaggcgagctagttgatttcacaagctacgcggatgtctcaaagcaaccggggcactacgtgatttactgggagatcaaaggggaggttgaggacaagatacttggcgcatgctgcaacgaaatggacaagtcttttgcggatcatggctatgtggtctcaaggaaaaccaactcgatagggcccttggagctttgcgttttggagagtgggactttcaagaagattttggacagcttcatagctaatggggcagcacttagccaattcaagacccccaggtgcaccaataatcatgtcctcctcaaaattcttaacacgtgcaccaccaaaaagttccggagcactgcttacaacagttcaatggaacaatgattgatatgtcactctatgaatgaatgaatggttatttcctttcgctactctttcaaaattttgttatggttatttttcttccaatatggtatatgatatgacttaattagagc

SEQ ID NO: 263 - DNA, 386 bp, Glycine max
  Clone ID: PAT_MRT3847_38272C.1
accaccaccaacccttaacattatattgctcatctgcgtctctcactgtctatctcacatagacaactcgatctaaccatggacctgggtcagatgcagagacagtggatcgactacaccaaatccctcttccatgagggcatcatggatggtcagtttctgcaacttcagcagcatcaagatgagaacaaccctgacattgtggtcgatattgtctctcacttccttgcagattccgatcggcttctcaaagatctcacctttgccataaatgataatagagttgacttcatacaagttgatgatcatgttcaccagttaacgggtaacacttcatgcacaagcgcacatagggtaaacactgcccgtattgctttccgcaacct

SEQ ID NO: 264 - DNA, 227 bp, Glycine max
  Clone ID: PAT_MRT3847_38797C.1
gatggtttggtcagaactcttaaggatctagccaatagtccatattcaccagagtatgatattgctggtatcacagacccatttctgcacatcagattgcttaaacttttgcgagtgttgggtgaaggcaatgctgatgctagcgacaccatgaatgacatacttgcccaggtggctacgaagactgagtcaaataaagttgcagggaatgccattttataagaatg

SEQ ID NO: 265 - DNA, 1675 bp, Glycine max
  UNSURE (1)..(1675): unsure at all n locations
  Clone ID: PAT_MRT3847_38946C.1
  unsure (1)..(1675): unsure at all n locations
ggcnggggagagcgtatatggaaatcaaacagcagatagagggtctagcatacgtgggttaaatgcatgcgcatgagtcggaagaatttgtgttagcggtgaggagatatattgagaattaacatttgatactgctgcgtgagactcacggtcatgactcatgtaaattcgtctcccacaacaacactagctctcacgtacataaatataaagatgttgatagcatattataaatcatagagttcattccatacacagaaagaagaacaacactaagaaagcagaatagggaaaaatacatcgatagaggaaaattaattgaagggtgctactactacgaccttctatatcattaatgattgaaattcgtgttggaattgtcttgtaggtgtagtagtgataataagagaggatcatatatatattagtagtgctagaaattaattgaagtgtgtaatagaatagagtgtgatagagagagatatggggagaggaagggtgcagttgaagaggatcgagaacaagatcaataggcaagtgacgttttcaaagagaaggtctggtttgctcaagaaagcacatgagatctctgtgctttgtgatgctgaagtggccctcatagtcttctccaccaaaggcaaactctttgagtactccagcgatccatgtatggaaaaaattcttgaacggtatgagaggtattcatatgcagagaggcagcttgttgcaagtgatcaaccactaactgaaaattggactctggaacatgcaaagctcaaagcaaggttggaagtcctacagaaaaatcaaaggaattttatgggacaagatttggagggcctaagtatcaaagagcttcaaaatttggaacatcaacttgatagtgctctaaaacacattagatcacggaagaaccaaatcatgcatgaatctatttcagagcttcataaaaaggataaggtcctacaggaacaaaataacactctcgcaaagaagataaaggagaaagagaaggcactagcccagcatgcacaaatggagcagcgtggtgatgaaatggatcttacttcctctgccctagtacctcatccattggagacatcaaacattagagagtcctcacaaataaggggtgaaggagataatgaaggaaccccaactccaacccgagcaaatgccattcttccatcttggatgcttcgtccttcaaatgaatagaagagtattaacgacctaaaattttaaattacatatgaatatggcgaatacaaagcttaccctataagatgtaaaatggtctatgtgttgaattgtgaacaccacccaatgagttcaattggaatatcatagatatgtaatgtgtctctgactactacatttcaaggatgctaagtaaattatatggtatggcctgtctagatatagacctgcaatacatatatagtgtcaattatgtatgcttggttcttatcaaaagtttaagttggactttacatgcctctcttcctagaaattcggaaggtaaacataatttcagtacacatatatagtgagtttgtgtaatggaatgtaatctttgtgtatcaagtgttgaaggtttagacttttgggtgtatagatagatcctaacaatactacaataaaaacatactatatcggttatttgtagtttgtt

SEQ ID NO: 266 - DNA, 1395 bp, Glycine max
  Clone ID: PAT_MRT3847_38947C.1
tacggctgcgagaagacgacagcgagaggacgaatgaattctatacacacacagaaagaagaaccaccaagaaagaagcataggggaaaatacatcgatagagagaaattgaagggtgctacgtccttctattgtattaatgattgaaattcgtgtgggaattgtcttgttggtgtggtagagataataagagaggatcatagtagtgctagaaattgaagtgtgtaatagaatagtgatagagagagagagatatggggagaggaagggtgcagttgaagaggatcgagaacaagatcaataggcaagtgacgttctcaaagagaaggtctggtttgctcaagaaagcacatgagatctctgtgcattgtgatgctgaagtggccctcatagtcttctccaccaaaggcaaactctttgagtactccagcgatccctgtatggaaaaaattcttgaacggtatgagaggtattcatatgcagagaggcagcttgttgcaagtgatcaaccactaactgaaaattggactctggaacatgcaaagctgaaagcaaggttggaagtcctacagaaaaatcaaaggaattttatgggacaagatttggagggcctaagtatcaaagagcttcagaatttggagcatcagcttgaaagtgctctcaaacacattagatcacggaagaaccaactgatgtatgaatctatttcagagcttcataaaaaggataaggccctacaagaacaaaacaacactctcgctaagaagataaaggagaaagagaaggcactagcccaacaggcacaactggagcgacttggtgatgaagtggatctgacttcctctgcccttgttccccaaccactggtgacatcaaacattagaacctcctcacaaatcagaggtgaaggagataacgaaggaaccccaactccaacccaagctaatgccattcttccaccttggatgcttcgtcctacaaatgaatagaatactatttaattaatgacataaagttttaatcaaattaaatatgaatatggccaatacaaagctcaccctacaagatgtaaaatggtctagtgtgttgatttgggaatggcacccggtgacttgaccagttggaatatcaacgatatgtaatatgtctgtgactaccacatttcaaggatgcttagtaaattatatggtatggcctgtctatacaggcctacaatacatatatagtgtcaattatgtatgtttggttcttatcaaaagtttaagttgtgctagaaactacgatattgggcgatgttagatccctcaaaatctatgattttttacaacagaaatattaaattttgtatgaactaatggttttatctaagtgttacaagaatacattgtctgtatt

SEQ ID NO: 267 - DNA, 1572 bp, Glycine max
  Clone ID: PAT_MRT3847_39240C.1
ccacgcgtccgggaatcgcaagcaaatggtgtacacagctctaaacatgatgatgatggtcgcttaaaacgaagaggaacatggttaactgcgacttcacacatagtgacggctgttattgggtctggggtcctatcactggcatgggccgttgctcagttgggctggattgctgggcctgccattctgacaatcttttctgtcatcactgtcttcacttcttctctgctcagcgattgttataggtaccctgactctgttcatggaaccagaaaccataactacagggagatggtaaaaaatattctaggaggacgtaaatacctgttttgtggattggcccagttcgcaaatctgattggaacaggcattggatacaccgttactgcatccattagcatggtggctgtcataagatcgaattgctttcacaagtatgggcacgaagcgaagtgtcatacatcaaattacccatatatgaccatctttgcggtcatacagattttattaagccaaatccctgatttccaggaactctcaggcctctctattattgctgccgtcatgtcttttggttattcttccataggcattggtctctccatagccaaaattgcaggaggaaacgatgccaagacaagtctaacggggctcatcgttggagaagacgtgacaagccaggagaaactatggaacactttccaagcaattggaaacattgcttttgcatacgccttcagtcaagtacttgttgagatacaggacacgttaaaatcaagcccaccagaaaatcaagccatgaaaaaggcaacccttgctggatgctcgatcacctcactgttttatatgttatgtggcctattaggctatgcagcattcgggaacaaggcacccggaaacttcttaacaggatttgggttttatgaaccatattggcttgttgacattggtaatgtcttcgtatttgttcatttagtgggcgcctaccaggtattcacacaaccagttttccagcttgtggaaacttgggttgcgaagcgttggcctgaaagcaacttcatgggaaaagaatatcgtgttggcaagttcagattcaatggattcaggatgatatggaggacagtgtacgtgattttcacagcagtggttgctatgatacttcccttcttcaacagcattgtgggtttgcttggagctatttccttctttcctttgacagtgtattttccaacagagatgtatctggtgcaggctaaagttcccaagttttctctggtctggattggggtcaaaattctaagtggcttctgcttgattgtcactcttgttgctgcagctggatcaatccaaggaatcatcgcagaccttagaatctatgagcccttcaagtaaatatcctttgtgtagtttagctctttggatgaacaatggtttgtggctaagtttgtggtcattattgatcagttgtttggataaactttctttcaagtgttttcataatatatacttttataatggatcgataagaatgcttttagatcctagaaaaattttaaattgctttttgtcctc

SEQ ID NO: 268 - DNA, 239 bp, Glycine max
  Clone ID: PAT_MRT3847_39392C.1
gaactttcaaggcctaacagtttgtgcaggaaaacccaaataaagttggccctgtgggggggaagcctggggagaagtccatgaaaccagaccctaaacttagcaaaaactactttgcaggggggtagctaggttattagttaaaagtggctttctgaatcgtgttaaatcagggaattgcaaaagggcctggttttttttaatgttttttaagtcctaaaatttagagccgataggtt

SEQ ID NO: 269 - DNA, 3174 bp, Glycine max
  Clone ID: PAT_MRT3847_40132C.1
tgctgaaagagcacattgcattggcgacaccgcgagcgacgacggaaattgaattgctcgtgcgcgtcggtgcgtgatcgatcgaaggacgaacgatgtcggagatggcgagcccagatcccgagggactcgacggagtccgcatgacgtggaacgtgtggccccgtacgaaggttgaatcgagcaagtgcgtgatccctctggcggcgacggtggctctgatccgtccccaccctgacatcccccgcctccagtacgcccctctccgctgcaagacctgctcctccgccctcaaccctttctcccgcgtcgacttcaccgccaagatctggatctgccccttctgctaccagcgcaaccacttcccccctcactaccacgccatctccgaaaccaacttccccggcgaactctacccccaatacaccaccgtcgagtacctcctccctctctccaattccctcaacccttcccccgtcttcctcttcctcctcgacacctgcctcatcgacgaggagatccacttcctcaaatccgcgcttcgtcgcgccattggtcttttacccgataacgccctcgtaggcttcgtttcattcgggactcaggtccaggtttatgaattgggcttctccgacatgtccaaggtttactgtcttccgcggctccaaggagattcccgccgaacaagattctcgatcagcttggtctttctgctgccggaaggagacctcaaaagggtgctgctcccggtgtcgccggtgccggtggattccccaattcaggcatcacgcgcttccttttgcctgcttctgagtgtgaatatactctcaatgcgctgctggatgaattgcagacggatcaatggccggttccgcctgggcgccgccctgcacgctgcaccggggttgcattgagtgttgccgcggggttgctgagtgcttgcaatcctgggactggtgctagaatcatagctttggttggtgggccatgcacggaaggacctggcgcgattgtgtcaaaagatttatctgacccagtgcgttctcataaagatcttgataaagatgcagcaccattcttcaagaaagcagtcaaattttatgagggtctcgcaaaacagctggttggccagggtcacgttttagatatttttgcatcagcacttgatcaggttggagttgcagaaatgaaagttgcggttgaaagaaccggtggccttgttgtcctgtctgaaagttttggtcattcagtcttcaaggactcttttaagcgagtttttgaggatggggagcaatctcttggtctttgtttcaatggaaccctagagataaattgctccaaggaaatcaaaattcagggaattattggaccttgcacctcgttggaaaagaaagggccttctgttgctgatactgttataggagagggaaacacaacagcatggaagatgtgtggccttgacaagagtacatgcttgactgtgatgtttgatctttcatcaagtgatcgttcaaatacccctggtgctgttaacccacaattgtacctacagttccttacaagttaccaggacccaagtggtcaatcagtgcttcgtgtcacaacagtaactagaagatgggtggatagttctgttagctctgaggaattggttcaaggatttgaccaagaaactgctgcagttgtaatggctagatttgcttctctgaaaatggagagtgaggaaacatttgatgctacacggtggttggatcggtttctcattcgcctctgttctaaatttggtgactaccgcaaggatgatccatcgtcttttacattaaacccatcattttcacttttccctcagtttatgttcaatctgcgacgctcacagtttgtacaggtttttaacaacagtccagacgagactgcatatttccgcatgttgttagacagggaaaatattagtaatgctgccgttatgattcagccgtcattgatatcgtattcatttaatgcactgcctgcaccagcattgttagatgtggcttccattgctgcagacaagattttgttgctagattcatattttagtgtggttatttttcatgggatgacaatagctcaatggcgcaacttgggataccagaaccaacaagaacaccaggcatttgcacaactattacgagctccgcatgacgatgcccaaatgataattagagaacggttcccggtgcctagattggtagtgtgtgaccaacatggttcccaggctagattcttattagcaaaactgaatccctcagcaacgtataataatgcacatgaaatggctgctggttcagatgtaatctttactgatgatgtgagccttcaagttttctttgagcatctgcaaaggttggctgtccaatcatgaggacagataatagtagagattgacattttatgggttctggactttggtttggggaattcaccaatgatgtgtgtgtcctgcgttgtgctgttgcattcagtacttttcctttctttcctttgttcttaacaaagagaaggccggagcctgcatgaattgaagaataaggaagacctaaaacataattctttaaggttctggtcgaattttcttttgtggagaaaataaagggttcaaaagtatgttgttaagtttgggtattgcggaaagaaaggatagaaaatcgagttaagagcccccaccactgctacagcagcataatagcaaatgagggagatatttttgactcagtttttcctatttgttttggcccagatctgaatttttgggttcctcagctggattaatttatatagttcttttacttttatatgttccccaggtagcaaagtaacgaaagccattttgtcacgttgagtttgatatcattctcttgatactgttttgtattgtatattgtcaagtaagcgtataggactcatctcggtgcaatggatggaatcaatgatggatgaagcatttgccgccaaagataccttcaaagctcccttcaaatctgaagggaagggaacattcaagactgtaagcttcaagttcaaagcaattgcaccaagaactagactcactttctacagctccttctaccataccagaattgatgactatggttctctttgtggccctgttgttgatcaagttatagtgttccctgt

SEQ ID NO: 270 - DNA, 281 bp, Glycine max
  Clone ID: PAT_MRT3847_40249C.1
gtcggtgtctttcgatgagctcattgcactctacgccgtctctgatgtgtgcttggtgtcctcgacccgagatggcatgaatctcgtttcctacgagtacattgctactcagcagaagcgtcatggcgtcatgatcttatccgagttcgctggcgccgctcaaagtttgaacggtagtatcattgtcaacccttggaacacggaggaacttgcagacgcaatccacgatgcagtcaccatgggtgcggagcaacgggctcttaactaccaaaagctggcca

SEQ ID NO: 271 - DNA, 592 bp, Glycine max
  Clone ID: PAT_MRT3847_40255C.1
ggctcgagatgccatcttatatgagtgtgttcaaacaataatgagtgttgaagataatggtggcttacgcgtgcttgcaatcaatatcctaggaagattcttgtcgcacaaagacaacaatatcagatatgtgggattgaacatgctgatgaaggctgtaactgttgatgctcaggcagtgcagaggcatcgtgcaacaattctggaatggctaaaggattctgatgcttcaattcagaaaagagctcttgaacttgtttgtattctggtgaatgaaactaatgtgaatgccttaacaaaagagctagtagaatatctggaagtcagtgatccagatttcagggcagaccttactgccaaaatttgctcaatagtttcaaagttttccccagagaagatctggtacattgatcaaatgctgaacgttctgtctgaggctgggaactttgtaaaagatgaagtatggcatgcctaaattgttgtgataagcaatgcttcagagcttcatggatatacagtaagagcattatacaaggcatttaaaatggcaggtgaacaggaaactcttgttcgcttaacagtttgggggata

SEQ ID NO: 272 - DNA, 1159 bp, Glycine max
  Clone ID: PAT_MRT3847_40335C.1
cgctttgtgattccaaaactcaagtgtctcgtgttccgcttttgacttccactcagatacctatatgagctagatcaacaccttgatcgctttttaaggtcagcatccatgtctaaaatagatcccccatttgatcgaggaagcataagaagaatactcatacaaactgtaagtgcttccaagtccagaaaaggatcactaagatattggctctcggcaggacctggcgactttcagttatctccctcttgttgccaccgatcaagtctgtatgcgatagtaatacaggatctgtcaccatcctcacctaatttcaggggcgttaaagttgtcacttcatctattcccattaaacaccccaagtttgctatcactaagagtgtgaactatcttccaaatgtgctctcaaaggtggaagctgaagaagctggtgcttttgtaggcatttggcttgatggtgaaggttttgttgctgaagggcctaatatgaatgtggcctttgtcactaaagataaggaacttataatgccacactttgacaaaattctaagtggctgcacagctaagagagttttaacccttgctgagagcttgttaagggagggtaagcttaaagggataagggtgaaaactgtgactgtcgaggaaggtaagcaagcagatgaaatgatgcttcttggcagcggagttcttgtttgccctgtagtgcaatgggatgagcaggttattggtgatggcaaagaaggccctataacgcaggctctcttaaatctaattgttgaggacatgaaatcaggtccctccactgttcgtatacctgttccttattgacacaactttatttccttctcttcattttgtaatgaagattaatcagtagttgtgatgcccctacttctacagggaggaatgactattaataacttcattgtctaatggtttttagagcttgtagtgttataagaaactctattccatggagcttagttttcaaatgtttttgtggtctcatgaactttttttttgagacttgctagttgttagtgaaaaatttgactcattcttctttccgtatcttatgaagggacaacttgctgctgctaatacgtgtgtactttgactttgttgttggaaatttgtgaagcatgagtttatgtac

SEQ ID NO: 273 - DNA, 524 bp, Glycine max
  Clone ID: PAT_MRT3847_40690C.1
gaaagcaatgctcttgccttgcctcttgttgttaagaagcttttgagggtgtcaccattggcttcaagttttgctgtgtctattctaaggaagatttgtgacaagagggaggaaggggttctggttgaggcacttcaagttggggtttttcagaagctcttggttatgctgcaggttgggtgtgatgagagcaccaaggagaatgctacccggttgttgaaactgttgaatggttacaggaacaaagcggagtgcactgactcatcatcattggatttcaagcatcttaagaagccattctaatttgtgatgaatggcaactagattcatttattctttatttttattatttgtataggtcaatttattgatacaaaattctttgctgtaaaaagatacacacatcaattgattctttgaattcattttggataattgattcgatgtaattagttagactactaataagtaataaccatggttgtggcaaatagccaaatacagagaagcatctttttaaatcc

SEQ ID NO: 274 - DNA, 2590 bp, Glycine max
  Clone ID: PAT_MRT3847_40691C.1
gtccagggtattaacttactttgtttgggagtcctgaaaagcaacaacgtgaacattataggacgtgagtattttaattgaagaaaaactaaattatatctgactatatatgatcttgaagctttcatttcagattactttgtcaattcatgcttcttatcaatatagcagccacaactgctatattcttattagaccttcttatgtcgacattgaaattctttagcatttcgccaatgcctgtctttgtttgtctgtttttaagtttaacaaatcacacatcaatactatgacaaaaacacctaaacttccacagttattgctgatgcattgatacatacctgaaatattcgacgtatttatcttcatgcagaaaatttcatgacgtcagtgtattaacttactttgttttgaaaagcgtgatatcataggacaaaatttcatgctgtccgaagctaactactttgacccatcctcatctcctccgcacacccatctatatatataccaaccacgcaaccttctcttcctcataacatctctcattcacctcacaacttcatcaaaccaaaaaacacaacaaaagaaagaaagaaagaaacaaagagttccttgctttgtagtaagatatatcatcaaaaatggttttgtcttggactagaagaaacgttttccgccgtgcaaagaaggagaaggaacaaagtcaattagaagtggaggttgtgattcccaaccactttcgctgtccggtgagtttggagctgatgacagatccggtgactttatcaaccggcattacctacgaccgtgtgagcatcgagaagtggatcgagggaggaaacagaacctgccccgtcaccaaccaggtgctgacaaccttcgacctcatccccaaccatgccattcgcatgatgattcaggattggtgcgtctaaaacagttcttatgggattgaaagaatccccacacctcgtattcctatctcggcatacgaggtttccgacacgtgtacgaggatcttgtcggcttgccagcgtggagatgacaagaggtgtcaggagttggtcgggaagattaaggtttggagtagagagagtgagaggaacaagaggtgcatagttggtgctggtgctggtgctgttcttgcatatgcctttgattgtttctcaagtaactctattgaaaaacatgtggttgttttggaggaggttttggaggtgatgacatggatgatcccatttggggaagagggtgtttctaaattgagttcaggagcttctttgaattcattggtttggtttctagaagggaaagaccttgcatcaaggcaaagtgctgctttgttgcttaaagaagtgtgtgttcaagaattggccaaggttggagaagttgttgaagctttggttaagatggttagggagcctattgggagcacttccacaaaggcttgtttggcaacaatttttaacttggtttcgttggctgcgaatagagagggaattgatcaaagatttgtggagttgggtttggtttcacttttgctagaggctattgttgatggagagaaaggggtgtgtgagaaggcacttggggtgttggattgcatttgtgattgcgaaaaggggaaggaggttgtgaagagcaatgctctagccttgcctcttgttgttaggaagcttttgagggtgtcaccattggcttcaggttttgctgtgtctattcttaggaagatttgtgacaagagggaggaagggattctgattgaggcacttcaagttgggctttttcagaagctcttggttctgctgcaggttgggtgtgatgagagcaccaaggagaatgctaccgggttgttgaaactgttgaatggttacaggaacaaagcggagtgcactgactcatcattgaatttcgagcatcttaagaagccattttaattagtgatgaatggcaactagattcatttattctttttttttttttgtgtaggtcaatttattgatacagaattttttgctgtaaaaagatacacacatcaattgattcattgaattcattttttggactggttatcgtatagtcttagaccgtgagaacatgattcttggttggagggaatctaactgttatgatgatgaactctctactttacctattaaccgatcaaatacacctgctatttctcctgccatagctgtgaatcctgaagcaagatcaagccagtctaataatcctgtgctgtcacctaatctctcatttaagataaaacctacttctgcgtttatgatggccctttttgtgcttttggccatattttgagcatatcttataggctattcagtgttatattactaatattagtattttctttagcacacaccagagaagcgttattactacgcattttttggattcttagtagcactattttgataatgagtttgtaaataatgtaacaacatgtcagtatagttgtgaaaatatatatttccattcttacatttagaaaaaagggttaaaggctgaccgccgtttttactcggtctcaaatgcaaatcctcacaggtcagttacaaaaaaaaaaaaaaaa

SEQ ID NO: 275 - DNA, 1860 bp, Glycine max
  Clone ID: PAT_MRT3847_40848C.1
tacggctgcgagaagacgacagaaggggaaacaatgcttgttttattttattttggtttatttttcgtttccatttgctctttcttccactgataatccaaagttccctcctttactttaaatcaacacatctcaagagagaaagagagagagagtgtgtgagagagagatggcaggtatcgctggtacatgtcctttaggagcattgctcagaaacagtgtctcagaaaacaatgggaagatatctgtggttcattatgaggggcttagattgcagcagagaatgcaaatgccttcaccaagccagtacatttcagcttcttcatcagctccaagatgcagaacaatcaaggccatggcttccccaactgttggagcaccaaagagagaaaaggatccaaaaaagcgggtagtaataacaggaatgggtcttgtgtcagtctttggtagtgacgttgatgccttttacaacaagcttcttgagggagaaagtgggataagcctaatagataggtttgatgcctcaaacttctcggtccgttttggaggtcagatacgtgatttctcttcagaaggctacattgatggcaagaatgaccggcgccttgacaattgctggaggtattgcattgttgcaggcaagagggcccttgatgatgccaaccttggaaagcaagtccttgacactatggacaaaacaagaataggagttctggtgggatcaggaatgggaggtataacggctttctcgaatggtgtggaagctcttgtacaaaagggatataagaaaattactccatttttcattccctactccatcaccaacatgggttctgccttgttggctatagacacaggcctaatgggtcccaattattcaatttccactgcttgtgcaacggcaaattactgcttttgtgcggctgctaatcacattagaaaaggcgaagcagatatcatggtggttggtggaactgaggctgcaatcatgcctagtggtcttggaggcttcattgcttgcagggctttgtctcacagaaacgaagaccccaagaaggcttcaagaccatgggacaaagatcgtgatggttttgtgatgggtgaaggctctggtgtgctggtaatggagagcttggagagtgcaacaaaaaggggagccaaaataatagcagaatatttggggggtgccataacgtgtgatgctcatcacatgactgatccaagagctgatggtcttggagtttcatcttgcataagcaagagtttagaagatgctggagtttctcctgaagaggtgaactatgtgaatgctcatgccacgtcaacactggctggtgacttggctgaggttaatgcaattaaaaaggtttttaaggacacatcagaattgaaaatgaatgcaactaagtcaatgattggtcatggtcttggggctgctggtggtttggaagccatagcaactatcaaagccataacaactggctggttgcatccaagcattaacctagataacttggaggctagtgttacaattgacactgtccctaacgttaagaagaagcatgaagttaatgttggtatatccaactcatttggattcggtggacacaattcagtagttgtctttgccccattcaggccataagtaggattcaaactcaatctgagtatttcttttactttgtcttttttttttctttacacattttgagaaccagtgatttttggacacaaattcataggactatgagttatggactgaaaatagttgtttcattatgtattgaaatcatatacccagatcgtgtggtctaatgtaatgagccctgaagtcaataaaatgtaattttcagccaaaaa

SEQ ID NO: 276 - DNA, 1086 bp, Glycine max
  Clone ID: PAT_MRT3847_40928C.1
attgagtcttggcgtggccaaagtagcagaaaataaaagtttcaaaggaagcctgatgggaattagcattggcacagtaacacaagccggaacagtcactagcacacagaaaatatggaggagtttacaagctctcggggcaatggcctttgcatactccttttccattatcctcatcgaaattcaggacaccataaaatctcctcctgcagagcacaagaccatgagaaaggccacaactttgagcatcgcagttactacagtgttctatttactctgtggatgcatgggttatgcagccttcggagataatgcacctggaaacctcttgactggttttgggttctataacccttactggcttctggacattgccaaccttgcaattgttatccacctagttggggcataccaggttttttcccagcccttatttgcatttgtggaaaaatggagtgcacgtaaatggccaaagagcaattttgtcaccgcagaatatgatatacccattccctgctttggtgtgtaccaactcaacttcttccgcttagtatggaggaccatttttgtgctgttgacgaccctcatagccatgctcatgccttttttcaacgatgtggttggaatacttggcgcttttgggttctggcccttgacagtttatttccctattgacatgtatatttcgcaaaagaagattggacgatggaccagtcgctggcttggacttcagttacttagtgccagttgcctcatcatttcattgttagctgcagttggttccatggcaggggtggttttggacctcaagacttacaagccatttaaaactagttattaaatcaaggccgtaagaaatagctagaagtgtttgaacatatgatatttttatacaaaactaatgataagttagtttgtgaaattaaagtatatacgttccatgcctgctgctgttagagcaacttgatttgaggaaaaaagtgataattggacataatatacctcagatttggacgtatacagtctgtgtatgtgtgttattttacaaggaataaaagtctttgaacgtgttatttctttagtcat

SEQ ID NO: 277 - DNA, 1850 bp, Glycine max
  Clone ID: PAT_MRT3847_40929C.1
attccgggtcagctttcttcttagtatcgagctacatatttcacagccatgttgccaagaagtagaacccttcctagcagaatccaccaaggaattatagaagagaggcacgatgtcaggccctacgtacaagtagaagtgcgacccaataatatccaaacggagacccaagcgatgaatatccagtctaactattccaagtgcttcgatgatgatggtcgcttgaagagaacaggaacattttggacggcaactgctcatatcatcactgctgtgatagggtcgggagtcctttcactagcatgggcggttgctcagcttggttgggttgctggacctgttgtcatgtttctctttgccgtcgtcaatctctacacttccaacctattaacacagtgttacaggaccggtgactccgttaatggacacagaaattacacctacatggaggctgtcaagtccatcttgggaggaaaaaaggtcaagttatgtggcctcatccaatatatcaatctgtttggagttgcaatcgggtacaccattgctgcctctgtcagtatgatggccataaaaaggtcgaattgctatcacagcagtcatggaaaagatccctgccacatgtcaagcaatgggtatatgataacatttggaatagcagaagtgatattttcccaaatcccagactttgatcaggtgtggtggctatccatagttgcagctatcatgtccttcacttattcttcagttggattgagtcttggagtggccaaagtagcagaaaataaaactttcaaaggaagcctgatgggaattagcattggcacagtaacacaagccggaacagtcaccagcacacagaaaatatggaggagtttacaagctcttggggcaatggcctttgcatactccttttccattatcctcatcgaaattcaggacaccataaaatctcctcctgcagagcacaagaccatgagaaaggccacaacattgagcatcgcggttaccacagtgttctatttactctgtggatgcatgggttatgcagccttcggagataatgcacctggaaatctcttgactggttttgggttctataacccttattggcttctggacattgccaaccttgcaattgttatccacctagttggggcatatcaggttttttcccagcccttatttgcatttgtggaaaaatggagtgtacgcaaatggccaaagagcaattttgtcacggcagaatatgatataccgattccctgctttggtgtgtaccaactcaacttcttccgcttagtatggagaaccatttttgtgctgttgacgaccctcatagccatgctcatgccttttttcaacgatgtggttggaatacttggcgcttttgggttctggcccttaacagtttatttccctatcgacatgtatatttcgcaaaagaagattggacgatggactagtcggtggattggacttcaattacttagtgtcagttgcctcatcatttcattgttagctgcagttggttccatggcaggggttgttttggacctcaagacttataagccatttaaaactagttattaagtgagatttaaagaaggtcgtagaaatagaagtgtttaagcttgatgatattatagaaaactaatgataagttggtttgtgaaatttaagtatatacgctccatgccgctgctgttagagcaattgatttgagaagaagaaaaaaatgataattggacataacatacctcagaatttggacgtatacgtgtctgtgtaactgctatattgaagtcaattgtaaggaataaaagtctttgaacgtgttatttctttaaaaa

SEQ ID NO: 278 - DNA, 175 bp, Glycine max
  Clone ID: PAT_MRT3847_41138C.1
gatgcagagactgtggatcgactacaccaaatccctctttcttgagggcttcctggatggtcagttgctgcaactgcatcatctccaatatgataacaaccttgactttggggacgaagttgtctttctcttgtttgaagattctgaaaggctactcatagatctaacctttgcc

SEQ ID NO: 279 - DNA, 242 bp, Glycine max
  Clone ID: PAT_MRT3847_41731C.1
gattcaacatttcacacaactactacaagtactgccttacgatcaataccaacagcaactattccaagttatcaaaagcactaccatgatcagggtcgcaaggttgactagtatttctacgttgagaagcaaaccgactaatactgcaaccctgttcatgctgctagtgtcacctatttaaccaccataacttcttctttttgtttacagcgattacatttataatcaacattataccacca

SEQ ID NO: 280 - DNA, 1140 bp, Glycine max
  Clone ID: PAT_MRT3847_42207C.1
ttgatgcgtgggcggacgctcttgttttcctttgtcaattgagaattgttcctctcttctcttccattcgtgtacgcgcaaaagaatcatgacgagttcctctgctgccgctcgcaagaatctgagtaagattgcctgcaataggctccagaaagagctcgtggagtggcaggtcaatccccccactggtttcaagcacaaagtcacagacaatctccagaggtgggtggttgaagtcactggagctcctgggacactttacgctaatgagacctaccagcttcaggttgattttcctgagaattacccaatggaggctcctcaggtgatattcttgcatccggctccgctgcatccccatatctacagtaacggccacatttgtttagatatattgtatgattcatggtctccggcgatgacagttagttctatctgcatcagtattctctcaatgctttcaagctcaaccacaaagcaacgccctgaagataatgaccgctatgtaaagaactgcagaaatggcagatcacccaaggagacaaggtggtggttccatgatgacaaagtataataattataaaccagtttctctaataagtccacaaaagtagagtagaggattatccttttgaaaacaaaatgaagaaatgggaaaatgcattttgagaaaccaggatccctttaaattcaatggataataactctgctgtaaattggcattgcctggtatttgtaaaggaaggggaaactatgtgtcttaagcaacttaaggagcaaacaaactcaaaacattgtggttaatctcacaggtatttggatgtggatatagatggtctgattaacccccttattgacaacttgtgtttcatacttcttttaagaattgcccattatatctcataattgactatatgcattgccgataaatactcccccattatatctcagaatttgattatatgcattgcctttatttttttttccttttcaatttccagaactggttttttttttcatttattttttttcactttcttgtttttgtattgtttattttccatttaatcgttctctttggattttaataaatttagtgttttattatttttttattattattttattttttatttttat

SEQ ID NO: 281 - DNA, 1647 bp, Glycine max
  Clone ID: PAT_MRT3847_4236C.1
tacaagttaacgagttatgggagctccccggacctcagttttaaaggggctttagggcgttaaaaagaaagcgcagagaaaggtgttgttctcagatccatccatcagtggtgggcgatgttgttgttctcagatccagactgagggggtgaaggaaaatgaagtcgtcgaggcgtctgttgaggatcgggcttgtgtcggcgtggtactcgtcgaacattggggtgctgctcctgaacaagtacctccttagcaactatggcttcaagtaccctatcttcctcaccatgtgtcacatgaccgcttgctccctcttcagctacgtcgccatcgcctggctcaagatggtccccatgcagaccatccgctcccgcctccagttcctcaagatcgccgccctcagcctcatcttctgcttctccgtcgtcttcggcaacgtctctctccgctacctccccgtctcttttaaccaggccgtcggcgccaccactcccttcttcaccgccgttttcgcttacgtcatgaccttcaagcgcgaggcctggctcacctatctcaccctcgtccccgtcgtcaccggcgtcgtcattgccagcgggggtgagccgagcttccatttatttgggttcatagtatgcattgcagctactgccgcacgtgccttaaaatccgtgttacaaggaattttgctttcttctgaaggagagaagttgaattctatgaaccttcttctttacatggctccaattgctgttgttttccttcttcctgctacacttataatggaagaaaacgtggttggcattacattggctcttgccagagatgatgtgaagatcatttggtatctgctatttaattcagcacttgcttattttgtcaacctgaccaattttttggtcaccaaacataccagtgctcttacccttcaggtgcttgggaatgctaaaggggccgtagcagtagtagtttcaattctgatatttagaaacccagtgtcagtcactggaatgatgggttattcactcacagtcctcggagttgtactttatagtcaagccaaaaagcgaagcaagtgatactgatgctgtctgtcattcatgattctgtggaaatcagcagtgaattccctatatttgttttcattcctgtgcggacaaactcaagattccatgaggcaaatttgttagcatgattgtgatcagaatgtttcagactctacaattttttggccctacatggaaaaacgggtttcccattgtattagtacctgtgcagaaatagcccacagtacaaagtttcaataagtgactgatctctctactatacccatgttggcatataatcgaggaatgtctttttgtcatttattctttgaagaaagagttgtagaaggacctctactcatttgttgtttacattgcttacatttgtttattgatgataaaatttgtatctgggatgcgccaacaacatcatacacacgaattaatagattgatcttctccactctactcatttgttgtttacattgcttacatttatttattgatgataaaatttgtatctgggatgcgccaacagcatcatgcacatgaattaatatattgacctgcgcaactttttaaaaaaaaaaaaaaaaaaccc

SEQ ID NO: 282 - DNA, 1378 bp, Glycine max
  Clone ID: PAT_MRT3847_42797C.1
tacggctgtgagaagacgacagaagggggtggaaaaaaagcattttgcaactgctcgcagcttaacgctgcaatttctttccaagttggtcgagcgacttcaggattgccttgcatacttttggtgtttgaagagctaatctgtctaccaaaatgaagggacgtgtaaggtgggatgaggctaatattggagaaattgaggcaaacaaacctgtgaggcagaaaattactgagcctaagactccatatcatcctatgattgatgatgacagttctctatctcctgtacgaggaagttttgatgcatgtattgataatgaaaatcgtgctgaagcaatatggagtgctctgaatgatgtagcctccagtagcagaagaggcactggacaatctggtggttggacatcatctgaggatgagccagaagcaatggagcaagatgatgatgattctgaaacagataggaacttgagttttaaagagcacagaaaggcccactatgatgaatttcttaaagtcaaagagctgcaagagacgggttctcttgaggatgaaagtgacgaggatcataattctcaacccagtaaggcggagaaatgtgagtcgtcttcactgagtcatagtgtaaaagagatggtcattgagggtaagaagtcttcaacgcctccagctaatggttcttagacagtgatcaacaaataaaatccactgtcttttcattagtttcattttgtgtattgaagaaaactaaatgattcactgtattgtatcatttgtatgtaaatagtttctttcttcatcatgcttattatgatccgttcacacttttgtattctggcaaattggtttgttttcggcatctttgaggaatttgcttgtggcttttataaggaattaaggttggatgcttaaagggaggaaatatcccaaactgaaactatatttcatttcttatttccttgtgatttttatgtgatttgtgtgggagtattatgccccaatttttaataccatatttcttcaaccacttgcataaataactgaatcaaatttattaactctttgccattcaacttattgaatgaagggtataacaccaaatcattgatgttgcatgatgcaaacagataatgcaatctaatctcagacgcacagaaaccatcatatgccatcataagcaaaatacaagcctccttcaccgtaagcaagtacttcttcacaatgctatcatttgctttttcagtggcctaacagcacttggcactcccaatccttcttcacagttcccacgcctgttatgtagcatctttggacggagaaagaaagtaccgcaaaatggtaagtatttgtgatgaaccaagatcctcgaaccgcgatcc

SEQ ID NO: 283 - DNA, 1930 bp, Glycine max
  Clone ID: PAT_MRT3847_43305C.1
gcacttgcccgcgcggttgtactgccactactagctcacaggatgggaacatgaacattagcagaaaatcaaataagacccacttgttagattggttacactagcagcacgcagggttctgttctgctttgcattctccgccatcatcatgcaagcgcttcactctcccaccctccgcgcttctcccttggaccctcttcgtggccccaacaatgccgccgccaaccgccgctcctccagcgccaagcgcgtgttcttcgtctccgccacggtggcgccgaaggtgtccgccccgcagcgacagaaggaccccaagaagcgcgttgtgatcaccggaatgggcctcgcgtcggtgttcggtaacgacgtggagggttactacgagaagctcctcgccggcgagagcggcatcaccgccatcgaccgcttcgacgcctccaagttccccacgcgtttcggcggccagatccgcggcttctctgccgagggctacatcgacggcaagaacgaccgccgcctcgacgactgcctccgctactgcattgtcgccggcaaaaaggccctcgaaaacgccgaccttgcccccgacaaccactccaagattgataaggagcgtgctggtgttcttgtaggctctggaatgggaggcttaacggtgttttctgacggtgttcaggctctgattgagaaggggcacaggaagataacgccgtttttcattccttatgcaattactaacatgggttcggctttgcttgggatagaccttggattcatgggtcccaactactctatatccacggcttgtgctacttccaattattgcttttatgctgcggcgaaccatattcggagaggggaggctgatttgatgatagccggtgggactgaggctgccattattccaattgggttagggggttttgttgcttgcagggcgctttcgcagaggaacgacgaccctaaaaccgcttccaggccatgggataaggaacgtgatggctttgttatgggtgaaggtgctggagttttggtaatggagagcttggagcatgctatgaagcgaggcgcacctattattgctgaatatttgggaggagctgttaactgtgatgcttatcacatgactgatccaaggtctgatggacttggtgtgtctacatgcattcagagcagccttgaagatgccggtgtgtcaccagaggaggtcaactacataaatgcacatgcaacttccactcttgctggagacttggcagaaattaatgctattaaaaaggttttcaaggacacttctggcatcaaaattaatgccaccaagtctatgatagggcactgccttggtgcagctgggggtttagaagccattgccacagtgaaagccataacaacaggatggctgcatccaacaatcaatcaatttaacccagaacctgcagttgattttgatacagtggcaaatgtcaagcagcagcatgaaatcaacgttgccatttcaaattcatttggattcggtggacacaactctgtggtggcattttctgctttcaagccttgattgcccagcttagcttgtctgcactttatgtagaacacgggtttaagttaattgaaattttgttccctctacatcattgaggttatttactctagctgagtccatcatcatatataaaaagctgtaggcatgtagttgttcattttgtgcctaattgtgacttgacaattagctataagactattttgtagtagaacattttgaatatagctcgaagattttattagtttggaggtatacagcagcggatagaatgtcaaagagcttatattcttaagcattcttccttattgttaagtatcatttgaatctcagggcggcccgggcccccttgatcggcttcttgaatacatgcttatacaacattatttc

SEQ ID NO: 284 - DNA, 249 bp, Glycine max
  Clone ID: PAT_MRT3847_43345C.1
aaaaaaaaaaaaaatttaaaaaaatttaaaaaaaaaaaaaaaaaaaaaaaaaaaaaaaaaaaaaaaaaaaaaaaaaaaaaaaaggggcggccgttttaaagaatcaaagttaactaacccttgaatgcaacaaaaaagtttttttatagggcaactaaaattaaattaattgcccgtggtttaaaaacgtcggaattgaaaaaaccttggcgttaccaaattaaatggctttgaagaaaatcccctttt

SEQ ID NO: 285 - DNA, 1885 bp, Glycine max
  Clone ID: PAT_MRT3847_43486C.1
cttgtgatctctccgtagggacaataccatgcctcttggtcctttctctaatccaaatatctctccgttaatgctctcaccacaaacttcaatagactagccaaaagctaacaccaactataggccaaatcaccaataaatattatttcccgttcttttggcgtgttggccacccactgaacacatttgcactcacacatagaagcagagagaggccattggttggtttcagagatgggaagcatgcacatagaaaccccagaaacttttgctgatggtagcaaaaacttcgatgatgatggacgagctaaaagaactgggacttggattactgcaagtgctcatatcataacggctgtgattggttctggagtgctatctcttgcatgggcaattgcacagatgggttgggtagctggtcctgcagtgctctttgtcttctctttgataacatacttcacctccactcttctcgctgactgttaccgttcacctgaccctgtacatggcaagcgaaactacacatattctgaggttgtcaaagccaacctaggaggaagaaaatttcagctgtgtggattggctcagtatataaatcttgttggtgtaacaatcggctacactataactgcatcacttagtatgggggcggtgaagaagtcgaactgtttacacaaacatggccatcaagacgagtgcaaagttaaggacaacgcttttatgattgcttttgcctgcatccaaattcttctaagccaaataccaaacttccataagctctcttggctctctatcgtagcagctgttatgtcttttgcttattcttccattgggcttggcctttccatagccaaaatcataggtgggggacacgtgcgaacaaccttaacaggggtggaagtttcgggaacggaaaaggtttggaaaatgtttcaagctatcggtgacattgcctttgcttatgctttttctaatgtcctaattgagatccaggacacactgaaatcaagcccacctgagaacaaagtcatgaagagagcaagtttgattggcattatgactacaacattgttttatgtactatgtgggtgcttaggctatgctgcatttggaaatgatgcaccatctaatttcctcacaggattcggcttctatgagcccttttggctaatagactttgccaatgtctgcatagcagtgcacttagttggggcataccaggtctttgtccaacctatatttgggtttgtggaaaagtggagcaaagaaaattggacagaaagccaatttataaatggcgagcatactttgaacattcctctatgtggaagctacaatgtgaacttctttagggtagtgtggaggactgcatatgtgattatcactgccgttgtagctatgttactcccattcttcaatgactttttggcccttattggtgcactctctttctggccattgacggtttacttccctatagagatgtacattaagaagtcaaatatgcaaagattttccttcacctggacttggctcaagatattgagttgggtttgcttgatcatttctattatctcacttgtgggttccatccaaggcctttcggttagtatcaagaaatacaagcccttccaagcagaacaatagaactttcatacttagtattccaacttgagccaagagtttctattgagggcgacaaaatttgtattactatgttttgaaatagttgttatattttcaattctcgaaatcgagacaacttgttatactaaagtaatataataaaatgtttagtttgctatgttaaatggttttcttcttggtagctgtttttttttcttttttgttaggttatgtttagattgatggaagaggatggaat

SEQ ID NO: 286 - DNA, 3616 bp, Glycine max
  Clone ID: PAT_MRT3847_43512C.1
ggggaataaagtatcaacccaaatatatatcatgttatctggtaaattgagttattatacaggaatccctactaaaatggacatcgcactaccttttacgaaaaaagagtaaccttagtgcaagccccccaacaaaatacacaattcaaaatacatggcagccaatcgcgaccagctggcagtgatagcactaccttaaattatcattccctcatctataagcagaaactagttttatctccatatacacgaagaattataacatgatggtgtttttatttctccgctaatgtttagtccctgatttgagatcataatgccagaacaatagctgcaaatttaatcggaatcaatactaactagcaacaataaaaaatttataaatcactaaaccacattcttctcatccataaaacacattagacaatccactgaaacattgtaaatcccaagcgcaacgcgcacttgaaatcataaaattcattaatacaataatcccactatggcaagccacattggatccatattatcggtaatacatatccaatcaactaccacatcgcaactgccatcgcctattcgcctggttgttgcttagatgtttccttgatctcatctccagcatcgtccgtgatgtctgatgtccacaaagtcagattgtcacggagaagttgcatgatcaatgtactatctttgtatgactcttcacccaatgtgtcaagctcggaaattgcctcatcaaatgcctgcttggcaagattacaagcacgatctggcgagttaaggatttcataatagaacacagaaaagttgagagcaagtcccaacctaatggggtgagtgggggccaagtcagcaagagcaatatcctgagcggatttgtaagcaagcaaagtactctctgcagcctctttcctctctgccccggtcttgaactcagcaaggtacctgtggtaatcacccttcattttaaggtaaaagactttgctctcgggagatgcagcggaaggaatgaggttggactcaaggaggttcaaaatcccatcacagatcttgctgagttcagcctcaattttgcccctgtactcctttataatggccacgtggtcctcattgcccctgctctcctccttctgctcaatggaggatatgatcctccacgaagccctcctcgcaccaatcacgttcttgtaagccacagagaggagattcctctcctccaccgtcaactcctcaacctccacagtctttgcaaccttctccatgaactcaaccatctcctcgtaacgctcggcctgctccgccaatttcgccatgtaaacgttctcctcccgagaagaatccgccatttctcagattcgcaaattcctcgcaccaatcacgttcttgtaagccacagagaggagatttctctcctccaccgtcaactcctcaacctccacagtctttgctaccttctccatgaactcaaccatctcctcgtaacgctcggcctgctccgccaatttcgccatgtaaacattctcctcccgagaagaatccgccatttctcagattcacgaatctcaccgcttaatcctaaaaaatggaagatgcagatctggaaaggagaaacaaaaaggaaaccctaaaaggagaagaaagtgggacgatgaacctgctcagaacttggtaagcctcacctaaaacctgaaaattttgtgcagcaagagggtcatttgggtttttatctggatgcacttgccgtgccttaatgtaataagctttcttaatctcggcttcggatgccgtagggctgacacccagcacgtcatagtattcggtctccttcaccatttcaaagcccagttgattgatagtggatgacgtattccaagccaaaaccaaatggcgttatccttctcactaaggcctaaactctctctccgcctgttgtggttggtatggacgtgggaatcccgggcgttgactgctgcaaccgcgtaattctctgtgtgaagccctcctctccggtggttccgactttttgccctcccccttctgtcgtccaggcgtagaattattagacaagcaaaacaacactgcacaatgcggtccccgccgacaagatgcgatctccagcacatacaggcacattccacacgagcgatacatacaatacaccccctcaaaaaccaacaaacaatcaaataaactacaaaccggatatcaaactcaatccttgctggttgaagtaggtctctgggcacccgggggggcggttggcctagggaaattataatcaaattgcatgccagcaaagcgcggggcctccacataggggctctgagacgaaaaatcaggacttgaagatttgggtgatgtactaggagaagtatcattgccagtttcacttccattcaacttgtgtactgccttatttggacactttcattctcgtttccattggctgatttaaccctctggaagattttaccaagagtttttaaccctttagctcgagcgcggagttcttctttcttggcaccgttgtcttgaagaaccatttgacaaacgcgggaaagagtggcttcaatgtctgccacattaagcttccacaatgagtcaatcattaatttcttgtgattttgcatgtattcttcaagctcttcttcagtatagtccccttctgaactgagttgctttttcatatcctcctgcaattggattaaagcaattgcccctgttgctgctgtaacttgagatttaatagagtgccctttgtttctaaaccactcagcaataaaaggcacacccaaataaattgctttcttccctagctcttttgctgcctgccttgcgtatatgtagccaatggtattcaacatatcaaccccataagctgcattagatagccgggctacttcagcttctgcatcattaacaaaaccctctttgtttccttgaacatattggttgagtctatttttcagtatctctgcaagcttttcttctctctccttctgaacaaccctcattttctcttgcaactttttactatcaaattgttctccttcagtaaagatgtccattgaagccattgatgccatggctaactgacctatatattcctcaaaaagctcactaccaaaaagcatggcaaagattgctgcaggatcaataattgcttcagttgaaattcctgattttccatgagcatcataagcttgtctttgagctgggtcactcagaacttggtaagcctcacctaaaacctgaaaattttgtgcagcaagagggtcatttgggtttttatctggatgcacttgccgtgccttaatgtaataagctttcttaatctcggcttcggatgccgtagggctgacacccagcacgtcatagtattcggtctccttcaccatttcaaagcccagttgattgatagtggatgacgtattccaagccaaaaccaaatggcgttatccttctcactaaggcctaaactctctctccgcctgttgtggttggtatggacgtgggaatcccgggcgttgactgctgcaaccgcgtaattctctgtgtgaagccctcctctccggtggttccgactttttgccctccgcgttccgtcgtccag

SEQ ID NO: 287 - DNA, 596 bp, Glycine max
  UNSURE (1)..(596): unsure at all n locations
  Clone ID: PAT_MRT3847_43712C.1
  unsure (1)..(596): unsure at all n locations
cgggattaaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaaatttgaatgttagattgatttcaaagcatacctatagtagggtgaatgtcttcatatatgatatgatttccttttaggcagcactttactttggtgagtatggtttataacttaagaatgactttgttgaaccatnttagtttgatcgt

SEQ ID NO: 288 - DNA, 837 bp, Glycine max
  Clone ID: PAT_MRT3847_44678C.1
ggctcgacccacgcgtcagcggacgcgtgtacggctgcgagaagacgacagaaggggagattcgtcttcagtttcagcctttctctctcactcactcactcacagttaagcaatggcgggaaaaggagggaaggggcttcttgcagcgaaaaccaccgcggcgaataaggacaaagacaaggacaagaagagacctatttctcgctcttcccgtgctggaatccagtttcctgtgggacgtatccataggcagctgaaacaaagggtccaagccaatggacgtgttggggcaacagctgcagtgtacttagcctcaattcttgagtatctgactgctgaagttcttgaacttgctgggaatgcaagcaaggatctgaaggtgaagaggatcacaccaaggcatttgcagctggctatcagaggagatgaggagctggacactcttatcaaagggaccattgcttggtgcgtggtgtcattcctcacattcacaagtccttgatcaacaaaaccgccaaggattgagctctctttggccttctgaattcatgttgctgtttactgaaaactaagtttgtggtttattgttgaattgatcacagcagtaggtttgtatgaagatttattttaacagttttataactcaggtggtagtgtgtaaatggcttgcttgctagacaatgctttctttaactgttttagttggtctgtttttagagctttaaccatgttggattgctagacaatgcttgcttttagatacaatctgtgatctgttgttgtctttgttgcccattgaccccttcatatatggttgttttattttaatctttgcaa

SEQ ID NO: 289 - DNA, 1379 bp, Glycine max
  Clone ID: PAT_MRT3847_44731C.1
gcagaaacagaagcacagcaccacgaaccaatcccagcctttcggttcccccacaaataaaatagttaccacaacccatttgttgcttgctgcgagcgaatccctctctctctttctctttctctctcatccagatcttgcaaaaaaaaaaaaacacaatggcagcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccattataatgctgtttagaatattaagatattgttctctagcaaacttggtattgctaattgttttagcatgtgaaggtgtgacacctttatttgtttttattctaaagcctcggaatcatttattccgatcgattttaacgtgtttttgttgtgaggattgtcaacttcattatgtttgggtgcatggggttatggagaatttgatataaaaagtatgatttct

SEQ ID NO: 290 - DNA, 1446 bp, Glycine max
  Clone ID: PAT_MRT3847_44732C.1
gatgggtggcagaaacagaagcacatcaccacgaaccaatcccaacctttcagttcccccacaaataaaatagttaccacaacccactattagttgcttgctgcgagcgaatccctctctctatctctcacacacactttctctctctctctctctctcacccagatcttgtagcaatggcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgtaacctcctctccgtcgcctacaagaacgtgatcggcgctcgccgcgcctcctggcgcatcatctcctcaatcgagcagaaggaggagagccgcggcaacgaggaccacgtcgccgtcatccgcgactaccgctccaagatcgaggccgagctctccaacatctgcgacggaatcctcaaactcctcgacacgcgcctcgtcccctccgccgcctccggcgactccaaggtcttctacctcaagatgaagggagactaccacaggtacctcgccgagttcaagaccggcgctgaccgcaaggaggccgccgagagcacgctctccgcctacaaagccgctcaggacattgctaataccgagttgcctccaactcaccctatcaggctgggtcttgctctgaacttctccgtgttttactatgagattcttaactctcctgatcgggcttgcagccttgcaaaacaggcttttgatgaggctattgctgaattggatacattgggagaggagtcatacaaggatagcactttgatcatgcaactgctacgtgataacctcaccctctggacctctgacatgcaggacgatggtgcagatgaaattaaagaagccgcacccaaaggtgacggggaacaaaattaaacataccatactctctgcttattagtcattgaacttcccttctgtaatgttttcaaagggagaaggtgttgaatgctaatctcaatgttactgagattttgggcattcgtgttcttcgttatgaattgtggatgtactgggctattttagtttgtccttccatttatacgcgtttctgaactgcctattttcttaatgacactgaaatttccattatgatgctgtttagaatattaccaagatgttgttctctttagcaaacttcgtattgctcattattttaggatgcgaaggtgtgacacctttcatttgtttttattctaaagcctcggaatcataactctgatcgattttaacgtgttttttgttgtgagggttttcaacttcactatgtttaggtagggttttgttgttcttgatcgctattttagtgcaatgcccatggggtcatggaaaagtgtttgatataaaaagtatgatttct

SEQ ID NO: 291 - DNA, 1044 bp, Glycine max
  Clone ID: PAT_MRT3847_44887C.1
cccacgcgtgcgcttttcttctcgcagagcgaaatcccaatcccacacaaatggcatgctcagccacctctgcttctctcttctccgcaaaccccacacctctcttctctcccaaatcctccctctccctccctaacaactctctccacctcaaccctctccccacgcgcccttctctctccctcacgcgcccctcgcacactcgccgctccttcgtcgtcaaagcctcctccagcgagcttccgctagttggaaacaccgcaccggatttcgaagcagaggctgtgtttgaccaggagtttatcaacgtgaaactatctgattacattgggaagaaatatgttgtgctcttcttctacccgttggacttcacttttgtttgtcccacagaaatcactgctttcagtgaccggcatgcagagttcgaggcactaaatactgagatattgggtgtttcagttgacagtgtgttctcgcaccttgcatggatccaaacagatagaaagtcaggtggccttggtgacttgaattatcctttgatttctgatgtcaccaaatccatatcgaaatcttatggtgttctcattcctgatcagggaattgcattgagaggtttgttcattattgacaaggaaggggttattcagcattctaccattaacaacttggcaattggtagaagtgttgacgagacaaagagaactctccaggccttacagtatgtgcaggagaacccagatgaagtttgccctgctgggtggaagcctggggagaagtccatgaaaccagaccctaaacttagcaaagactactttgcagcggtgtagctaggatactagatagttaagagtggctatctgcatctgtatcagtcagtgtgaattgcaaaagggtcttgtttcttaatgttttgtaagtccttaaattttgagccgcagggtatgggaatatactaataaatgcatgctggattttgaagtgtactatgtattaatttgcaatttattttgattatgatctctgtttcgtgttcatatatgagcc

SEQ ID NO: 292 - DNA, 296 bp, Glycine max
  Clone ID: PAT_MRT3847_45016C.1
cttactcgtgggcggacgcgttggaaaaaaaaaaaaaaaaaaaaggggaaaaataaaaaaaaaaaaaaaaaaaaaaaaaaaaaaaaaaaaaaaaaaaaaaaaaaaaaaaaaaaaaaaaaaaaaaaaaaaagggggcggccgttttaaaaaatcaaaatttacttccccttgcttgcaacgtaatagctttttttttgtgccacctaatttaaattaattggccgtcttttaaaaacgtcttaactgtaaaaaccctggctttaccaaatttaattgccttgaaaaaaatccccttt

SEQ ID NO: 293 - DNA, 870 bp, Glycine max
  Clone ID: PAT_MRT3847_45510C.1
cggaataatctttgtgatccacgcgttttttcgctttgttatcaaagacttaaatcaacacgttggacgagtttttttctgtctgtagctgtcggaagtttgaaacatacatattcttcttaattttgggtcagtagtatgtggaagttgaagatagcagaaggaggagatgggttaatctctgtgaacaatttcattggacgtcaacactgggagtttgatcctaatgctggaactccacaagaacgtgctcaagttgaaagggtacgagaggaatacaaaaagaaccggttttgcattaagcaaagcggtgacctactcatgagaatgcagctcacaaaggagaacacgtgtgggcccattctagcaagagtgaacgtgaaagacacggaaaacgtaacggaggaagcattgatcactacaatgagaaaggctatcaatttctattcctctattcaagcccatgatggccactggccagcagaatctgctggccctttgtttttccttcaacctttggtaatggcactctatattacagggtccctaaatgatgttttaggaccagaacaccagaaggaaattattcgttatttgtataatcatcagaacgaagatggaggttggggattgcatatagagagtcacagcacaatgtttgggtcagcgttgagctacattgccttgagaattcttggagaagggcctgaagatggtgaagacagggcaatggctagaggcagaaaatggatcctcgaccacggtggtttggaagctattccatcctggggaaagttctgggtcacggtacttggagtttatgagtggtcaggctgcaacccacttccaccagagttattatttgggtat

SEQ ID NO: 294 - DNA, 123 bp, Glycine max
  Clone ID: PAT_MRT3847_45570C.1
gccagctgtgactgcctgtatcacccttgtacctccatcaatcatcagtgctattacagcagttacctttggcgcattgattggcacaatccatcagggcacaacaattacatgaacttgtgc

SEQ ID NO: 295 - DNA, 1869 bp, Glycine max
  Clone ID: PAT_MRT3847_45795C.1
gtacacccgcggtaccggtccggattcccggtcgaccacgcgtccgcattttcattttcttaagcgcccatttcccactcctcctttctctctctttcattattgagacttctttccagatttctcaatctatggctctgcattttcttctcctgctgctttttgcagtgtctgttgttgcagctgatgaagaaccatttataggagtgaatattggaacggatctctcagatatgccacaccctactcaagtagtagctctactaaaagcccagcaaattcggcatgttcgattatatgatgcagaccaagctatgctccttgcacttgcaaagacaggcattcaggttgctgtgactgtcccaaatgaagagatcctagcaattggtcaatcgaattccacggctgccaattgggtttcccgcaatgtggtagcgcattatccagccaccaatatcactgccatttgtgttggttctgaggttttaactaccctcccaaatgcagcaaaagtacttgtcagtgcgattaaatacatccattcagcccttgtggcatccaatcttgatcgccaagttaaagtttcaacacccctttcctcatccatcattcttgattcatttccaccttcacaggctttctttaatcgctcactcaatccagttttagtcccactacttgatttcttgcaatccactggctcttatctgatgctaaacatatacccttactatgactacatgcaatcaaatggagtgattccgttagattatgcactcttcaagtctctccctcctaacaaagaagctgttgattccaatacccttctccactacaccaatgtctttgatgccatggttgatgcagcatactttgccatggcctttctaaattacaccaacattcctgtagtggtgaccgagtcagggtggccctcaaaaggtggctccaacgaaccagatgcaacggtcgacaatgcgaatacttacaacagcaatttgatcaagcatgtgtttaacaaaaccggaactcccaagcatccaggaatagatgttagtacatacatctatgagctctacaacgaggatatgaagtctgggccattgtcagagaagaactggggactgtttgatgccaatgggacacctatttacattctacacttgacagagtcaggggcagtcttagcaaatgatactagcaataatactttctgcattgcaaaggacggtgctgacccgaagatgctgcaggctgcactagattgggcatgtggaccggggaaggtcgaatgctctccattgctgcagggtcaaccatgctatgaaccagacaatgtgattgcgcatgcaaattatgcatttgacacttactatcataagatgggaaagactcctgatgcatgtgacttcaatggagtggctacaatctccacctcagatccaagtcatggttcttgtttatttcccggaagtgttggcaaaaatggaaccttaggtaacttcacagctccttccatgaattctacaaattcagattcctcagcctacaaattcagctgtgacttgagaattagaagccttttaatggtaacaggatttctattatggggagtggttttgctataaagtggtatatgtcagaacgtgttactttgaaattttttgtggtggatgataatgctacatattcgtcttggtacgattctattgttcatagtggtccattcaattttgtacaaaaaccagctaagggtttggaccgaatgaggccgcaactgaattatcatcatcatcattattattcttttcaactagaattgattcaatctttatcaaaaattgaagtgattcaatctatatcaaccat

SEQ ID NO: 296 - DNA, 254 bp, Glycine max
  Clone ID: PAT_MRT3847_46662C.1
ggctgtaaaatgtagtcacgtctgtgggaattaggctagtcaataaagccttgatggctacatatggatttaattttgctacatgctttaactgcactacatcattccacaacaaccttgttgacacttactcttaaatcaatctcatatatccatacctctcatctaccattatctgatatcatcaaatttgtctcgtttgcatatttcttcattgttgttattaatgtgattttaatgttgaactcttacat

SEQ ID NO: 297 - DNA, 1828 bp, Glycine max
  UNSURE (1)..(1828): unsure at all n locations
  Clone ID: PAT_MRT3847_46694C.1
  unsure (1)..(1828): unsure at all n locations
attggaaatgtaaaatgatttcattctaattttttaagaatcaaactcaagtaaatttacaagactctgacagcaagcatgatcttttctaaaatagtaaaatgactttagagtttagagtaggtcacattattaaattaaaaaataataagccatgagaaaaggaggcatcgcgctcgccgagatcgtcttcgaggtcctcactctttctcatttccacatatctgacagaaaaaaatggagaactatcagtacccggcgtcgtaccctgactccggcgagtcctccccgcgctcgcgcgagatcgacttcgagaacccgccgccgtgggacgagcagcagaaccaaaactacaaggccaagttcatgtgcagctacggcggcaagatccagccccgcacccacgacaatcagctctcctacgtcggcggcgacaccaagatcctcgccgtcgaccgctccgttaagttctccgccttcctctccaagctctccgccctctgcgactccccgccacaggacctcaccttcaagtaccagctccccggcgaagacctcgacgccctcatctccgtcaccaacgacgacgacctcgaacacatgatgcacgaatacgacagactctatcgccctaacctaaaacctgttagaatgagactcttccttttcacactctctaattcaaaccctaattcctctttctcctccgaacgcgaccgtttcgttgaggctcttaattcgggtccggttccttctcaacccgatccgatcaaaaccccacccgttacgccttctaatgttgattatctcttcggtctcgataaagccgttgctcctccaaatcttcctccgaacttcgcagcggttaaattccacgatccggtgccggaacctgtcgctccgacgccggtagagtatcaatcgagagtttccgatcgggttgttggatcggatccgaatgtgaattcgatggaaattcagagacagatgcagcaggagatgcagcgattgcagattgcggagaatgaatatcgtagaaggagtgaggatggatttgcaactggttatgctgctgcagccggaggagattattacatgcagaaggtgcaggagaaggttccgccgcagaatgcggcggtgccgcctccggcggcgtactggtcggagaagcagttttccggggagggatatcagacgacggtgacgacggcggctccgggaggaggtgaccagccgatgtatgttatggcggcgccggggacgttctatcaccactcgccggtgatgcgacctccggcggcggcgcagggatactacgctgtgcagaggatgggttctgatggctaccgtgaacagcaggcggtgtacggaggcgtggctgcgccgaaagcggcgttttcttcggcggggatggttaaggggccggcgtattcggagggatatagtggcggcgtggtgaggcctgcggggttgccggataatgcggcgtatgcgcaggtggcgtatgatagcgcgagtgggagacaggtttactatactgcgcagggagggatggtgcacgcgccgccgccgccgcagtaccagggggttccgcctcaggaattgaggccgggtggggtttcggtggggcaggatggtaaggtggttaacaaggttaaccaaggttctgtgtgattataatagctgtgattgagattgtcattatgttaattttgaaataaataatacactaaatatgttttgcttttttttttttttctcttcatggnttatatatatacactaaatattacgagtattgtttgctaataatttatgggtagtgctt

SEQ ID NO: 298 - DNA, 128 bp, Glycine max
  UNSURE (1)..(128): unsure at all n locations
  Clone ID: PAT_MRT3847_46867C.1
  unsure (1)..(128): unsure at all n locations
cgctactactagntccttcaactctcgctggcaacaacagcagtcctancattaagnngcgtttttccaaagtgcttttcnagcaattagcgatgggnatngcnagaggaggcttcnagggattcagg

SEQ ID NO: 299 - DNA, 1469 bp, Glycine max
  UNSURE (1)..(1469): unsure at all n locations
  Clone ID: PAT_MRT3847_47972C.1
  unsure (1)..(1469): unsure at all n locations
ctgtctctgttatgtgggaagacgacagaaggggagaagaagagagagacagacagaacaatgggggaagcaaagggaaaggaagaagaagtgttagcctcagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatgctagattggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatggttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgagaatgcgttgtggctgcgagaagacgacataagtggattgggaaaggaaataaaaaatgaaagctcttacctttactgggcatacaagaacaacattccagttttctgtccgggcttaactgatggctcattgggggacatgctgtacttccattccttccgcaatcctggtctgattgtggacatagtgcaagatataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgagactctgctcagactgttaaggtacactgtgatgcaacaatagcatttcctctgctggttgctgaaacgtttgcttcaagagtgaaacctccccattgatgaaggttaaagatgaatttactctgaagttcattttaattgtgtgtgtttgaggatcttgatggacaagttcggcattggtgttcaatttgactatcatttgattcctaagctcctcttagcagtggagacctttttgaccattcaaaggtaatccattaatcctgtcagtgaggaagtcaggaattatagatgtgaggatcattgtactaatatctttagggaaaataaggctaagaaaactaactgatcatatatggcatttttaatattttcccccananaaaaaaaaaaaaaaaaaa

SEQ ID NO: 300 - DNA, 422 bp, Glycine max
  Clone ID: PAT_MRT3847_48100C.1
gtgctgcacatgtgaggctgttgagatggttagaacccttgcgatgatcaagcccgatgggttgtcaggtaagtacacagaagcaatcaaggaggtcatcttggattctggatttcatatcgtcaaagaaaccgaggtccagcttgatgctgagagggcatctgtcttctatgcggagcattcccagagaagcttctttgacagcctagtcaagtacataacaagtggtccagttcttgctatggttctggaaagacctgacgccgttgcgcaatggcgcactgtgattggaccaactgatgcaaaaaaggccaacacctctcatccaaacagcattagagcaatgtgtgggctggactctgagaaaaattgcgtgcatggttcggattcaccagaatctgcagacagagagatctcatttt

SEQ ID NO: 301 - DNA, 112 bp, Glycine max
  Clone ID: PAT_MRT3847_4964C.1
accaggagaccagtttcgtgaccattggccaacgaattttggcaaatcctttaagggttcggtttcattatggccatcctgatatatttgacagactcttccacacaacata

SEQ ID NO: 302 - DNA, 195 bp, Glycine max
  Clone ID: PAT_MRT3847_504C.1
cgagaatgtactacctcaaggcagatttcattcaaagaacccaaatggcttctaataagattcctacatgggtagggggaaccaaacttattattttggaacctggatttggtccttaacaactagacctatttggtataaaaaaaacatattttatttctaaataaaaggtaaaacagaggggaaaaatggaaa

SEQ ID NO: 303 - DNA, 2190 bp, Glycine max
  Clone ID: PAT_MRT3847_50784C.1
accgatgaaaacgacaacatgcgactttgtttttttaacgatgaaaacgaagtgtattgagtaatactccgttccctggttcctccatcgcgaaattagggttcgctcacttgtcttcaatttcccagattcacctagcaccatccataaatccccctattaacgtgtctttcggaccgatttttctacgtgacgcatcgcaattcttcagcggtttcgtttagggaacccgcgaaaccgaatcagatagtgcggcacggaaactaggaattaaagcaatggcagaagatctggtgctggatactgcaatcagagactgggtgttgatccctctctctgtggttatggttctcattggtgtgctccgttactttgtttctaagcttatgcactcttcacaaacccctgatgccaaaattgttaaagaagggcaagtgattgttagagctcggaatttacgtgctggggcgaatttcattccatccaaggcatttcgcgctcgcaaaatttatttctggaacgaggaaaatggtctgttgttcctgaaacagggagaaggcctgatcccgcaagcacagatgttcatggatatgatgaagaaaaaccatacgatgataatacaccattctcttacttttgcttgggtgaactttttcttttctggatttgtagcagccaagataccctttccattgacacagaggtttaggtcaatgctacagaacggaatagaccttagcacagtagatgttagctatgtcagcagtcgctcttggtacttcctcaatctgtttggattaagaggattgtttagtctcatcttgggtgaagaaaatgctgtagatgatacacaacgtatgatgcaaatgggtggatttggatttgatccttcaaagggtctaagtgctgagaaagacaatcttgacataacccagcatgactgggccttaccgaattttgagcagcgtgctgaagctgtgttgaggaaagttgccagttaaccatgttatggagtaggaagcttcattgctagcattagcaggatacacttactttctattgttgcggtaggaggtgtacctttttgcagaaaagatatcaaagatcttgttgagactgtagtcttgagactgaacattttgcaactatcagaaaacattgttcggttttgttgaagctagaactgaaactattcattcttgcttatttttctgaatgaccattgccataaaaagcatgaaggcttcccaggaaacgttgagtcctgtaatgtgtttcaaggcctattcaactattctatctgtatcccacatcccactcctagaattgtcccctaatatgttaaattaagaaatattacattcgcatctcttattctgcttttgttgcagaattagaatgcaggtgaggtgcacttgattataatcagatgctaaaaaattgtgatgtgatgtaatgcatgctcaaattaccaaaagccgaaagaatgttttaaaatttgaattgagtgattaacaattacaaatatgagtggtttactctagatttttcataattttgaatatcaatcattgaaaattattgtatgattcacttgttgactctcctccccccaacccccgggcaataccagaaggaggtacaaatgatcttttatttcaatgaggtgctatgatgtaaatgatctttcaccaaggatgacagtcaggtgaaattggacacttctagtagaaataaacaaaatgtagaggcattctatccagtgtacaagaaaaggaaatagacgcagatttcaaacaccccgcaatccatttgatccatttggaactgaatcctgttctttccagcaaatataacagaaaattccaagacacagagtcataagccttctcgtagtctactttgaactcaaggcaaggttgactgcttcttttggcctcttcaatcaccttatttgcaatgaggacactatgtagtagatgtcttccttcaataaaagcagattgtgtctcatctacaataaaggacatcaccttcttcattcttttagccagcaccttagagacaatcttgtacatacaacctattaatgagatgggtctatagtcattcaagaattgagggtcagccaccttggggattaaagctatgaaggatgcattgcagccccttgggaacactccattagca

SEQ ID NO: 304 - DNA, 724 bp, Glycine max
  Clone ID: PAT_MRT3847_50935C.1
tcgggaatcgatcgaatatgtcgggaaaaggggcaaagggattgataacaggtaaaacctcagcttcagccaaagacaaagacaaagacaagaagaaacccgtttctcgttcttctagagctggtcttcagtttcctgttggacgaattcaccgtcttttgaagtcaagggtgagtgccaatggaagagttggggccacagctgctgtgtattctgctgctatactggagtatctaactgcagaggtgttggagttggctggtaatgcaagcaaggatctgaaggtgaagcgtattacccctagacatttacagcttgctatacgtggagatgaagaacttgacaccctcattaaaggaacaattgccggtggtggtgttattcctcatatccacaagtctctaatcaacaaatcctcaaaggagtgagggttaaaagaaaaatatttgaattaaccttggagatgagttttcctgtaaatttgatggtatcttattttgtggatattttgcttgttgtgttagtttggtagaagagacatcctgcagcagttctgatatctttatttgagctgtatggactgacatactggcttctgtgctctgttgctgcaagctagctacatgaaactagctgttaggatgtatattgaagcatggttaattattatgttcaacctattaatctatgatgtttcaatgttttgaactgtttggcgtgtgcg

SEQ ID NO: 305 - DNA, 765 bp, Glycine max
  Clone ID: PAT_MRT3847_51233C.1
ggctcgagctcgagccgaatcggctccccctggagccgatttccctgtctctgttctcttcaccattctctttcttctttgtttcaagtttcaacaacccagattcactctctctctcgtaattttctctcttattgaggctagaaaaagagagcaaaaaaactaaaaaatgcctgcggtcggaggtataaacaccggagggggcaaggagtaccctggaagcctcactctatttgtgacggtaacatgtatagttgcagccatgggtggtttaatcttcggttacgatatcggaatttcaggtggagtgacgtccatggatccgtttctgctcaagttttttccgtcagtgttccggaagaaaaactccgacaaaacggtgaaccagtactgccaatacgacagccagacactgacgatgttcacgtcgtccttgtacctcgccgctttgctgtcgtcgttggttgccgccaccgtcacgcgtaaattcggccggaaactctccatgcttttcggaggcttgcttttcctcgtcggtgccctcatcaacggtttcgcccaacacgtttggatgttaatcgtgggtcggatcttgctcgggttcggtatcggcttcgccaatcagtctgtgccactctacctatctgaaatggctccatacaaatatagaggagcattgaacattggctttcagttgtccatcactgttggtatccttgtggccaatgtgttgaactatttctttgctaaatcaaaggtggttgg

SEQ ID NO: 306 - DNA, 2086 bp, Glycine max
  Clone ID: PAT_MRT3847_51235C.1
gtttctttcactttcttcgaacctctttgcatatacttattttttcaactctgttctcttcaccattctctttcttctttgtttcaagtttcaacaacccagattcactctctctctcgtaattttcttctcttatttgaggctaagaaaaagagagcaaaaaaactaaaaaaatgcctgcggtcgtaggtttattgaatcttctcaccccagtttcactttctcattattttctctcctattgataaagaaacagagagagagagaaaaaaatgcctgcggtaggaggtattagcaacggagggggcaaggagtaccctggaagcctcactccttttgtgacggtaacatgtatagttgcagccatgggtgggttaatcttcggttacgatatcggaatttcaggtggggtgacatccatggatccgtttctgctcaagtttttcccgtcggtgttccggaagaagaattccgacaaaacggtgaaccagtactgtcaatacgacagccagacactgacgatgttcacgtcgtcgctgtatctcgccgcgttgctgtcgtcgttggttgcctccaccgtcacacgtaggttcggccgaaaactctccatgcttttcggaggcttgcttttcctcgtcggtgcccttatcaacggttttgcccaacacgtgtggatgctcatcgtgggtcggatcttgctcgggttcggtatcgggtttgccaatcagtctgtgccactctacctatctgaaatggctccatacaaatatagaggagcattgaacattggctttcaattgtcaatcacagttggtatcctcgtggccaatgtgttgaactacttctttgctaaaatccatggtggctggggatggagattgagtttgggaggtgctatggtccctgcccttataatcacaataggatcactagtccttccggacactcccaattccatgattgaaaggggtgatcgtgaaaaggccaaggctcagcttcggagagttcgcggcatcgacgatgtggaagaagagttcaatgaccttgttgcagctagtgaatcctccagaaaagtggagcacccgtggaggaacttgttgcaaagaaagtacagaccccacctcaccatggctgtgctgattccattcttccagcaactcactggaatcaatgtcatcatgttttacgcgccggtgttgttcagctccatcgggtttaaggatgattctgctctaatgtcagctgtgatcactggcgttgttaatgttgtggcaacttgcgtctcaatttatggtgttgacaagtggggtaggagagcccttttccttgaaggtggagttcaaatggtcatttgccaggctgtagttgcagctgctataggagcaaagtttggaattgatggaaaccctggtgatttgccaaaatggtatgcagttgttgtggttctcttcatttgcatttacgtatcagcatttgcctggtcatggggtcccctaggttggttggtgcctagtgagatctttcccttggagatccgttcggctgctcaaagtataaatgtgtcggtgaacatgtttttcactttcttgattgcacaagtcttcttgacaatgctttgccacatgaagttcggcttgttcatcttctttgcctttttcgtgttgatcatgacattcttcatctacttcttcttgcctgaaaccaagggcattcccattgaagaaatgaaccaggtttggaaggcacaccccttctggtccagattcgtggagaatgatgattatggcaatggtgttgagatggggaggggaactgctatcaaagaagtgtagttacttgtttatttttctcaatgactagcgttttagcttttgttggtaaatcatactattggtggtgtcaatgtattgaattgttcctataaattaaaaagggttattttcttatgtatcccctgcttcttcatatgaagcaagtttacaggatacttttctatattaatccaattgcacaaattgttatgcctttgaaaacaaaaagaaagatgtacactcatacctcatagccatccgatttcatatccttt

SEQ ID NO: 307 - DNA, 1832 bp, Glycine max
  Clone ID: PAT_MRT3847_5172C.1
gaacacaaccacctctcacctcaaatgacttcccattctctcttttgaaatcactacacaacaccaagaaatccaaatctaattcctcatctcgtttgatatcctgattcctactctcttagtttccactctattgtatggatgcatgtgatgaactgatgatatatgcatttgcttttatagtttgcttggccaccaagtaacgacaaagagaaacagtttctaactttttcttggctggttgtaaataatctctcttttctctattggatcatagctttctgcaccctcttcctcttaggttcccatatttttctctcttgtcgtggacctcaactttgtaggctcgccttagaaaaaaccttcttttctttttggtgggggtgagagttgctatcttattcctggtttcatcaacaagacactaacatctttgttgtttttagtttcagaattccttatactcacacaccaaaattctggtacaccatgatttttccaagattttgtacgaatctaaaaggtatggcttttatagattctcaagtttatcttgatcacacaggtaaaagattctgaaaatctgtgcaccttgtgaatcaaagctctataatttcttcctttccgtgtatctcttctgtgttttttgtgagcagccttttctagttcctctccatttccatctctttaggaacttaattcaactaagattttttgtgtgcttgtggcttgaggtatggaattggaaaccctctacaccccttgttatatgccaaactcaaattggtttgtgcaagagagcctcagcacagagtggactagagaagataacaagaagtttgaaagtgcccttgctatatatgacaaggacaccccagatagatggttcaaggtggccgctatgatccctgggaagactgtgtttgatgtgatcaagcaatatagggaactggaagaagatgtgagtgaaatcgaagcagggcatgttccgattcccggctaccttgcatcttctttcacctttgagctggttgacaaccacaactatgatggatgcagaagaaggcttgcacctgtcagaggctctgatcaagagagaaagaaaggagtcccatggactgaagaggaacacagacgttttctgatgggacttttgaagtatggtaaaggagattggagaaatatctctcgcaattttgtggtcacaaagactccaacccaagttgctagccatgcacaaaagtactacataaggcaaaaggtttctggaggcaaagataaaaggagacctagcatccatgatataaccactgttaatcttacagaaacttctgcatcagacaagaacaagcctcctgtgattgcaccacagcagaagctgaatagcatgtcaaaagtacagctggactggactagtagccactacaatgatggatcactcatggttttcaacccaaatagtgatgacttgtttgtgtcatcttcatctgatgtcacttccatggccctgaaaatgcaagggcaagatctctatgaatgtgccttacgtgaggcttatgccaaggtaaaagttccaggtttcagcatggctcctagagacttcaataatgaagctgtttttggtattcatgcactgtaattccaaccctgatgatgttaaagaaaaaattatagatcattgttctgtaggattaatgtagatgacctgaagctagcaagctacttcgttcatcattagtgaacatcctaaaagaaaactagactaatgtttcaatccttaaaaactgaatttggaatggacttcttttaaagttttcctcttttatcttttt

SEQ ID NO: 308 - DNA, 1900 bp, Glycine max
  Clone ID: PAT_MRT3847_5173C.1
ctaactcttactttcccctctgttactttctcgagccgattcggctcgagctacacaacaccaagaaatccaaatctaattccttatctcgtttgatatcctgatttctactctctcagtttccactctattgtatatctgtatatgtatgtatgtgatgaactgatgatatttgcatttgcttttatagtttgcttggtcaccaagtaacgacaaagggaaacagtttctagctttttcttggctgattgtaaataatctctctcttttctatattggatcatagctttctgcaccctcttcctcttaggttctcctatttttctctcttgtcgtggacctcaactttgtaggctcaccttagaaacaaaacttcttttctttttggcgggggtgagagttgctatcttattcctggtttcatctacaagacactaacatctttgttgtttttagtttcagaattcgttatactcacccacacaccaaaattctggtacaccatgatttttccaaggttttgtacgaatctaaaaggtatggcttttatagattctcaactttatcttgatcacacaggtaaaagattctgaaatctgtgcaccttgtgaatcaaagctctataatttcttcctttctgtgtttctgtgagcacccttttctagttcctctccatttccatctctttaggaacttaattcaactaagtttttgtatgcttgtggcttgagatatggaattggaaaccatctaccctccttgttttatgccaaattcaaattggtttgtgcaagagagccacagcacagagtggactagagaagataacaagaagtttgaaagtgcccttgctatatatgacaacgacaccccagatagatggttcaaggtggcagctatgatccctgggaagactgtgtttgatgtgatcaagcagtatagggaactggaagaagatgtgagtgaaatcgaagccgggcgtgttccaattcctggctatcttgcctcttctttcacctttgagctggttgacaaccacaactatgatggatgcagaagaaggcttgcacctgtcagaggctctgatcaagagagaaagaaaggagtcccatggactgaagatgaacacagacgttttctgatgggacttttaaagtatggtaaaggagactggagaaatatctctcgcaattttgtggtcactaagactccgacacaagttgctagccatgcacaaaagtactacataaggcaaaaggtttctggagggaaagataaaaggagaccaagcattcatgatataaccactgttaatcttacagaaacttctgcatcagataagaacaagcctcagttatttaatgcgtctcctgtgcttgcaccacagcagaagctgaatagcatatcaaaggtacagctgggctggactagtagccactacaatgatggatcattcatggttttcaacccaaatagtgatgccttgtttgtgtcatcttcacctgatgtcacttctatggccctgaaaatgcaagggcaagatctctatgactgtgctttacatgaggcttatgccaaggtaaaagttccaggtttcagcatggctcctagagacttcaataatgaagctgtttttggtattcatgcactgtaatgccaaccctgatgatgttaaacaaagaaaattccacgtcatagatcattgttctgtaggattaatgtagatgaccataagctagctagctactttgttcatggttagtgaacaacctaaaagaaaactagaataatgtttcaatccttaaaaactgaatttggaatgaacttattttaaagttttcctctttatgtctatttctttggtgacccgatcagatcgagtatggaaaaccattcaggc

SEQ ID NO: 309 - DNA, 147 bp, Glycine max
  Clone ID: PAT_MRT3847_51785C.1
ggctcgagtaaattcctcgtggaatattggaggagccatgtctacaggtgggcaagtcgtcaagtgcaaagctgcggtggcatgggaagcagggaagccactgtcaataggaaccatagaagtggcaccaccccagaaaagtggagt

SEQ ID NO: 310 - DNA, 888 bp, Glycine max
  Clone ID: PAT_MRT3847_51981C.1
tccggatacccgggtcgaagagcggactattccctcctccttcctttgcctctttcgcttttgctttctaggttttttttttttttttcttgctctttctctgtgtcgatggcgggaaaaggagggaaggggcttgtggccggaaaaaccacggcagcgaacaaggacaaagacaaggataagaaaaggcctgtctctcgttcatcccgtgctgggatccagtttcctgtgggtcgtatccataggcagttgaagcaaagggtgcaagcaaatggacgtgtgggggcgactgctgctgtgtacttggcctccattctggaatatctgactgctgaggtgctggagctggcggggaatgctagcaaagatctgaaggtgaagaggatcacaccaaggcacttgcaactcgctatcaggggagacgaagagcttgacaccctcatcaaagggaccattgctggtggtggtgttatccctcacattcacaagtccttgatcaacaaagctgccaaagaatgaaaatcaaatgcctctttgcttctcctattatgtgtttctttatgtttatgtagtgttagtaagtgtagtaggcctttgctactgtttaagaacagatgttgatgttattgtgtaaatggtcattctattggcttttaacttgcctgttgtgatactcctggaattgtaacgctgttggattttaagagttctttgtattagctttggtgcttgatttagttgttttttctggccatttatctcactgatattggcttgttttattttaattgacctttgctaaatgatccctcccagtgatttagtgaactgggaatatcaaaaaaaaaaaaaaaaaaaaaaaaaaaaaaacggccgctctagaggatt

SEQ ID NO: 311 - DNA, 286 bp, Glycine max
  Clone ID: PAT_MRT3847_51C.1
aaaaaaaaaaaaaaaaaaaataaaaaaaaaaaaaaaaaaaaaaaaaaaaaaaataaaaaaaaaaaaaaaaaaaaaaaaaaaaaaaaaaaaaaaaaaaggggcggcccttttaaaggatccaattttacttccccttgcttgcaacgaaataccttttttttagggccccctaaattaaattcacgggccggggtttaacaacgtggggactggaaaaaccctggcttacccaaacttaatcgctttgaagcaaatccccttttccccagtttgcttaataccaaaa

SEQ ID NO: 312 - DNA, 199 bp, Glycine max
  UNSURE (1)..(199): unsure at all n locations
  Clone ID: PAT_MRT3847_52241C.1
  unsure (1)..(199): unsure at all n locations
cgagactacctccggtccgggcagcgagtaaaccgcccggccggcgcgcgtcgttggatatatgatgagtggacgtgacagagtgtcncattatatcttaattgcgtcattttcctccttccttctaataagacttctctctcaccctcggccccaccttcacgtgtgattggaggtgtttgtcgcttttgtaataatt

SEQ ID NO: 313 - DNA, 981 bp, Glycine max
  Clone ID: PAT_MRT3847_52622C.1
gggattgaccatgcaagcttcttgcttgcacttcaaatggccgctgaagctggaatccatattttaggttgggttacaacagcttgggtgcatttgcaaccattaaccatctccactttcaggcatattacttggctctgccttttccaattgagaaggcccctactaagaaaattgccaagttaagcggtggagtgaaaatatctaaactgttaaactatcctgtcagaggccttgtctttgagggcggtcattctctagagggtttagcaaatgttgtttcagaagcctgcatctgccttcagcacaacaacataccttacaatatacttatttcagactgtggaaggcaaatctttctcttaccacagtgctatgcagagaaacaagcccttggagaagtgagtgccgagcttctggagacacaagtgaatcctgctgtgtgggaaatcagtggtcacttggtgctgaagaggaagaaggactatgaggaggcatctgaagccaatgcttgcaggcttcttgctgaggtctccctctctgaagagaggttccaagaagtcactgctcttgtttttcaagccattgcatcggttgagatgaatgtcaagcctcaattacttgaggaagttgatgctgttagcccaagcactcagcgtgccatggtggctggttcacatgaatgccttgttctccagtaacaaggctatgatgaacaaattcgtagtgattatggatatatattgtgttatgttacgtttcagttctaatacctgtagtacctgggttcagttactggagtttgaagtatttattatatgcatgttttaaggacttaaaaaattatgtggttgattgtccgtcgtgatctatgtggaaatacaatttaataactgttcttttgagccttattcagtgtttagtgtttgtggttgattaatgtgacatactcatcactctatctcttaattctcttcaacc

SEQ ID NO: 314 - DNA, 2271 bp, Glycine max
  Clone ID: PAT_MRT3847_52624C.1
tccacgcgtccgcacaactccccctaaatctctcatcatctcttatctttctctctctctcttataatacaagaccctagtcctctctcacgccccaaccaccaccatcaaccaaaccttcctctctcaatttcccttcaattcccttctgggctttgcaattcggccaattgggtccccaaatctgtaaccttttcctctgtctaacgcgaaacggaagagaaacacccacatagagaaagagaaaaaaaaaggagaggaagaaacaattttagggtgtggggttaaaacccggggttgaagcattgcagacatcacggctattcaaggagttcgccactctctttctcatgcccgttgtgtccgacgcaagggttgtgtgacggagagcaatccttcgccgcacggcgggcgtggcgctctgccttccgaaggtggcagcccctccgacctcctcttcctcgctggcggtggttcttcccattaacattctaaagtagtattagccattaacattacatcctacaccttcaaaagttctctctattagcggtttctggtttcttttgttcttcttctttggtagttgttaggtttggtgaggtctaagatgttgagcattaagagggttcccactgtggtttcaaattatcaaaaagaagagacaggggaggctgctgccggaggttgtggtcgtaactgcctcaaaagttgttgcattcaaggtgcgagactgcctttgtatgctttcaagaaggtggacaaggtttgtggaaatgaattgcctttgcttggatgcaaggagcagcaccctgtggcctttctggactcgcttgttcttggagagtgggaagatcgcatgcagagagggcttttccgctatgacgttacagcctgtgaaaccaaggtgattcctggggagtatggtttcattgctcagctgaatgagggtcgccacctcaagaagagaccaactgagtttcgtgttgataaggtcctccagccctttgatgaaaacaagtttaacttcactaaagttgggcaagaagaggtcctgtttcagcttgaggctagcaatgatggggaggctcaattctttccaaatgcacctattgatgttgagaattctcctagttttgttgccatcaatgtgagtcctattgaatatgggcatgtgctgctgattccacggatttttaagtgtttacctcaaaggattgaccatgcaagcttcttgcttgcacttcaaatggcagttgaagcaaggaatccatattttaggttgggttacaacagcttgggtgcatttgcaaccattaaccatctccactttcaggcatattacttggctcttccttttccaattgagaaggcccctactaagaaaattgccaagttaagcggtggtgtgataatatctaaactgttaaactatccagtcagaggccttgtctttgagggcggtcatacactagaggatttagcaaatgctgtttcagaagcctgcatctgccttcagcacaacaacataccttacaatgtacttatttcagattgtggaaggcaaatatttctcttaccacagtgctatgcagagaaacaagcccttggagaagtgagtcctgagcttctggagacccaagtgaatcctgctgtgtgggaaattagtgggcacatggtgctgaagaggaagaaggactatgaggaggcatctgaagccaatgcttggaggcttcttgctgaggtttccctctctgaagagaggcttctagaagtcactgctcttgtttttcaagccattacatcatcggttgagatgaatgtcaagcctcaacgtcttgaggaagttgatgccgttagcccaaacgcacagcatgccatggtggctggttcacatgaatgccttgttctccagtaacaaggctatgaacaaattcgtagtgattatgaactaaatattgcttgccatgttacgtttcagttctaataagtgtagtaccttatattatggtccagttactggagtctgaagtatttatgttttaaggacttgaataattgtggtttgtattttattatatggactcgctgtacggtgcttgattgtccttcgtggtctatgtaaaaatacaatgactgttcttctgagccttattcagtggttagtgtttctgtgtttgtggtttgattaatgtgacatactttcatatagtgaggcatgggaatgtgcaagtagcatttatataaatggtgcttgatctttttctattt

SEQ ID NO: 315 - DNA, 1694 bp, Glycine max
  Clone ID: PAT_MRT3847_52745C.1
acactacccactcaactcactccaaccatggcgtcgtggtggtgctcctctccctccgccaccctcaccgtctccaccaccaccacccgccacttctctctcctttctcacacttcccaatttcgcatccaaaccctcacattcccaccttcctcctttactcgcttcaccaccgctccaccttcgctccgatttagggttccatgctccaacaaaaccgccttcgaaaccgagcttccggaggacggcgtggattgcgtgggaacaggccaagacgtggaatgcctcgttaacacggaagagaaacaatcggaaccatcatcatcgtcatcatcatcatcatcatcgtcatcgatgctgtgtctcgcggaagcgctgtgggaaggggcggtgttggtgtcgccgttcttcttctggggcacggccatggtggcgatgaaggaagtgcttcccaaatgcggtcctttcttcgtttccgcttttcgcctcattccggcggggtttcttctcgtcgcattcgccgcttccagaggaagaactctcccctctggcttcaacgcttggctttccatcaccctcttcgctctcgtcgatgccgcgtgctttcagggttttcttgcagaagggttgcaaaggacttcagctggtttgggcagcgttataattgattcgcagcctttgactgtggctgtacttgcggctttgttatttggtgagtcaatcggagttgttggagctgctgggcttgtacttggtgtcataggacttgtactgctcgagttacctgccctatcatttgatgaaagcaacttctcactatggggaagtggtgagtggtggatgctacttgcagctcagagtatggcaattggcacggtcatggtccggtgggtctccaagtactctgaccctgtcatggctactggatggcatatggttattggtggtctcccacttgtgctattcgcagttcttaacaatgaccccgcagtgagtttgagtctcaaagagtacagttcgactgatatattggcactcctctacacatccatttttggaagcgcagtcagctatggtgtgttcttttatagtgcaactaaaggtagcttgaccaagctcagttcacttacgtttttgaccccaatgtttgcttcaatttttgggtttctctatcttggtgagaccttctctcctgtacaactagttggggccttagtcactgtggctggaatatacatggttaacttcagaagcacatctgaatgaattgtcatttttgcctggttctttcaacctaatccaatggaaaacaactctgggaattagatgttttccatgaactcaaattgggaacgataaaagcaagtttggacatggagaggagaaattgcagtgatatacaacttggagcccttgtgctcatgctagtgtaaatacaattttgttttgttagttaatttaggcctcgagcctcttcctatgcaatatataccaaaaacttgaagttacctgggcagaacacaagccttatatcggaataaattgtttccgtaaaggtttttttgttgtgtaagatggcttaagtgttacattatgactgaacaaaatgtatatattatgactggtttatggcaagtttcgtgtatagtaatctgttatgaaagaaatatacatctcgggccaatgactataaa

SEQ ID NO: 316 - DNA, 177 bp, Glycine max
  Clone ID: PAT_MRT3847_53506C.1
agcagctgacaatcaaactcaggtaggtatcaaggtgctacaaggcgagcgggaaatggctgcagacaacaaaatgcttggagagtttgaccttgttggtattcctcctgctcccagaggtctgcctcagattgatgttacatttgacattgatgccaatgggattgttacttgtct

SEQ ID NO: 317 - DNA, 1158 bp, Glycine max
  Clone ID: PAT_MRT3847_5356C.1
caagaactttgtgaacagtgaatccctatttaagagtcatcgtcagcagcagcacccttggatgagcccccagccttcttgggaagaagaaggttgtgaatgttaggcataacaccgccgatcactaggtcacacttcatcaatggcgggtagaggcaaaaccctaggatccagcgccgctaagaaggccacctcaaggagcagcaaagccggcctccaattccccgtcggtcgtatcgccaggttcctcaaggccggaaagtacgccgagcgcgtcggcgccggagcccccgtctacctcgccgccgttctcgaatatctcgctgctgaggttttggaattggctggaaacgctgcgagagataacaagaagactcgaattgttccacgccacatccaattggcggtgaggaacgacgaagagttgagcaagcttctaggagatgttaccattgctaacggcggtgttatgcctaacattcacaaccttcttcttcccaagaaggctgggggctcatccaagggtgctgctgctgacgatgactcttaaatagggattcactgttcccacgcgtctgggctgctgctgcagacgatgactcttaaatttgggttttttttccgtgaaaagttatcgaatttattctctttggattctctctgtttttgtagtttttcagtttttgataattgtgttctgtagatgtagttaggttttcagtcactgatgtgaatagagaacgctctttttcttcaagaaagattgttggaaatttaaatcattttaattcgtaaaaaaaaaaaaaaaaaaaaaaaaaaaaaaaaaaaaaaaaaaaaaaaaaaaaaaaaaaaaaaaaaaaaaaaacaaaacacaaaaaaaaaaaaaaaaaaaaaaaaaaaaaaagaaaaaaaaaaaaaaattaaatagacaaaaaataaaggggggcccgttttaaaaaaaccaaattttacccccctggattgccatgaaatacctttttttttgggcccccaaaaaaaaaataatggggcccgttttaaactccctaacagggaaaaacccgggggtatcccaaataaatcccctttaaaaaaaacccctttttccccggtgggtaaaatacaaaaaagcccccccatatctccttttccaaaaat

SEQ ID NO: 318 - DNA, 1898 bp, Glycine max
  Clone ID: PAT_MRT3847_5357C.1
gcgtccgcttctcttaaatttctcagtctccggaactcgtttctaccttcacttcgcacatctcgaaccctctctttccggcaactaggttaaagttcatcaatggcaggtcgtggcaaaaccctaggatccagcgccgccaagaaggccacctcaaggagcagcaaagccggcctccaattccccgtcggccgtatcgcccgtttcctcaaggccggaaaatacgccaagcgcgtcggcgccggtgctcccgtttacctcgccgctgtcctcgaatatctcgcagccgaggttttggagttggctggaaacgctgcgagagacaataagaagactcgaattgtgccgcgccacattcaattggcggtgaggaacgacgaagaattgagcaagtttcttggtgacgtcaccatcgctaacggtggcgttatgcccaacattcacaatcttctccttcccagaaggcccgtggcttatctaaggcaggaaaaaggaaaaaaggagcgaatcaaaaaaaaagaaatacatattctcttctcaaatttctcagtctccggaactcgtttctaccttcacttcgcacatctcgaaccctctctttccggcaactaggttaaagttcatcaatggcaggtcgtggcaaaaccctaggatccagcgccgccaagaaggccacctcaaggagcagcaaagccggcctccaattccccgtcggccgtatcgcccgtttcctcaaggccggaaaatacgccgagcgcgtcggcgccggtgctcccgtttacctcgccgctgtcctcgaatatctcgcagccgaggttttggagttggctggaaacgctgcgagagacaataagaagactcgaattgtgccgcgccacattcaattggcggtgaggaacgacgaagaattgagcaagcttcttggtgacgtcaccatcgctaacggtggcgttatgcccaacattcacaatcttctccttcccaagaaggccggtggctcatccaagggcgctgctgctgacgatgactcttaaatagggattcgcttttcttgatttttttattatcaaatttagattatcttttggcctctctgttttgtagtttcttttttagttttgataattatgctctgtagttgtagttaggttttcattactgatgtgaatagagaatgctcttgttcttcaagaaagattgttgaaaatttgaatcattttaatttgtaatttttcagtctcgatctagcacttgattcctggttgtaatctataatattcgaattcaaactgttttaaatttgtttccctgacctcatccttccatcaaaatgatatctatcactatataatggagcaaacccttgactttcccaatatcctttaaaagcagtctgatcctcccaagcccattcatcccaatcaacaccatgatcaattttgttttgaccttttgctagtgctttggaagttggagaatattcatcttcaaaaccaaacatttgatcggtgtcatcaaaaacatcactaataccattcccataataatgcatactaggcaccaatctcttgtgatttaaacggcttcttaatccttcaacatctgcttcatataaaacaacacctttcccatcagcagcaccaacagacctttttacaagattacgacccacgccaccgcccgttaaccatacatctgcacgccgattcatggcatcatatatgcgatcgaggatagaggtgacgcatgtctcgacaaaattctagcacgcctagttgggcgcagcctacagaggtgatcataagctagagtggccaacagcataagataaaagtagccatacccatggacctcgtcatgagaccttacgtagaaatcatagtccacttcaacggaat

SEQ ID NO: 319 - DNA, 1609 bp, Glycine max
  Clone ID: PAT_MRT3847_5358C.1
cccacgcgtgctcccacgcgtccggctgcgagacgacagaaggggagatatacattctcttgtcacagttttctgtgtcaccggaactcgtttctttcaaaacacttcaaacatctcgaacgctctctttccggcaactaggttaaagttcatcaatggcaggtcgcggcaaaaccctaggatctagcgccgccaagaaggctacctcaaggagcagcaaagccggcctccaattccccgtcggccgtatcgcccgtttcctcaaggccggaaaatacgctgagcgtgtcggcgccggcgcccctgtctacctcgccgccgtactcgaatatctcgcggctgaggttttggaattggctggaaacgctgcgagagacaacaagaagactcgaattgtgccgcgccacattcaattggcggtgaggaacgacgaggagttgagcaagctactcggtgacgtcaccatcgctaacggtggcgtcatgcctaacattcacaatcttctccttcccaagaaggctggtggatcatccaaggctgctgctgcagacgatgactcttaaataggggttttttttccgtgaaaagttatcgaatttattctctttggattctctctgtttttgtagtttttcagtttttgataattgtgttctgtagatgtagttaggttttcagtcactgatgtgaatagagaacgctctttttcttcaagaaagattgttggaaatttaaatcattttaattcattgcatgccctgttaggtagttccttacgcgccggctcgggttctcaagttttcgtcgggagcaacagccagaggggaaatatataacttcttctaggtgtccggaaatcgttcctatcatcacttctcaaatctcgaaccctctcgttcgtgccgatcactaggtcacacttcatcaatggcgggtagaggcaaaaccctaggatccagcgccgctaagaaggccacctcaaggagcagcaaagccggcctccaattccccgtcggtcgtatcgccaggttcctcaaggccggaaagtacgccgagcgcgtcggcgccggagcccccgtctacctcgccgccgttctcgaatatctcgctgctgaggttttggaattggctggaaacgctgcgagagataacaagaagactcgaattgttccacgccacatccaattggcggtgaggaacgacgaagagttgagcaagcttctaggagatgttaccattgctaacggcggtgttatgcctaacattcacaaccttcttcttcccaagaaggctgggggctcatccaagggtgctgctgctgacgatgactcttaaatagggattcactgttcacaaagttcttgaatttagattctatgtttgctctcttttttttttcctttttatttgtagttatgataattgtgccctttgtagtagtagttaggttttcagtcagatgtgtttaaagaatgctcttacgcatcaagaaaggttgttcaaaatttaaattattttaatgtcacctttgagtcttgatctagcaaaaaaaaaaaaaaaaaaaacccctcaaattttaatttaactgtttgatttggtcttgttcttc

SEQ ID NO: 320 - DNA, 220 bp, Glycine max
  Clone ID: PAT_MRT3847_53649C.1
tcgcgaagagaacgtctacatggcgaagctcgccgagcatgccgagcgctacgaagagatggtggagttcatggaaaatgtctccgccgccgccgacaacgaggaacttaccgtggaggagatgaacctcctctcctgtgcctacaagaacgtgatctgagcgcgccgcgcctcgtggctcatcatctcctctatctagcagatcgaggagagccgcgcg

SEQ ID NO: 321 - DNA, 134 bp, Glycine max
  UNSURE (1)..(134): unsure at all n locations
  Clone ID: PAT_MRT3847_5387C.1
  unsure (1)..(134): unsure at all n locations
ggattattgtattaatgnatttnntgatttcnagnncgcgttgcgcttggnatttacaatgtttcagtggattgtctaatgtgttttntggatgagangaatgtggtttagtgatttataantctttattgttg

SEQ ID NO: 322 - DNA, 691 bp, Glycine max
  Clone ID: PAT_MRT3847_54011C.1
gattgaaagctgatagaagctagctcaaccgagaagaagcaagggataatcattattagtcttctttctcttttggttactattgattgctccaatcatcgatactatgtctctaaaaatagcagcagaaatttatccaaaatcaccatcagagacagtgaaggagcctttggtggtggtaaaggaatatgatgaagatagacacaaggtcgctgtagagagacttgagaggctttgtgaagttgggcagagtggaaagccttctcttgtcactgacctcatgggagaccccatatgccgtatccgtcactttcagttgcatgtcatgctggttgcagaatatggagaagaaggagaagttgttggggtgataagggggtgtgtgaaaacagttaccagagggaattcggtttatataaaactagcctatatcttggggctcagagtctcccctcggcacaggagatttggcattggcacaaaactagttgaacatttataagagtggtgcaagcaaaaagggtctaagtatgcatatatggcaactgattgtaccaatgaaccatccgtgaatttgttcacaagaaaatgtggttactcaaagttcaggactctaaccatactagtgcaacctgtgcatgctcactacaagccaattagctccaatgttgctgtgcttcgccttccgcca

SEQ ID NO: 323 - DNA, 265 bp, Glycine max
  Clone ID: PAT_MRT3847_54023C.1
ttgggacccaaacatggggcattttagtttaagcaagaaacagcaatagggggtcgaattttaatatacaccaatcaggggctgaattataaaaagaatttggaccgaaaacacttttgtttaagttggcctttaatctgcactgcaaaatcagttttgggggggcctgtgggggcttaacctagtaataatattcaaatgcattgcgggtaggcatgctggatgaagaaaaacaaaaactttggggaattgagttcataaaact

SEQ ID NO: 324 - DNA, 1825 bp, Glycine max
  Clone ID: PAT_MRT3847_54836C.1
ggtattgcgatattcatttgataaaatagtttattaacttcgtgataggaatacacacataaaaagtacacgagagtactttgtagatgtttaggcagtgctacttcatggcattattatcagcattgcagattacagtggctggatgctttatttatattggtagatattatttccagcagattatttaattactcatggcaccaaattgggaaatcaaccatcaactttcatgtctgtctctggaagccaggggaatggcagtgttggtttagttgcttccagaagaacctcaatgggaatctttggtgcagatggcttcaatggtgttatggcgtgattatacttttgagggtttgcacagtaatcctgatctgcatgcatctttagcacaaattttttgaatatattaaaatttgatttttgcagtagatcatctgatagacgaaggtatgttactccgaacatgcttagttttggagggccattgttgttgacaccttgcggtcttgcattcagtatgatttggttgtaagctgtggcatcataccttggaagtgcattttctccagcaactctgatgtcttctctccaacctccactcaatacctgctgaacaagctcctgtggtccacttttggcatctgagggttgctctgagtccctcatctcaagacatgtaaagttcaaaatggcatgatggcgagacagcatccttgcaatggggcggtatccgtctctatcattaaggttgtaatatccagcagtaagctctgcagcatgattttcaactttgtaccaccagtgaattccagatactttgattgctaatttgactttacagcccaggaaagctttgttggcttcatctagtatttgatcaccatgattcagcaatttgttagaataccaggtcaagaagaacttccctttctcagtgacatacgtgccatttgatttgaagaatccagtagattctgggacatcattgtacttgcctgcgtcatctggcagttcccattcaggatggccagcccttgctacagctgctttgaaatctgccttcaaatatttgtcatagcactgaaattcgccaataccaggaaattcccatccttggctttgtggataagaggggtatctgagctctcctgctgggccaagcccaacttcaatgtctataataagtccagattctaaaaaatctgacatgttttctctgaaactcttcatgtagtcactgtatatctcaatggctgttcttccatggaatataggctcgttgtccacaccaacagttagatattccttgttccgggttcctgagcggttggtgtagaagatatcatgatttgattctccaatgtcaagcacccactggggaattgggatgttaactatatctcctacgttccctccacattgatggaatgacataatagcttgcagtgtcaagccacattcttgaaccagctgaaacaaactcctgtaggctctccaatcatactgcttaggccccttcagttctatgatcccccaccacacatcaaccataaccccgtcaacacccgcagctcgaagctgcaagagctgttctttaaggccatctgggtcttcaaaaacattgtcaacattgacaactccgagtgggagcatcacataaactggaacataatttagtagcatgttactgtcggaagtggccatcttgctgtttgcgtggtgttttttaaaaacctaagagagctgcagagttctctgatatctagaatggtggtaaaggagatgctatgtagaacggtagaagttgatccccttctgtcgt

SEQ ID NO: 325 - DNA, 364 bp, Glycine max
  Clone ID: PAT_MRT3847_54862C.1
cgcacgcgtgggacctcgggttccattggcccagccatgtccaaggcgcgtgtctacaccgttgtcaacgtactccgacccaaagagtactgggtttactagtgtctgaccgctcaatggggtgatcaagatgattatgaggttgtgcgcaaagagggaaggggaaagtacagagaggtttttgaaggcataaacgttcatagcaatgagcgctgtataatcaatattcttaagcctgtcaagagaaagactatttaaagagagatagaaatacttcagaacctttgtggtggtccaaatatcgtgaagctgcttgatattggcagagatcagcactgtaaaactcctagcttaatatccgagt

SEQ ID NO: 326 - DNA, 2086 bp, Glycine max
  Clone ID: PAT_MRT3847_55132C.1
cggctcgagcaacttctcgacgcagcgcaaaagctgcaactccgcttctcatattagaattcagacaaagcctcatccttcatagttcagatccattcttgctctgtattttgtttttcttttaaatttttctttaaatttctcaattgatcaaagatcttcagcaaaccggtcaagtttgtgtagtttggccagatgggaggtgggtttagagtgctacacttagttagaccttttctctcgttcctacctgaagttcagactgctgataggaaagtgccatttagagagaaggtcatatatactgtgatctctctgttcattttccttgtttgcagtcagcttcctctgtatggaatacactcaacaacaggtgctgatccattctattggatgcgtgttatccttgcttcaaaccgtggaactgttatggagctgggaatcacccctattgtgacatctgggctggtaatgcaacttttggctggatcgaagatcattgaagtggacaacaatgtacgggaggatcgtgcactcttaaatggtgcacagaagctacttggcatcttgatagctgttggtgaagcagttgcatatgttctttctggaatgtatggtagtgttggtcaacttggagtgggaaatgccatcctcatcatcctccagctctgttttgcaggtattattgtgatatgtttggatgagctccttcagaaagggtatggtttaggatctggaatttctctgttcattgccactaatatatgtgaaaacatcatatggaaagcatttagccccaccaccattaacagtggacgtggagctgaatttgagggtgctgtcattgctctattccatttgttgataactagaacagacaaggttcgtgcccttcgtgaagcattttaccggcaaaaccttcccaatgtgacaaatctgcttgctaccgttttgatcttcctaattgtgatatacttccaaggattccgtgtggttttgcctgtgagatcaaagaatgcccgtggacagcaggggtcgtatccaatcaagttattttatacctccaacatgcccattattcttcagtctgcccttgtttccaatctctacttcatttctcagcttctacacagaaagtacagtggaaacttctttgtagatctattgggcaaatggaaggagtctgaatatggaggtggtcagtctgttcctgttggtggtattgcatactacatcactgcaccttccagcttagctgatatggcagccaatcctttccatgcgttattctaccttgtgtttatgttgtcagcctgtgccttgttctctaaaacttggattgaagtctctggttcatctgctagagatgttgcaaagcagctcaaggaacaacaaatggtaatgcctggacatcgggagtcaaacttgcagaaagaactgaaccgatacattcccactgccgcagcatttggaggcatatgtattggtgccctgactgtgttggcagatttcatgggggcaattggctcagggacaggaatattgcttgcagtaacaatcatctatcagtacttcgagacatttgagaaggagagagctagcgagcttggcttctttggtttctaagctctgcttagcacattcactgttggtgacgcaattcggctctaccgcacccacagttttgttgtgtaatgaggactggttggtaggttgtttaacacacagtaagggagaacttagattagttttttttattacttttctcaaccgaggaagccctagtataatatcactgtaaacgttatggagtttctctgaatacacttgcgttaatttaagttgtcatagtctgatatcatgggctaaaagtgggatgatcttaattgatagcttagctctagaaattaccttctatttgatagtattagttttgtggacgtgcgttgcagtagtttttaacatgaatctttcaattgaaaggctgggctcgtataggctagagctgatgttaacgtgcaaagtctaatgttaggtttgtttcaagatatagcaaagaattcttctcaaaaaaagtgaacatttt

SEQ ID NO: 327 - DNA, 1879 bp, Glycine max
  Clone ID: PAT_MRT3847_5638C.1
gtttactcagaatagagattatattctatttctctctccttaattcccttcgtttctctctcttcgccattcattttcctccaacttgttggtctctctgtctctctctctctctaggatcccttccttaccattctttacttctccccttttacttgaccccttcaagttgaagtgatcatttagttatcctctaaagcagtattttgctggtgattttcatctgcaatggagttctgaatctatgatgatgagatttctcatttgaacccccagagatggacaagaaagagcatattgcaatttttactactgctagccttccatggttgacaggaaccgctgtgaaccctttgtttcgtgccgcgtatctcgccaaaagtggggaaagagatgtcactttggtgatcccttggttatctctgaaagatcaaagactagtatatcccaacaacattacatttgcttcaccctcagagcatgagaagtatatctgccagtggctagaggagagagttggatttacatctggtttcagcatacagttttatccaggaaagttttctagagataaaaggagcattcttgctgttggggatatttcagagattatccctgacaaagttgcagatattgctgttctagaggagcctgagcacttgacatggtatcaccatgggaaaagatggaagactaaattcagactagttatagggataattcatacgaattatttggagtatgtgaagagagagaagaatggagtcatgcaagcatttttgctgaaatatttaaacaactgggttgttagtatatattgtcacaaggtaattagattatctgccgccacccaggattacactggctccatcatctgtaatgttcatggagttaatccgaaattccttgagattggcaatacggctgcgagaagacgacagaagggagaacatgcctttaccaaaggtgcctactttattgggaagatgatatggagcaaaggctacaaggaactgctccaacttcttaaagatcatgaaaaggaattatctgctcttgaggttgatttatttggcagtggagaggactcagatgaagttcaaaaagctgcagaaaagttggaactagcagttagagtccacccagctcgtgatcatgctgatgctctatttcatgattacaaattgtttcttaatccaagcacaacagatgtggtctgcacaacaacagcagaagctttagcaatgggcaaaattgttgtttgtgccaaccatccctcaaatgactttttcaagcagttcccaaattgttggacgtacgacgacgatgacggatttgttaaactcacactcaaggcactggctgaacaacctgcccagcctactgatgctcagagacatgacctatcttgggaggccgccacaaaacggtttcttaaggcagctgacttagacaagccgttagagagaaaattgtcaagaacaacttcaaactttctggctgcctccttaaatttgcaagagaaagtagatgaagcatcagcatatgtgcatcatgtagcttctgggtttgaagtatcaagaagaatctttggtgccattccagatagcttgcagccagatgaagagctacgcaaggagcttgggttgactgatgcttccacgaaataaagttaaagaaaaatgatgttggaatgctgtgatgttaattaaaatttgtagagattctatcttctatacatatataactaattagttacccttgcatttgaacggttgtgcttgtctttacccatgtttaccttttattgttgctaaaatcaacatgtacatcatagtgattaaaacaattcattaactactaaaaaaaaaaaaaaaaa

SEQ ID NO: 328 - DNA, 398 bp, Glycine max
  Clone ID: PAT_MRT3847_56602C.1
acaaaaccggttccatggactgatagtaggcatattaagggtctcagaaggcgaaagcagcaactcatgtatcgaaggcaaaacctggagagtacatacattacgcctcacagaaggcgaaggaaacgaaggacaagacaatggaagacgctggagagtacactgattaagcgtctcagaaggctaacgaaacgaaggacaatacaatggtcaacgctagtgaatatacagattatgcttcgcactcacgcgaacagaagccaaggacatgacaatggggaagggacgggaatataaagactatactgcatcaaaggctaactaaggaaaagatgcaactgcgaataagatgggagagtctaaagattatacggcggataaagcttaatgggggaaag

SEQ ID NO: 329 - DNA, 2862 bp, Glycine max
  Clone ID: PAT_MRT3847_5686C.1
gacggtagctattaacattacaacacctttttattatttcacctctctctctctctctctcattgccatagatctgaaacacagatcacagggtccgcgctttttgacccttctctccattggtcattcccccgaatacgccgcacctataatctagcaccgaccggaccctccatacccgttttcgcgcggatctaggagctcaggtaatccccgaggaattttcaattgttatcggttgaatttcaacggttttcttctttttgaaatttagttgattaattcagctagggtttagtgtgtgagtgaataaggttgttgttggggggtttgcgatggctccgaccatcatcgacacactgtcttgactaaggctcgcgatcacagaaaaccgtaggtctcgtcttgaccttgcgctttgtgaattgcgcgtgagactgaggttgggtttggaaggcaagaactcatttcagccagcaacaggaaggttgtggtacgtaaatagtcataacctaacccttgcatttgcaagagaggtatcgttagcgagtgccagccacatgcgtggtgcgtgtcagactgaggttgggtttggaaggcaagggcttgtgttgtcacaatccaagagagaagtaatggcgaacatagacatcgaagggatcttgaagcagcagcagccttatgatgggcgcgttccgaagacgaagatagtgtgtactttgggccctgcttctcgatccgtagaaatgaccgagaagcttctgagggcagggatgaacgttgctcgtttcaatttctctcatggcacccacgactatcaccaggaaaccctcaacaatctcaagactgccatgcacaacactggcatactctgtgccgtcatgcttgacactaagggacctgagattcggactggttttctgaaagatggaaaacctattcaacttaaagaagggcaagaagtcaccataactactgattatgacattaagggggatccggagatgatatccatgagttacaagaagctgcctgtccacttgaagcctggaaataccatactgtgctctgacgggacgattactctcactgtcttgtcttgtgaccctgatgctggtactgttagatgtcgttgtgaaaacactgcaacgttgggtgagagaaaaaatgttaaccttcctggtgttgtggtggatctacccacacttactgagaaggataaggaagacattcttggatggggtgtacccaacaagattgacatgattgctctttcatttgttcgtaaaggctcggatcttgttaatgtccgcaaggttctggggccacatgcaaagaatattcagttgatgtcaaaggttgagaatcaggagggagtcctgaattttgacgaaatcctgcgggagactgatgcattcatggtggcacgtggtgatcttggaatggagatcccagtagaaaagattttcctggcacagaagatgatgatatacaagtgtaatcttgttgggaagccagtggtgactgctacccaaatgcttgaatcaatgataaagtctcccaggccaacccgagctgaagcaactgatgtagctaatgcagttcttgatggaacagattgtgtgatgcttagtggtgaaagtgctgctggggcatacccagaacttgctgtgaaaatcatggctcgcatttgcattgaagcagaatcatcccttgactatggtgccatcttcaaagagatgataaggtctaccccattgcctatgagtccattggagagccttgcatcatctgctgtccgcacagcaaacaaggccaaagcaaaactcattgttgtgctgacacgtggcgggtctacagccaagttagttgccaagtataggccagcggttccaatattgtcggtggtggttccagtgttgagcacggactcatttgattggacctgcagtgatgagacgccagcaaggcacagcctgatatacaggggcttgattcctatactgggcgagggatctgcaaaggctaccgatgcagaatccacagaggtcattctcgaagctgctcttaagtccgcaacagaaagggccctttgtaagcctggtgatgcagttgttgccctgcatcgtattggagctgcctctgtcataaagatctgcatagtcaaataatgcatgctcaactcaacgtgccgccaactaatgcagggttatgttttgccttttatttctttctttctgctgtttatccgtatcataaaatggaggatttagttactagctgtagatcgagtgttttttggtatactctgtttatattgcggagtacttctaaatcagattatcatggaaataatactcttaccttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttttaaaggtccaaattttactccccggggttggaaaggtaaaattttttttttggggccccaaaaataaattcccggggccgggttttaaaacggggggggggggaaaaccctggggttccccaaattaaatcgtttggaaaaaaacccccttttcccaaggggggaaaaaaaaaaaaagcccccaccgattcccctttccaaaaattggccaccccgaatgggaaaggggacccccccttttaggggcctttaaaccgggggggggggggggttccccaaaggggaccctttactttggcaaggccctaaagcccggttctttgggttttttcccttttttt

SEQ ID NO: 330 - DNA, 470 bp, Glycine max
  Clone ID: PAT_MRT3847_56902C.1
ttaaacataacagtctcttcattaaaatcctgaaggatgattagaatacagccgcatgttacaaattctacattttccacttcaaggttgcccatttgcttatatcccttcttgcccacttacacaagttttttgccttacatctctgctgaatatcacacaaccgaacaaataacttatggagtaggaaggtgatcttcctccctttcctacacacagatgcttcttttaacactttaacgagaaccaagagacaaaatgaacagggtatgatgagacatcttacgaatcatacgggttagtaatcaaaagcggttgggaatcctcgttctgaccttgaggttcacattgcatggcaacttcctgctgttggtcaactaacctgctcatacgtattagcacctgcccctcctttgttttgcctctgtctggccattatgagccaattctaacagtggacccgccacccc

SEQ ID NO: 331 - DNA, 1032 bp, Glycine max
  Clone ID: PAT_MRT3847_57413C.1
agcagcactccctgcagacgacagacgggggcgtaggcaaggggggggagagaaaagcgttcatcttgtcggtcgaagagaatctatttgggcgtaggcaaagagagagagagaaaagcgtgaatcatgtcggacgaagagcatcacttcgattctcaggcggatgcgggagcgtccaagacgtatcctcagcaggctggtaccattcgcaagaatggctacatcgtcatcaaatccaggccttgcaaggttgtagaggtctctacgtcaaagacaggcaagcatggacatgcaaagtgtcactttgttgcaattgatatttttaatgggaaaaagcttgaagatattgttccatcatcccacaactgtgatgttccacatgtgaatcgcactgactatcagcttattgatatctctgaagacggctttgtgagtctgttgactgataatggaaataccaaggatgatctgaagcttcctactgatgaggcattgcttgctcagattaaagatggattttctgaaggaaaagatcttgtggtttctgttatgtctgcaatgggagaagaacagatctgttcactgaaggacatcggtcccaaaaattaatatgatgctatggctgtagctatagctgatagcacgctttttcttcttatgttgctaacaggtagtatattctccgatacatgtgtgcaaaataaacttcataagatggaaatttgcctgtgcttgaaactcaaatgcttgggatagaagaaattgagctaagtttagcttttgtccattaattaaggaacacaacggtcttgggtggatgaaattctcataaacatctcatattatttgtttttgttgagtttaatatataaccctatttgttctctgcactgaataatactgtactgaatttctgaaacacgtggttaaccggatattgcccaaagatttgatatgatgaatttagccatcttaatttgggatcagatggtaaaattttacggctttaactataatatgaggtgttattat

SEQ ID NO: 332 - DNA, 1339 bp, Glycine max
  UNSURE (1)..(1339): unsure at all n locations
  Clone ID: PAT_MRT3847_57838C.1
  unsure (1)..(1339): unsure at all n locations
cccacgcgtccgtacggctgcgagaagacgacagaaggagattgcgtcgttgtttgttgtttcccttcatctattttttcttcgcccccttttgtgtttctttttttggttgtttgttctttcttctcgttcgtcgctttgtgatctctctctgcaaccatgtccgccgagaaagagagagagacccaggtttacttggccaagcttgccgagcaggccgggagatacgaagaaatggttgagtgtatgaagaaagtagcaaaacttgatcttgatctaactgtggaagaaaggaacctcctctcagtgggatacaaaaatgtgattggtgcacgaagggcctcttggcgcatcatgtcctcaattgagcagaaggaagagtctaagggaaatgagcacaatgttaaactgatcaagagttactgccaaaaagttgaggaggaactctccaaaatttgtggggacattctgactattatagaccagcatttgattccttcttccgcatcagcagaagctagtgttttctactataagatgaaaggtgattattttcggtatcttgctgagttcaagactgaccaagaaaggaaagaggcagctgaacagtcactgaaaggatacgaggctgcttcagccactgcaaacacagatcttccatcaacacatccaatccgtcttggacttgcactcaatttctctgtcttttattatgagataatgaactctcctgaaagggcctgccatttggctaagcaagcttttgatgaggcaattgcggagttggacaccctgagtgaagagtcatacaaggacagcactttgatcatgcagctgttgagagacaacctgactctctggacctctgatttgcctgaggatggaggtgaggacagcataaaagctgaagaaaccaaaccttctgagcctgagcattgatgtgattcaatagtcagaaatctaaggtactctccaagagggcatttttcagcttttcttgcaatggatttggacccggacaatagggactgtggttggtggccatttcataattcttatgctctcttaatatctttaccaaagctagaagatctgcaccctttttttttccttcaaacttttttcttattaccttctctctgttttaagtaaaatggtcagttaagcaatgaacaatttacatttacccttataagcatcttcattccttcgttcattatgtttggatttattttgtccaatttacatttacccttataagcatctgctttccttcgggccgggtgcttggaggggttccgctttccccgtttgggtttcctaanaaaaaaaaaaaaaa

SEQ ID NO: 333 - DNA, 943 bp, Glycine max
  Clone ID: PAT_MRT3847_58025C.1
gagccattcgtgagcctagagttgttgtacagactaccagcgaagtagatatcctcgatgatggttatcggtggcggaaatatggacaaaaagttgtcaaaggaaatcccaacccaaggagttactacaagtgcacaaatgcagggtgcacagtaaggaagcatgtggagagagcatcacatgaccttaaatctgtgatcactacgtatgagggaaagcacaaccatgatgttccagctgctcgtgccagcagtcacgtcaatgctaatgcttccaatgcagttcctggccaagcttctcttcagacccatgttcacagacctgaaccatctgaagttcacaacggcattggaaggcttgagaggccttccctgggctcattcaacctacccgggaggcagcaactaggaccttcccatggcttctccttcggtatgaaccaatccatgctatcaaatctggtgatgtcagggttgggccatgcgcaagcaaagcttcctgtcatgcctgttcattcattcttggcagcgcatcaacaacaacagcaacatcaacaacaacaaaaccaacaacaacgtgcggcaaatgatttgggtttcatgttgccaaagggagagccaaatgtggaggctattcctgaacgtggtggccttaacctgtcaaatggctcatcagtgtaccaagaaattatgagccgcatgcctcttggacctcatatgtaaaattttattccctgattctttaaataaaaactaatgtttacatcttttatatatatatatatatatatatatatatatatatatatatatatatatatatatatatatataatgccaaggcatacataggtggacttttcattattagactcttttgtatttgacattcttcaacacatgtcaaaggtatatgtagtttatttttctcatttattgcattc

SEQ ID NO: 334 - DNA, 453 bp, Glycine max
  Clone ID: PAT_MRT3847_58098C.1
tggtcaccggggtggagcaatgcagacaaggcattgacagcattcgtaaacggtgctttgatcgaatactcgaagaatcgcaggaaggcagacagtgccacaacctcatttctctcaccacatttgcactttggtgaggtgagtgtgaagaaagttttccaccttgtccgcatcaagcaagtgttttgggccaatgaaggaaacaaggctggtgaagagagtgtgaacttgtttctcaagtctattggcctcagagagtattcgagatacattagtttcaaccacccttatagtcatgagaggccccttctagcccaccttaagtttttcccttgggtggtgaatgaaggatactttaaggcttggagacaaggcagaacagggtaccctttggtggatgctggaatgagagagttgtgggcaactggttggttgcatgatcggatacgcgtt

SEQ ID NO: 335 - DNA, 1212 bp, Glycine max
  Clone ID: PAT_MRT3847_58517C.1
ctcgggcagtggcagcataaccagaaaaaggttccagaaattctggtaaggaacgaagcaaagcaaacgcagcgtttcgtttcgtgtcgctgctggttatggatggaatgtacggagtgccggcggagtacgccgacaaggctctcatgacgccggagaatctgattttcccgccggactaccaccacgacttcctcgccgccggccggattccgctgttcggatccgacgagttcttctcctcctccgccggaattcaccggcagcaggaagatgacgtggcagccaccactgtcatgaaggccaaaatcgcctctcaccctcactaccctcgcctcctccaagcttacatcgagtgtcagaaggttggggcgcctccggaaatcgcgcgcttgttggaggaaatccggcgagaaaatgacccgtgcaagagcgacgccgtttcttcttccacgtgctttggagccgatcccgagcttgacgaattcatggaagcctactgcgacatgttggtgaagtataaatccgacttggctcgcccttttgatgaagcaaccactttcctcaacaagatcgaaatgcagctcagccatctctgcactggtgcttccgtttccaacgtttctgatgatgggggtgtgtcttcggacgaagatttgagtaccggagatggtgatgctcaagatggccaattaaagggtgaagatcgtgagctcaaggataggcttttacgaaagtttgggagtcacatcggtactttgaaactcgagttttcaaagaagaaaaagaagggtaagcttccaaaggaagcaagacaagcattgcttcaatggtggaatgttcactacaaatggccttaccctacggaagctgataagattgaactggctaagtcaacagggctggaccagaagcaaattaacaattggtttattaaccaaagaaaacgtcattggaaaccatcagagaatatgcagttttctatgatggaaaattttaacggacggatccttgctgatgaatgaatgaggtgcatgtacatgatattttcaaatgtatatcccgattaattattgcttgtattttcttttttttgtaaattctgaattaaaagcagattactgacagtaaaatgcttattactttcccatgaaggaaaagggaaatgatcataatactattcttgataaataaccactgacattgtgaatt

SEQ ID NO: 336 - DNA, 419 bp, Glycine max
  Clone ID: PAT_MRT3847_5870C.1
taagaatctagaaatgtactttcttatttctgggaagccacaaacatcagacaaaaaactttattattgaagagaactcataagagatctaaaagatggcaccaccaatgatgggttgttggtataatgctggggggtttgacaaagcaaggtgcgtgaatggcaacccttgttgcagttgtcagagggagacagcgttaggcgcaatgtgctggtataacggccacaattgtggatgtgtcaatattgtttagggctcacaccatctagctggctgaacggtagtatttagatgctgctgtaaataaacacgagagttcaccgctgttaattggttgaatggaaaaaattgctgggggtaggcagcaaatagctgaatgaatggtacctgttgttgttgcaaataagaagcacacctc

SEQ ID NO: 337 - DNA, 3250 bp, Glycine max
  Clone ID: PAT_MRT3847_58755C.1
cttatctcagcagaagccgattaggttcccatctcattgaagaaaagaagatgacaggggagaggttgacaatggagtagaatgtgaggaggaatctgctgaaagtgatctgcattctatagagttaaatatggacaacaacaacaagagttataagtggacctaccctcctgaaagcagatttgatacaagaagatatccaattgaggaagaagtgaaaggtagtaggaggtctacctctgggaaagcttcaaggaaaagcacatcactgcaaaggagtatatcagatggaatggaatggggagtccaagctgataagattcaaaattcaggagatgggatagattgggaaagcttttatgaactgctaaaattaaattgtgcataaattaaaatcagctttttgaataagttaaatgtgttaaatttctccaaaaagctgactttaacttgtatataagctaactttaactttatgggagaaacttgtgaatgtgtttactctttcttatttttttctttttatcttacaagtacttatcctaatagagtctaagcatagcaatagtacaaacttccgcttcaaaaacatggctctaacacttcgttcttcaacttcttttattaatcagaaggaaaccaaagtcctcaaaacttctgacaatgcccctgcaatagttagtttttcaaaattcaagccatcatcatcattgttccggctccgggcaaaaaattccatgcaagaagctcatcacactcgtgagaaatgggagaaggtgctggctccgtcggtcgcacatagccacaatgattcaaagagagtacctgtgtatgtgatgttgccattagacacagtaacaatgggaggaagcttgaacaagcccagagcgatgaatgcgagtttgatggccctgaagagtgcaggggttgaaggtgtaatggtggatgcttggtggggtttggtggagaaagaagggcctttgaagtacaactgggaaccctatgctgaacttgtgcagatgctgcaaatgcatggcttgaagcttcaagttgttatgtctttccatcagtgtgggggaaatgttggagacaattgcagcattcctctaccaccatgggtgttggaagaaatcagcaagaaccctgagctggtttacacagacagatcagggaggaggaatcctgagtacatctccttgggctgtgattcggttcctgttctaaatggaagaactcctctccaagtgtactctgactacatgagaagctttcgtgacaaattcagagattactttggcagtgttatcgtggaaatacaattgggaatgggtccttgtggagagctcagatatccatcttatccagaaaccaatggaacttggaggtttcccggaattggagaattccaatgttatgacaagtatatgaaagcatccttggcagcagcagccgaagacattggaaagaaagaatggggaggaggtggaccccatgactcaggccagtacaatcaatttcctgaggatactggatttttcaaaagggaaggaacatggaacactgaatatggacagttctttctggaatggtactccggtaaattgctggaacacggtgagaggatccttgtatctgccaaaggaatatttgaaacaactggggtgaaactatcagggaaagttgcaggaatccactggcattacagagcaagatctcacgcagctgaactaaccgctggctactacaacacacgaaataacgatggatatctgcctatagcaaggatgctcgcaaaacatggagttgtcttcaatttcacctgcatggaaatgaaggacagagagcagccagactttgcaaactgctcacctgaagggttagttcaccaggtgaagatggcaacaacaacagctagagcagagcttgcgggggaaaatgcattggagagatatgatgcagatgcatatgctcaagttttatcaacaagtaagtcagaatccggcagtggattggctgcattcacatatctaagaatgaacaagaggttgtttgaagctgacaactggcggcacctagtggatttcgtaagaagcatgtctgagggtggtcggagagagagacttccggcagctgattcccatgggagtgatctttatgttgggcacatcaaagcaacacaggaaaagcacacacaagaggctgctcttgtgtaattgcatatttttgcaagttcaggcatcttggtatatagttaaaagcatcataagatatttttttatagaaaaagggaagctacagaaaaaaaggagaaatgacataggatcatgatacagaacactggcatatgtcatgccaacacctgagatgatcgagaagatattattttatttcatgtaatgtataactccaactacaatggagaaaaaacagtttatctgctgacgttataaacccaataatacagatattggtctctattcaacaagggctctattatatatttagagagaaattattgtatgaaaagcaagctcaaggaaaaggttatgcagatgaaatgcaaggctataaatcagtgaaaggtctaagggatcagatactggctggttctaggcttgcatcttccagaggttatgccagtccaactagacaattttcccagccatggccatcacgagatcttgcaaataacttccaggaaagacctgctacagcacagggcaatggtctaaaatcaaggttaggggaagccaggggtgagggccagaatgtaaggaagtccaaaaggtgagttaatgctcataacttttgagacaatgctttgtttgtgaaggtccatacccgtttgcttctgctaccatgatggctggtaaaaatgcagggcagcgattatcatagatccgctagccactaggtgaaagctgaaagaagcttttctcctttcaagttttatcttgttgatagcccatggctgcttaagttgcagcaatcgctgcttaaattttcgtttgaccctatgtgtaggtatgatcgtgttcgtagagttcagaacatgtgttatataagtataacaagcgagtttttgttttctcctgtagcatatgctgaagcccgaaggtgatcaagaacattttgtattttcttctttcggtatctaaggatactaccactgtctcccacaagggtgttaaatctaaaaaaaaaaaaaaaaagtagttttttatagtaagggtagggtgggggggggaag

SEQ ID NO: 338 - DNA, 806 bp, Glycine max
  Clone ID: PAT_MRT3847_58757C.1
gttctttcttataaatacaagcataccatcttgaacaattcctacatatccttccttcatcttcaaaatatggctctaacacttcgttcttcaacttcttttattaatcagaaggaaaccaaagtccttaaaacttctgatgatatccctgcgacagttagtttttcaaaattcaagccattggtccgtctccgggcgaaaaattcaatgcaagaagcgcatcacactcgcgagaacagcttcaatgaagcaagtagaagcgagaaatgggagaaggtgcttgctccatcggttgcacataaccacaatgattcgaagagagtacctgtgtatgtgatgctgccactggacacggtaacaatggaaggaagattgaacaagcctagagcaatgaatgcgagtttgatggccctgaagagtgcaggagttgaaggtgtaatggtggatgcttggtggggtttggtggagaaagatgggcctttgaagtacaactgggagccatatgctgagcttgtacagatggtgcaaatgcatggtttgaagcttcaagttgttatgtctttccatcagtgtgggggcaatgttggagacaattgcagcattcctctaccaccatgggtgttggaagaaatcagcaagaaccctgagctggtttacacagacagatcagggaggaggaatcctgagtacatctccttgggctgtgattcagttcctgttctaagaggaaggactcctctccaagtgtactctgactacatgagaaagcttcgtgacagattcaaagatacttgggcagtgttatc

SEQ ID NO: 339 - DNA, 288 bp, Glycine max
  Clone ID: PAT_MRT3847_58C.1
ctccttgggaggatgctttacatggctccttcagatggaaaatggggcgaacacgagttggattacctcctgttcatggttcgtgacgtgaagctcaacccgaatcctgaacaggtggccgacgtcaagtacgtgaaccgcgatcagctgatggagctgctcaggaaagctgatgctggggaagatggcgttaagatgtccccttggttcaggctggtggtggacaacttcctcatgggctggtgggatcatgtcgagcaagggactctgcagggggcagcggacatg

SEQ ID NO: 340 - DNA, 257 bp, Glycine max
  Clone ID: PAT_MRT3847_59173C.1
cacagatgatgacgcctaacatgatgtcaccattgacgatgccgagcatcttgtcaccaatggtcttgccgagcatgatgtcgcaaatgatgatgacacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtatcgaataatgagt

SEQ ID NO: 341 - DNA, 419 bp, Glycine max
  Clone ID: PAT_MRT3847_59634C.1
gaaattgggagtccgtccaccaaaaggagtgctcttatatggtccccctggaactgggaagacactaatggcccgtgcatgtgctgcacaaactaatgcaactttcctgaagcttgcaggtccccagcttgtccagatgttcattggtgatggagcaaaactagtccgcgatgcctttcagcttgcaagggaaaaatctccctgcattatatttatcgacgagattgatgctattgggaccaaaagatttgatagtgaagtaagtggggatagggaagtacagcgcacaatgcttgagttgcttaatcagcttgacggcttcagcagtgatgaccaaataaaggtgattgcagcaactaatcgtgcagacatcttggatcccgctctcatgcgatcaagtagattggatcgaaagattg

SEQ ID NO: 342 - DNA, 615 bp, Glycine max
  Clone ID: PAT_MRT3847_59716C.1
ctcttttttttttttttttttatttttttttttttttttttttttttttttttagataaaaatgccaatggcattactagcatttactcttataaaacttagaccttacccctacaccaaggaaaacacatgtcccacaatgctacactgttagcaaacaaaataatttaaagaaaactggattttgggggccactttacaaaataagactggaaatctttacttttataggctacactgagttggacccatcagctttggggggaaaaaaactgcctcctggagcaaatgcctttttgaaaattgacccaacctggattcctgttttagcactctcctgaaaacttccttggccaaaattgccataagcttttagtcctttcctattcttagccttttgggcccaaccaaaaatggtttggtgaaaacgctcattaaatattgcccttttatagggagctcccatctgcgtaacaaatgcataccggggcagggggctgggactacatagcacctgaataaataccccaataacaagccttggaacaaagtatagaacttgtcccattatacagggggcaaaaccatatgggaccttctatggctgaatgcttt

SEQ ID NO: 343 - DNA, 269 bp, Glycine max
  Clone ID: PAT_MRT3847_60017C.1
ctctctctctttctctttctctctcatccagatcttgcaaaaaaaaaaaaacacaatggcagcgagcgctccaactccacgcgaagatttcgtgtaaatggcgaatctggcggaaaggccgagcgctacgaggaaatggtggagttcatggaaaaggtctccgcctccgccgagagcgaggagctgaccgtggaggagcgaaacctcctctcggtcgcctacaagaacgtaatcggtgctcgcagggcttcctggcgcatcatctcctc

SEQ ID NO: 344 - DNA, 814 bp, Glycine max
  Clone ID: PAT_MRT3847_60180C.1
taccggctgcgagaagacgacagaagggggttttttttctctcttgatgcagtggtagaagctgaacccgtttcgctttcaatcgaagggaagaacaaacattcaattcatggcagctgcaaagcttcaagctttatggaatcacccagctgggcctaaaaccattcacttctgggcacctacctttaagtggggcatcagcattgccaacattgctgatttctcaaaaccacccgagaaactttcctatcctcagcaaatagcggtcacagctactggaattatctggtctcgttacagcactgtaatcaccccaaaaaattggaacctgtttagtgtaaacattgcaatggcagggacaggcttataccaactctcacgcaaattgcggcatgattattcctctgaggcggaggcggaggtggctgtcacaaaagaatgatattaaatattttaaaagtccaagttattgtgtagttggaggcagatgcccaggctgtaatttccgttatataattgtattcttacttggtagttcatttgtactttcccaagtctcaaactgttaaagcattctcacttgtgtgtttgattgtggcaaaataagggaatcaagataagcgggcaactgaatatatctggccccttatggggcgtctttgatatttcttaccatgattataaatcataggtcttgaagcaatcacacttggagggcatttggcaccaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 345 - DNA, 1896 bp, Glycine max
  UNSURE (1)..(1896): unsure at all n locations
  Clone ID: PAT_MRT3847_60398C.1
  unsure (1)..(1896): unsure at all n locations
cgatgaattttgaagtgaaagctcgataaatgggttttggaggaaggaagagatccttgtgttgtgggttgaggtgagaagggaagggatgtggagttcaacttcaagcacagcagcgattccctccgacgaggaacctagcgaatcctcctcctcgtcctccttctccacctctctcttcaatttctcttctggaaacccgagaatcgaggagacccgtggcctcatgcatctcttcccagacgacactccttctactctacccgttggacggaagcctctcgtttgcgttgtcggcgtcccaaatcacatgacctatgcggatttctgccagttctgtggttccttcattcagcacatgctagagatgcgcatagtcaggatggatgggatggaggatcagtacagtgttttagttcgctttgacgatcaagactccaccgacagcttctacaagcactacaatggccgccgtttctcttctctcgaggttgaggtttgccgtgttcttttcacattagacgtgcagtacactggctccattgaacatgcacaaccctccaatgctacttcaactgaactgcctacttgtcctgtttgccttgagcgattagatcaggacaccggtggaattcttacaactatatgcaaccattctttccattgttcctgtatttctaaatgggcagattcttcttgtcctgtatgccgctattgccagcagcaagctgaaaaatctatatgttttgtttgtcaaaccactgagaacctatggatatgtgttatatgtgggtatgttggctgtggaagatacaagggagggcatgctataatacactggaaagagacacagcattgctattccctagaagtggaaacaaaacgagtttgggattatgtgggagacaactatgttcatagacttattcagtccaaaactgatgggaagttgattgagctgaacactcagtgtgcgcatgcagacaatggatgtggaagttgcagctgtgaagataatgccatgaatgaggctatacttaatagtaaagttgaagctattgtcaatgagtacaatgaattgcttgctactcaacttgaaaaccaaaaattatattttgaatccttattacaagaagtaaaagaagaatctgagagaaaaatttccaaagctgttcagaaggctatcagtcttaaacagcagaagattcagtccaagattgacagatgtaagaaagagaagaaatttctggatgatcttaatgagaatcttgtgaaaaatgaggacatttggaaaactaagatacttgcgattgaagagagggagaaaaaaaccacgagactgatgggtgatagagtagcggacctggaaatgcagcttggtgatctcatggtttgtcttgagggtgggaggacggtagaacagctggcagcttcagatgagattaaagaagggattatcttggacaaatcaatagaatcctcgacaactagtggctctgacctggtgggaagagacgcataacagaagaatggttccttttaatgacagaagaatgattccttttaatggactacattgcacggactgacctataccatgtttataatcacagatttatagaaactacactcgtggatccacagttgacatgttttcactctaattttttcccatataaaactcccagtgtatgtatctgtttagatttgtaaataaaaagatttccaactaccagtataaattcttaatatttataaatgtaagtatcaggcaggaacttatagatnacccgagaaaaaaaaaaaaaaaaaaaaaaanaaaaaaaaaaaaaaaaaaaaaaaaaaaaaaaaaaaaaaaaaaaaaaaaaaaaaaaaaaaaaaaaaaaaaaggggggg

SEQ ID NO: 346 - DNA, 1307 bp, Glycine max
  Clone ID: PAT_MRT3847_60645C.1
aaaaaaaaaaagcattaaagagtggccaccagaacatgttgtttttcaattcaaactctctctctctctcctttctttctttctcccctgtcgatccgagttagcattccaaggagcgagtaagtgactcggtggtacaggcggcgttttctcgtttcgccgcgcatcattcgatttcgctccgttccgcaccataacgaatcgaatctcccgatcaatcacgagatattcgatctccttctcaacagtttcactccagattcaaactcacacgcacgcacgcacactctttttttttatcatcgcgttgtaagcgagatcttggagagctacgagctcgttcgttcgtttgccttatttatttttcgcggttgatctctctcgttgttccgagagagttctttgttgtggaaacatggttagcggcaacatttttcattgtagaaaaaattcgtggcctcctcaagagtatatcagtaaatccactttgcagctgtttgattatgatagttctgctccccctgaacaagcttggagaaggagattaaacagccatgccaatcttcttaaagaatttagagtaacttttacggaagctataaaaatggttcgattaggtatacgcatttggtcatatgttagggaagaggcttctcatggaaggaaagcgcctattgatcctttcactcgagaaagttgcaagccatctgcatctcaaggagtcccacttggagggatggggagtggcagcatatcaagaggatttagaggcgagttccgacaatggcaaattattcctagcttatgtgaagcatcaccagtcatgtcaaatcagttctctatttttataagcggagagggaggaaacaaaaattttgcatcagttttggctcctggccagcatgaaggtttaggatctagcaggaaacctgatgatcagggcatatcatcatggggttggaatctaagtggccagcactcaacctaccacgctttgtttccaagagcttggacagtttatgatggtgagccagacccagaactaaaaatatcgtgtcggcagatatcaccattcgtaccacataattatagagaaagcagtctaccagctgctgtttttgtttatacgttggtgaacactggtaaggaaagagctaaagtcagccttttgtttacttgggcgaattccattggtggaagctcacacttgtcaggagatcatgtgaatgaaccattcaaagctgaagatggagtctccggtgacttctattcacaagacagcaaaggaaccctctgtacttttgcat

SEQ ID NO: 347 - DNA, 2205 bp, Glycine max
  Clone ID: PAT_MRT3847_60792C.1
gccccaggtgtgctaacgcggacaagtttaccgggtgcaattttgcgtcagcgctgcttcaatttcgtaatataaatcatactcacttctcatccgctttctaaaaaataaaaaaaaaatttaaccctagcaattttctcttattgcctaaaaacatttcaatcactctactttaaacgatccgctaaaaaaaaacctctcgcaaaacccacactcccaagccaaatcgatgtcgtcttcggagtcccaagaccccgccgccgccgcagcatcgtcggaggcccaagtcagcaaaaaggcggctaagaaggaggccgcgaagctggagaagctccgccgccgccaggaaatcgccgccgcatccgccgccacggccaacctctccgtcgacgaggaggaccccctcggcggaaactatggcgacgtgccgctggtggagctgcagtctaagacatcggcagacgtcggcgagtggacgcgagtggaggcgctcggcggcgcgctggagaacaggtcagtgctgattcgcgggagggcgcaggcgattcgccccgtcgggaagaagatggcgtttctggtcatcagagagaacggcttcaccgttcaatgcttggtgcaagcgcagcctgatacggtgagcgcgcagatggtgaagtttgccgctgcactcagccgcgagtccatcgtcgatgtcgaaggcgttgtttcggtccccaccgctcccatcaaaggcgccacgcagcaggttgaaatccaagtgaggaagttgtattgtgtcagtagggctgtacctactctgccaattaatcttgaggatgctgctcgaagtgaagttgaaattgagaaggctcttcaggctggtgagcaacttgttcgcgttaatcaggatacacgtttgaactttagggtgcttgatgtgcgaacgccggctaatcaagggattttccgcattcagtctcaagttggaaatgcatttagacaattcttagtatctcaaggcttttgtgaaatccacactccaaagttgattgccggatctagtgagggtggagctgctgttttgagtctggactacaaaggtcaacctgcatgcctgacccagtcacctcagcttcacaagcaaatgtctatctgtggagattttggccgtgtttttgagattggtcctgtgtttagagcagaagactcctacactcacaggcatctgtgtgagtttacgggccttgacgttgaaatggagatcaagaagcattactttgaggttatggatttagtcgatagattgtttgttgcaatgtttgacagtttgaaccagaattgtaagaaggatctggaagctgtggggtctcagtacccatttgaacctttaaagtatctgcggaagacactacggcttacatatgaagaagggattcagatgctcaaggatgttggagtagaaattgaaccttatggtgacttgaatactgaagcggaaaggaaattgggtcagctagtcttggagaaatatggcacggagttctatatccttcatcggtaccctttggctataaggccattttatacaatgccttgctatgacaatccagcatacagcaactcgtttgatgtctttattcgaggtgaggagatcatttcaggagctcagcgtgttcatgtgccagaatttttggaacaacgtgcagcagcttgcggcattgatgtcaaaacaatatcttcgtacattgattctttcagatatggtgcaccaccacatggtggctttggagtagggttggagcgtgtagtgatgctcttctgtggcctgaataacattcgcaaaacatcactctttcctcgtgacccacttaggattgcgccatgagaaaatcatatcccaacagttaattgctcaaatattgagtcttttcaattttcattatatgacaagattttatttttttatgttgaatcccgaaaacattatttaaattctcagtcttggagctgatacttaaatccaccgtgataaaaacaaatgttttgactggctgtattgccactgtgtattgaattgacccactttagaaagtccatctttctcctctaatcagaaaccaggtgaatcaatgataaatttgatcccatgaacatatttcagctggacatttggaactgggaatgacttgtatgcattcaaatcaagtagcattttgttaaaaaaaa

SEQ ID NO: 348 - DNA, 2033 bp, Glycine max
  Clone ID: PAT_MRT3847_60871C.1
acaccgcatacgttgtttcccttgggcgacccacgcgatgggaataatttttttttttttttttttgtgctgagttgttttgtttattactatttcttctcttttccttgtgacacagacaaggaaaaagggagaaagaacagttttttttttcttttttttgaataagtctttctctaccctcagttgctctcatagactcttgactctttcagttgtttactaattaacactcatcacattcgttgtgtttggcttcttcactcgctttctctatttttttctcactaaaaagttccatcttttttttttttttttaatttctggggttattattgctttctgtgattctgtctcagttccattttggtatctttgagggaaattcattgggtttgcagggttttatcttgttagaatttagaccaattggctaacagataatagtcttcattgaacatcaatttcaagcattctctctgatttttttgatcaagtggctcttttctagattctgattcccttcaaaatgcttctggatttatccttagtattgattgtataaaacctccacttctgttatcattttctctctgccttatcttcctcagtttccactcatcaagtttcaatcttcctttgaataagcccaaatttgattgtatgaaccagtagcttttgcttgtaaattgaattgatgaagtgggaaagtataaccctttcttctcctacttcttgtactccaaactccaacaccaattggttggtggaaaataatagcaggagcacaaaatggacccctgaagagaacaagctctttgaaaatgctcttgcagtgcatgataaggacaccccagatcggtggcacaaagtggctgagatgattcctggaaagacagtggttgatgtgataaggcagtacaaggagttggaagtggatgttagcaatatagaagctggtttgattccagttcctggctatagtagcactgctatctcacccttcaccttagattgggtgaacactcctggctatgatgggtttaaaggatgtggaaagagaccttcctcagtgagacccattgagcatgaaaggaagaaaggagtgccttggactgaagaggaacataaattgtttctattgggtctgaagaagtatgggaaaggcgattggagaaatatttctcgcaatttcgtgattactagaactccaacacaggttgctagccatgctcagaagtacttcataaggcaactttcaggaggcaaagacaagaggagggccagcatacatgacataacaacagtgaatctcacagaaaccatcacaacttcttgttcagaagacaccaatagatccacttcaccacatgttctctcacagccgcagcagcaaaattctactcctactacccccagaactcattttcagtggactaatcagtctaacacaggagtagctatgactctcaaccctgctcatgaaagagtcttcatgtctccttatggtgctaactcctttggggttaaaattgagggacagaatcttcatgagtcttcttacttgggacctcagacacagaacatggttttccaaatgcaacagtcctcacaacactagttccatgcattagaacttgttgtagtgaattattaatgggtagaagtagaaccagaatcttctgtccatttcaataagtacggtgcttgagttgagctttttcctaagttcttatgtgaatatcctagattattggttagttattatgaacttgaaggaaggtacatagatttgtttctttaacaaataagaacttcctgaaaggagtggcaggcaaccaagtcccaaacgttggtcttggttggttttgttgtctgggaataatggatttcaagcaaagtgtataaataatggaatttcgacttagaggaaaagaggcacttctcgtgtcttgtcctctccggcatatatatttgtatgtggaggatactgttactgcaattgaattcaaagcaaactttttatagaaatc

SEQ ID NO: 349 - DNA, 266 bp, Glycine max
  Clone ID: PAT_MRT3847_60948C.1
cgcacacaactactacaagtacttccttactatcaaaaccaacaacgtctatggcaagttatcaaaagcactacgatgatcagggtcgcaaggttgacgagtatggccacgttgagaaccaaagcgacgaatacggcaaccctgtacatgctgatagtgacagctatgtagacaccagaactgctgctggtagatactgtgatgacatttataagcaacatgataccaccagtgcctacggtgtacacactggtagacaacattct

SEQ ID NO: 350 - DNA, 1276 bp, Glycine max
  Clone ID: PAT_MRT3847_6094C.1
caaccctgcttcccataaaagtttgtgcaatctttcaagtaaaataaaatccacaaacatacacaccaaaccaaaccaatcctcaattggctgaaaaccttgttctacatgctctcatagttcgtgtgttgaattgtgttgtgaatttggtgtgatgaagtgggaaatggagatcctccctcctgcatcaccttacatgtacaattccaattggcttcttgatgataacaggaccaacaacaccaaatggacccctgcagagaataagctgtttgagaatgctcttgccgtgtatgatagggacactcccgatcggtggcacaaggtggccgagatgataccaggaaagacggttatggatgtagtgaagcagtacaaggaattggaagcagatgtttgtgacatagaagcagggttgatcccaattccggggtacagtagtggtaccaccacaacctcacccttcaccttggattgggtgaacactagtcctgcttatgatgatggcttcaaaggaatcactgctaagagatcctcctctggaagaccccttgagcaggaaaggaagaaaggtgtgccatggactgaagaggaacataagttgtttctactggggctgaagaagtatggcaaaggtgattggagaaacatatcgcgaaattatgtgatcactaggacgccaactcaagttgctagccatgctcagaagtacttcatcaggcaactatcaggaggcaaggacaagaggagggctagcatccatgacataacaacggttaatctcacagaaaccaccagaacttcttctgatgaaagcaagagatctgcttcgccacaaaattccgcaatgctctcacgccaccagcagctgaattctaatgctgcctcatccggattgaatttccagtggagcgatcagccaaatgcaggggtagctatggcactcaaccctgcacatgaacaagtcttcatgtccccttatggccttaactcatacgggtttaagatgcagggccaaaatctgcacagaagttctcttcatgagtcttcttacttaggacctcagacaccaaacatggttttccaaatgcagccctcccaacactattcccatgcatgaggtggtggtggttgttgttttgaattattattactattattattattattattatttatggctagaaccagtgtcttttgctcagttcactagtacagtgtctgtgctttttaccatgttttatgtgaatatctttcattacactgttgaaacaaa

SEQ ID NO: 351 - DNA, 163 bp, Glycine max
  Clone ID: PAT_MRT3847_6220C.1
tgtccctgggtcctccaggaagcttccccttaatcttgtccataaaccctttcttctcgttctgaacaccatgaaattgggcatgctgacgatgttccttcctatatcccgcttaaccgtgcgcaccccccagggttgactcctaaccaggttcacttccata

SEQ ID NO: 352 - DNA, 1638 bp, Glycine max
  Clone ID: PAT_MRT3847_62243C.1
attatattatccgattcagaattgtgtggactggaaactcctctgtccccaaacagcacgatgcgtgaatttgattcatctgtactggtggtgttgtcatcgtttttggacgtgagcgtcaacactctaagcaaagcagccatgaagaagggcatgaatgactttgtattcatcatgtactccaatgccttcgctgcatgcctcctccttctcttagccttattcttttataggaaaagaacacttccgccactctcctgtaacacccttggcctattccttgttgttggcatgctcagttgcattaatcagtcgatcaagtttttcggcataggttacagctctccaactttggcctcagcactgtccgatttggtgcccgcctttaccttcatacttgccgtcatcttcaggatggaaaaattagattggaaagctaatagcactctggccaagtccattggcacagtggtatcgatcgctggggcattgttattgtctttgtacaaaggccaagtcatcataaataataatccaccttttaaattgttccctcaaaaacttgtctcatccatgcaatttgactgggtatttggggcactgttgcttgcagctcatagctgttttctctcaataaactacattcttctgacacggatagtgagagaataccctgcagaactggtggtggtactcagtcgcattgcattaacatctatactatctgttcctgctgcactgatttcagtaaaggatctaaaagctttgagactggggtttaatatggagcttatagctattggatgttcagcaatttttgtcttatcctttcgaggtgttatccatatatggatcatggggaagaggggccctgtctatgttgcaatgtttaagccactcgaaattgtcttcgcagtcatcttgggggttacttttcttggggactctctttatattggaagtgtgatcggagctgccataatagttgttggtttttatgctgttatttgggggaaaagtcaagagaaggtggaggaagattgtacagtctgcagctctgagtcatatgataatgaggtccctcttttacagaacaagagaacgggggaataaaatcttcaggaaatgatttatatactttctgcttgtaagcaaagaacgatggcagaaaaatttcaatattcttgtttcctctaaatctgtttccctgggcctgcaagaaatagatattggtcaccgaggacatgaatagaaagattgcataatttgcacaagatattgattttttgggtgccacttattccctacatccaccgagaagggtcagagcggattacaattttctgccattgctgagttgaatgcacacaaatatcaatcagtttgacctttccttctttatttggttcttgtggactttcggatttcacctccagttgttgtatagatcgtctaccaatattatggaatgtgctgtgaaataattaattttagttcttaacaagagaatctacaacaatgcataatttgttatgtatgtgaagtgttgtttttgttatcaattattgtagttattttatgtttattcattttaaaggaattaaaatgcatatgggtgtgtggggtttattgataatg

SEQ ID NO: 353 - DNA, 258 bp, Glycine max
  UNSURE (1)..(258): unsure at all n locations
  Clone ID: PAT_MRT3847_62711C.1
  unsure (1)..(258): unsure at all n locations
ctctctctttctctttctctctcatccagatcttgcaaanaaaaaaangcacaatggcagcgagngntccnantccangcnaaganttcgtgtacatggcnaagtggcggagcaggccgagcgctacgaggaganggtgnagttcatgganaaggtctccgcntccgccgaaagcnaggagntgaccgtggaggagcgnaacctcctctccgtngcctanaagaangtaatcggngctcgccgcgcctcctggngnat

SEQ ID NO: 354 - DNA, 725 bp, Glycine max
  Clone ID: PAT_MRT3847_63030C.1
ccgtacgcccgcgagaagacgacagaagggggatcgctctcacgcttctgattattcctcttcccattctagggttccgaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgcttttggctgtgaggaacgatgaggagttggggaaattgcttgctggtgtcaccattgctcatggtggtgttcttccaaacattaaccctgttttgctacctaagaagactgagagggctcaaggaacctaaatctccatccaaggctaccaaatctcctaagaaagcttagatgtttttattttattttaatgaatatgtatatcagtgtttagatgctttttatgtaaaagaaaatattatctgttgcaaacactgtaattcttatcgtcttgcatgtaggagtttgctaaattaatgaaaatttcttattattttgggtcaaaaaaaaaaaaaaaaaaaaaaaacaaagcggccgctctagagaa

SEQ ID NO: 355 - DNA, 914 bp, Glycine max
  Clone ID: PAT_MRT3847_63031C.1
ttttccacgcgtccgaagacgacagaagggggatctcaccatcactctcgcacttgtgattattcctcttttaacaatccgcacccaaattctagggttccgaaatggacgctggcggaaagatcaagaagggcgccggaggaagaaagggcggcggcccaaagaagaagccggtttcaaggtccgtcaaagccggtctccaattccccgtcggaagaattggccgttatttgaagaaaggaaggtacgctcagcgtgtcggtaccggtgctcccgtatacttggctgcagttctcgaatacctagctgccgaggtgcttgagttggctgggaatgctgcacgtgacaacaagaagaacaggattattccaagacacgtgcttttggcagtgaggaacgatgaggagttggggaaattgcttgctggagtgacaattgcacatggtggcgtgcttccaaacattaaccctgttttgttgcctaagaagtctgagagggcttccaaggaacctaaatctccatccaaggctactaaatctcctaagaaggcttaattgacttattagtttattgttctctatttagtgtgcacaatgtaaatctgtgtttaggttcttttttctatcaccataattgtagttctcaaatcgttgtttattttttgcattttcactcaattagtcgaaacagcaagttctcagtaagggattaatttaattttcttatattcgtataattgtatcctttctcattctctctctcaatcgagatgttgtgaaatgttacattgttgaatttccatcataattattgtttggataggtgtatgtgtgatccaagaaagaaatggacgttgatagtatgttacttagcactattgtaggcagtgacaagagtttaatgtcaaattatgc

SEQ ID NO: 356 - DNA, 983 bp, Glycine max
  Clone ID: PAT_MRT3847_63035C.1
atattattcctcttcccattctagggttcccaaatggaccccacgcgtccgcccacgcgtccgcccacgcgtccgtacggctgcgagaagacgacagaaggggatccatttctcgcaacaacgcttaacctctctcattccccatttcctcacctccttcaaccgctgctaaattctagggttccgaaatggacgctggcggaaagatcaagaagggcgccggaggtagaaagggcggcggcccaaagaagaagccggtttcaaggtccgtcaaggccggtctccaattccccgtcggaagaattggccgttatttgaagaaaggaaggtacgcccagcgtgtcggtaccggtgctcccgtatacttggccgcagttctcgaatacctagctgccgaggtgcttgagttggctgggaatgctgcacgtgacaacaagaagaacaggattattccaagacatgtgcttttggcagtgaggaacgatgaagagttggggaaattgcttgctggagtgacaattgcacatggtggcgtgcttccaaacatcaaccctgttttgttgcctaagaagactgagagggcttccaaggaacctaaatctccatccaaggctaccaaatcccctaagaaagcttagattacttttttattttccatatttaatttagtgttgtatatcggtgtttaggtgcttttggtgtaacaggatattttatgtgtttcgaaaacactgtaattcttgtcccaatttgttgcttgtaggagtgagtttgcttcgttaatgaaaagtggaaacccccttgttttcaatcaacattctctctacctcctttttgtttttattatgagatgttgattcagttgcattgaagtgaagtaatttgtttagaagcggtgaataaactgaactttaagtagtttcgtgctgagttcctatgggcttggtgtagactgtaactttatttgaattaaacaatgtccg

SEQ ID NO: 357 - DNA, 1767 bp, Glycine max
  UNSURE (1)..(1767): unsure at all n locations
  Clone ID: PAT_MRT3847_63039C.1
  unsure (1)..(1767): unsure at all n locations
gcgtccgtacggctgcgagaagacgacagaaggggacgtccagaattccccgccgtctcgctcttgcaattattcctcttctcgcaatccgcaccctaattcctaggctttggaaccgaaaggggtcaaatccttcaataccgatatgcgccccggcatgaagccgcggccgaaatctgaagggttacgaaatggccgccggcggaaaagaccaagtccgcgcgccggagggtagaaagggccggcagaccaaagaagaaggccagtgtcagggtgtcggccccggtgcagtacgttaacgttgtccgggacctcgtctccgaatccgccgtcgggagtgtttggcctgtatatggaagaaagggaaagaagcgctcagcgtgtacggtaccggtgctcacggatacctggaaacaacacattaaacctttctcattccccatctcctcaccttattcagccactgctaatttctagggttccgaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctattggctgtgaggaacgatgaggagttggggaaattgcttgctggtgtcaccattgcacatggtggtgtgcttccaaacattaaccctgttttgttgcctaagaagacggagagggctgccaaggagcctaagtctccatccaaggctactaaatctcctaagaaggcctagattatcctttttttttttttttttttaaatctagtgttgtatatcggtgcttagatgcttttggtgtaacaggaaatttgatgtgtttcttaaacattgtaattcttgtcccattgtgttgcttgtaggagtgagtttgctttattaatgaaaagaaaccgtggaaaccaagagaaaatacaaaaatggtgatgatgaaactcaagacaggaatacatcaagaaaacaagatgctgtgcaaacatcataacatgcacatttatgagaggaaagagagacgggtaaaggtgaagtctcataatgaagaattaacagcaaagaggagatgttcaagaagtcgagagcgtgaggatagaaggtccccttctttttcaccaagggagcaaaaacgtacttatcaagatggagagcgcaaagagttgtcaatgcattccttgaaagatagttctagaactaagaaccctgatattgatagaaatagagtatcaactaatggttcaagtggtcaccatcatcgacatggtgtctccacaagtggacttggtgggtattctccaaggaagaggaaaagtgaagccgctgccaagactccttctccatctaagcattctcttgagaagaaacgtgctggatgggatcttccccctgcagggacaaataatccttctgctgttgtttcttcaagttttccagtatcaaattgtgctgtgttgtctaatatgcatgatgtggtttcaactagttctcttgatctagcccttgtgaagcctctgcctgtgtcttttccaagtgatgtatcaacagggaagaataccannacattgattctgt

SEQ ID NO: 358 - DNA, 442 bp, Glycine max
  UNSURE (1)..(442): unsure at all n locations
  Clone ID: PAT_MRT3847_63148C.1
  unsure (1)..(442): unsure at all n locations
aatcagctccatgtgtcctcttctttgatgagcttgactccattgctactcagagaggaagtagtggtggagatgctggtggagctgctgatagagttctgaatcaacttctgactgaaatggatggcatgaacgccaaaaagactgtgttcataattggggccaccaacagacctgatatcattgactcagcacttcttcggcctggtcgtctagatcaactgatctacattcctcttcctgatcaggagtcccgttatcaaatcttcaaggcctgcatgaaaaagtcacctgtctcaaaagatgttaatttgggagcactagctgagtatactaaaggctntagcggtgctgatataactgagatatgccaaagagcatgcaaatatgctattagagaaaacatagaaaaggacatagagcatgagaggaagagaagaga

SEQ ID NO: 359 - DNA, 2093 bp, Glycine max
  Clone ID: PAT_MRT3847_63328C.1
gtgtgtgtgtgtgaaactctcgacttctcaacttagcaacgcttgaaattttagttcacaaaagtcactgcctcatagcaagccttgaatccatatttgagagacacccatcctcccattttttattttcttttcatgttgattgattgatcatgaacaaaatataactcataacttaatcctactatataaaaatagagggatctccttctcttatccagagaagcatatatagagaaagaaagaaggccctgccctatatagctgaaggcagtgtgcacaaactctgagactgcatattagagtttgagtcttcactctgaagcctaacttgggtttgtgtctctcatagcaagatgatggaaaacggtggcaaacagacatttgaagtctccaatgacacgcttcaacgagtaggttccaagagctttgatgatgatggccgtctcaaaagaactggaactatttggactgcaagtgcccacataataacagctgttattggttctggggtgctatctttggcttgggctattgctcagctaggttggattgctggtcctgtggtgatgattctattctctattgtgacttattatacctcaactcttctagctacttgttaccgttctggtgaccaactcagtggcaagagaaactacacttacacacaagctgttagatcctaccttggcggcttttcgtttaagttttgtgggtaggttcagtatgcgaacctttttggagtggcaattgggtacaccatagcagcttccataagcatgatggcagtcaaaaggtctaattgttatcatagtagcggagggaaaaatccatgcaaaatgaatagcaattggtacatgatttcatatggtgttgcggaaattatcttctcccaaattccagatttccatgagttgtggtggctctctattgtagctgctgtcatgtccttcacatactcattcattggacttggccttggtattggtaaagttataggaaacggaagaattaaaggaagcctaactggtgtaactattgggactgtgacagaatcccaaaaaatttggagaactttccaagcgcttggaaacatagcctttgcttactcctactcaatgatccttattgaaattcaggacacaatcaaatcccctccagcagagtcagagacaatgtccaaggctactttaataagtgttttggtcacaaccgttttctatatgctatgtggttgctttggctatgcttcttttggagatgcaagtccgggaaaccttctcactggctttggcttctataacccattttggctcattgacatagccaatgctggcattgttatccaccttgttggtgcataccaagtttactgccaacccctcttctcattcgtcgaatcaaatgcggcagaaaggttccctaatagtgattttatgagcagagagtttgaagtaccaatccctggttgcaaaccctacaagctcaacctcttcaggttggtttggaggacactttttgtgattttgtcaactgtgatagccatgctcctaccattcttcaatgacattgtagggcttattggagccattggattttggcccctcactgtgtatttaccagtggagatgtatataactcaaactaagataccaaagtggggcataaaatggataggcctacaaatgcttagtgttgcatgctttgtaattactatattagctgcagcaggttccattgctggggttattgatgatcttaaagtttacaagccatttgttaccagctactaattcaataggataattacttagtgatcatgatcaccattgtcagagatttcattagcaacaagaaaaaaaaaagaaggtaaattgttgcaaattgaaatcaacaggaaggtggtcttacttgtttattgcttagtaaccttgtatcttctgtatctttgtttttttttgtttgtgtgtgtgtgttctcttactttgtaacttgctctgtatccctaatttgcaatgagaaatggaggaaatgaagcagaggctttcaaattatcaaagcttttctctttgagtcaagccacttgcatt

SEQ ID NO: 360 - DNA, 887 bp, Glycine max
  Clone ID: PAT_MRT3847_63488C.1
gcacgaggattgaaggcgcatccccttctccctttcaaattttggtctccactacgaattcgcacaaaccctacccacatcttttttttttttttttcttttgcagttgctaggcaccaagatgaaagtcaacatcttgcaatgccagcatagatttacactcactccttccccatttcaaatcttcgtctccaattcgcgctcacataaaccctaccctcaatttccattcgcaatttttgttgctgctgagcacggaatcggagatgaaagtgaagatcttgcaatggcatgctattgcttcttggacttgggatgcacaggacgaaacgtgtgggatttgtaggatggcctttgatggatgttgtcctgactgtaaacttcctggagacgactgcccgctgatttggggtgtatgcaatcatgcgtttcatttgcactgtatcctgaaatgggtgcattctcagacatcacaagcgcattgccccatgtgccgtcgtgaatggcagtttaaaggatgagagcatttttttttcctttaagggcggccactgaccaatgtaaatcggtctagttgaagacacttcttctgcagttttaccacgcatataagatgcactggcttcttattagctattgtacacttcaatatattttattggttcggtaaggaggtgatcaaattcaaagtttctggatgtgaaattttattattgtcatgtgaatgacatcctcgttttttttcttctgatagtttgctgatgtcttactgctcatattttgtatcgatagtatgcttccgaagcatgacaatgtatgtaattggcttcacaagattgacctaaataaggttgcattattgaagttattattttttaaaaaaaaac

SEQ ID NO: 361 - DNA, 184 bp, Glycine max
  Clone ID: PAT_MRT3847_63655C.1
tttgccccgaagggtaaggaaggttggtagggtttcaatagcaatacccataatgagtcaccctatcccaacctctgatgatacccattcggtgcaaattattataccacacatacagatgggtctgaagtcaaacatgtacctattttgttgctcatatactcacattgctgctaccaaggga

SEQ ID NO: 362 - DNA, 179 bp, Glycine max
  Clone ID: PAT_MRT3847_63797C.1
gtgttatgcatccaatgttatttaccataggcccggctgcacatacccaccgacggctgattttcattgagtgagtcctctttttctgttactgctatgaatttttttctttttatcattgagaaagattttaatagccacactctaactggtgtggggttttttaacaaacagcataa

SEQ ID NO: 363 - DNA, 575 bp, Glycine max
  UNSURE (1)..(575): unsure at all n locations
  Clone ID: PAT_MRT3847_6427C.1
  unsure (1)..(575): unsure at all n locations
ggctcgagatggaggctacttcagcagccactgttccgacaaccttctacatgtccccttctcaatctcacttgtccaacttcggaatgtgttacggtgtcggagaaaatggtaacttccattctccacttacggttatgcctctcaagtctgatgggtcactttgtatcttggaagctctcaaaagatcacaaacgcaagtgatggtgccaacttcgtctccgaaattggaggactttctaggtggtgcaactatgggaactcacgaatatggaagccacgagagaggtttgagcctagacagcatctattataactcccaaaacgcagaggctcaacccaacagagaccttctttcacaacccttcaggcaacaaggtcatatgagtgtccaaacacacccttattactcaggccttgcttgccatggtttatatcaagcaccgttggaggaagaaacaacaaaggaaacgcacgtgtcggattgcagctccctaatgcctcanatgacagaaggcttgaaaaactgggtggctccaacaagggagtttttcactcaccagcaggttttggag

SEQ ID NO: 364 - DNA, 170 bp, Glycine max
  UNSURE (1)..(170): unsure at all n locations
  Clone ID: PAT_MRT3847_64305C.1
  unsure (1)..(170): unsure at all n locations
gnacacanctacnacaatnacntccttanaatcaaaannaacaacnactanggcaagttatnaaaagcactacgatgatcagggtcgcaaggtngacgagnatggcaacgtngagaagcaaaccgacgaatacggcaaccctgttcangctgctagtgncaccnnngnag

SEQ ID NO: 365 - DNA, 455 bp, Glycine max
  Clone ID: PAT_MRT3847_65269C.1
caaatgaggcgttaaggatcaatgttttattcagacacatacagaacatgttgtccagtcacaccactgtgattgctgaagctggagacacttggtttacttgccagaagctcaaattgccacaaggctgcgggtatgaatttcaaatgcagtatggatcaataggttggtcggttggtgcaactcttggttatgcacaggctgctccccataagagagtgattgcttgtattggcgatggtagcttccagatgacagtacaggaagtgtcaacaatgttacggtgtgagcagaatggcatcatctttctaattaacaatggtggatacactacagaggtagaaattcatgatggaccttacaatgtcataaaaaattgggactatgctggacttgtggaaagactagataatggtgaaagcaaatgctggactgccaaggtattgtgaggagta

SEQ ID NO: 366 - DNA, 1349 bp, Glycine max
  Clone ID: PAT_MRT3847_65615C.1
tcgttccgcgtggagaagacgacagaaggggggagacttaaatgaaaaggaaataatcttaagtggaaccttctgcgaaattagccttccttcgtcccttgattgaagtataaattaggggtgttgaaattcaaagccatatccgtcattaaccaaatttgtgtttctccgattgcaagcaatggactccttcaattccttcttcgattcaacaaaccgatggaattacgatactctcaaaaacttccgtcaaatttctccggtcgttcagaatcacctcaagcaggtttattttactctgtgtttcgccgtggttgctgcggctgttggggcttaccttcatgtcctcttgaacattgggggttttcttactacagtggcatgcgtgggaagcagtgtttggttactctcgacacctccttttgaagagaggaaaagagtgactttgttgatggccgcatcactgtttcagggtgcctctattggacccttgatagatttggctattcaaatcgatccaagccttatctttagtgcatttgtgggaacatccttggcctttgcatgcttctcaggagcagctttggttgctaggcgtagggagtacctgtaccttggtggcttggtttcttctggattgtccatccttctctggttgcactttgcttcttccatctttggaggctcaacagctctctttaagtttgagttgtactttgggcttttggtgtttgtaggttacattgtagtagacacccaagaaatagttgagagggcacacttgggcgatctggactatgtaaagcatgccttgaccttgtttaccgatttggtcgcagtttttgtccggattcttgttattatgttgaagaattcgactgagaggaatgagaagaaaaagaagagaagagattgattttcttaccaatctgctcgattaacacttcacctcgcttggtctgtaatacataaaacagccgtctatacagtgttttccactttttaagcttgctcctcctactgtgcagttaagtcgtttgtttaccaatagtccatattgacatgttttgagctctctaataagagaaatgtttacattacaaatgtttacattacatttgttttaaagatgaaaaggggagtggggaagaagtcgatggtgaaggtccctaataaattcttactcccaagactcagaatttttcttggggaggaagtggaattcagggaaacacttttttttcacacattagtgtataattttatactagactcgccaaatcacgaatttcattatctatttagcttcttttttttccccctgtaaaaaaaaaacaaaaaaaaaaaaa

SEQ ID NO: 367 - DNA, 314 bp, Glycine max
  Clone ID: PAT_MRT3847_65785C.1
ccacgcgtcctttttaatgaggatttagtggttgttcatgatgctcttgagtttggacattgtcgtttgtcccttgcggtacctaaggaaggcatttttgagaacatacatactatggaagatttgctaaagatgtctgaatggacagaagaaaggccactacgtgttgttactggatttggatatctaggcgataagttcttaagagagaaaggttttaagcatgtttcgtttttatctgccgatggagctcttgagtcatatcctcctgtgagtctgcttcctcttcatttgttttcctttctgtttccttg

SEQ ID NO: 368 - DNA, 2238 bp, Glycine max
  Clone ID: PAT_MRT3847_65831C.1
ccacgcgtccgcggacgcgtggggtagaatttggtagggagagaacaaacccactataaaatgcccacacccctgcctcgctgttctcacatcttcttttacgtattgaatctcagaattctctaaaagagatctttttctgctctttgaagaaagaagggtctttgcttgattttggagatgtctctgctctcagatctcatcaaccttaacctctccgataccaccgagaaggtgatcgcagagtacatatggatcggtggatcaggaatggacctgaggagcaaagcaaggactctcccaggaccagttagcgacccttcagagcttcccaagtggaactatgatggttccagcacaggtcaagctcctggtgaagacagtgaagtgattttatacccacaagccattttcagggatccattcagaaggggtaacaatatcttggttatctgtgatgcctacactcctgctggagaacctattcccactaacaagaggcacgctgctgccaaggttttcagccatcctgatgttgttgctgaagtgccatggtacggtattgaacaagaatacaccttgttgcagaaagatatccaatggcctcttgggtggcctgttggtggtttccctggacctcagggtccatactactgtggtgttggcgctgacaaggcttttggccgtgacattgttgacgcacactacaaagcctgtatttatgctggcatcaacatcagtggaattaatggagaagtgatgcccggtcagtgggaattccaagttggaccttcagttggaatctcagctggtgatgagatttgggcagctcgttacatcttggagaggatcattgagattgctggtgtggtggtttcctttgaccccaagccaattaagggtgattggaatggtgctggtgctcacacaaactacagcaccaagtccatgagagaagatggtggctatgaagtgatcaaagcagcaattgacaagttggggaagaagcacaaggagcacattgctgcttatggagaaggcaacgaacgtcgtttgacaggacgccacgaaaccgctgacatcaacaccttcttatggggagttgcaaaccctctctctccctccaccttaaccctctccccacgcgcccttctccctccctcacgcgcccttctctctccctcacgcgcccttctcactctcgccgctccttcgttgtcaaagcctcctccagcgagcttccgctggttggtaacaccgcaccggatttcgaagcagaggctgtgtttgaccaggagtttatcaacgtgaaactatctgattacattgggaagaaatatgttgtgctcttcttctacccgttggacttcacctttgtctgccccacagaaatcactgctttcagtgaccgacatgcagagttcgaggcactaaatactgagatattgggtgtttcagttgacagtgtgttctcgcaccttgcatggatccaaacagatagaaagtcaggtggccttggtgacttgaactatcctttgatttctgatgtcaccaaatccatatcgaaatcttatggtgttctcattcctgatcagggaattgcattgagaggattgttcattattgacaaggaaggggttattcagcattctaccattaacaacttagcaattggtagaagtgttgacgagacaaagagaactctccaggccttacagtatgtgcaggagaacccagatgaagtttgccctgctgggtggaagcctggggagaagtccatgaaaccagaccctaaacttagcaaagactactttgcagcggtgtagctaggataatagttaagagtggctatctgcatctgtatcaatcagtgaattgcaaaagggtcttgttttttttaatgttttgtaagtccttaaattttgagccgcagggtttggtaatatgcgtgctggtgtactggattttgaagtgtactatgtattaatttgcaatttctgttcattatgatctctgtaaaaaaaaaaaaaaaaaaaaaaaaaaaatttctgcggccgcgaattcttccacataatgtgtggaacgaagaatacttttatataaattgttttgcactattggcctctctgtttgatcctttaataattctgcattgcatgtgcatgcgtatcacacaggtgcaagcttatgctaacttgcattcgcattgtcgtttgcttttgtgggtgttgaacaaat

SEQ ID NO: 369 - DNA, 2773 bp, Glycine max
  Clone ID: PAT_MRT3847_66342C.1
cggagatatggctccgacccacgcgtccgcaatttcatccacggtgtcagtcgtcacgcgtccgattgaattaagtgattgaatggttccgaaatgcacttgctgtctttttctacttgactattacaccttccccattttgatttgatctgattgaattggcctcttgccagcaaaacagaatgtggaagctcaagttcgccgaaggagggaatccatggcttcggacattgaacaatcacgttggaagacaggtgtgggagttcgatcctaagcttggatcgccgcaagatctcctcgagattgagaaagctcgccagaattttcacgataaccgctttacccacaaacacagcgctgatctacttatgcggatgcagttcgcaagagagaacccaacacgtgaagtcttgcccaaagtcggagttaaggatattgaggatgtgacccaagagattgtgacaaaaacattaagaagggccgtaagtttccattcaactctccagtgccatgacggacactggccgggagattatggaggtcccatgtttctgatgcctggcttggtaattactctgtctatcactggggcgttgaatacagtcttaactgaagaacatagaaaggaaatatgccgttacctctataatcatcaaaacaaggatggtgggtggggtttgcatattgaaggtccaagcaccatgtttggctctgtcttgagttatattactctgagattgctaggtgaggggcctaatgatggacaaggggaaatggagaaggcacgtgactggattctagggcatggtggtgctacttatataacgtcatgggggaagatgtggctttcagtacttggagtgtatgaatggtctggaaataatcccctgccccctgagatatggctccttccatacatgcttccatttcatccaggaaggatgtggtgtcactgccggatggtctatttgccgatgtcctacttatatggcaagaggtttgttggtccaatctcaccaacagtattatctttgagaaaagagctttatacagtaccataccatgatatagattgggatcaggctcgcaatttgtgtgcaaaggaagatttgtactatcctcacccacttgtacaggatattctttgggcatctctacacaagttccttgagcctattctgatgcattggcctggaaaaagattgagggaaaaggctattatttctgcattggagcatatacattacgaagatgagaatactcgatatatttgcataggtcctgtaaataaggtgttaaatatgctttgctgttgggtggaagatccaaattctgaggccttcaagttgcatcttcccaggatttatgattatctatggattgcagaagatggcatgaaaatgcagggctacaatggaagtcaactatgggacactgcttttgctgtccaagcaattattgcatctaacctcattgaagaatttggtccaactataagaaaagctcatacctatattaagaattcacaggttttagaagattgtccaggtgatcttaataaatggtaccgtcacatttcaaaaggtgcttggcctttttcaactggagatcatggatggccaatttctgactgcacagctgaaggactgaaagctgttctattactatccaaaattgcaccagaaatagttggtgagccaatagacgtgaagcgattatatgattctgtaaatgtcattctctcactacagaatgaagatggtggttttgcaacatatgagcttaaacgatcttataattggttggagataatcaatcctgctgaaacttttggtgacatcgttattgattatccttatgtggaatgtacatcagcagcgattcaagctttggcatcatttaggaaattatatcctgggcatcgccgagaagaaatacaacattgtatcgataaagccactaccttcattgaaaaaatacaagcttcagatggatcatggtatggttcttggggagtttgcttcacttacggtgcttggtttggggtaaaaggtctgattgctgctggaaggagtttcagtaattgctcaagcatccgtaaagcttgtgaatttctgctgtccaagcagcttccttctggtggctggggagagagttatctgtcctgtcaaaacaaggtgtattcaaatctggaaggcaacaggtctcatgtggtcaacactgggtgggctatgttggctctcattgatgctggacaggctaagagagattcgcaaccactgcaccgggcagctgcatacttgataaattcccaattggaggacggtgactttccgcagcaggaaataatgggagtcttcaacaagaattgcatgatcacatacgccgcatacagaaacatattccccatttgggcgttgggagaataccaatcccaagtattgcaatctcgttaatcgagccttagttagggtgtcatcctaattatttcgacctgtggacagtaaaagaaataataataataacctatttttcttttatttccatggctctcttaaaatgtttgtgactaatgagtttagtagtcagctaaaaaaaaaagcaaacacgtggagaatgcctgtaagttttttctattactcatagacgcctctcttgctttccctgcagcagaggaattaaatatatacataaatagagatataaatgtttatgtcacttcttttgggacgaagaacgcaattctttctagcaatcgattcaaattgtttac

SEQ ID NO: 370 - DNA, 478 bp, Glycine max
  Clone ID: PAT_MRT3847_6668C.1
aattcggctcgagtggcagtgtctcttccctggcttggtttatgtcaaatcaagaaacaagctttgtcacaattggtcaaagagttcttgcaagaccactgaaggtgcgattccactatggtcatccagatgtttttgatagaatttttcacataactcgaggaggaatcagcaaggcatcttgtggcatcaatctgagcgaggatatttttgctggattcaactcaacactaagacgcggaaatattactcatcatgaatatatccaatgcggaaagggtagagatgttgggctcaatcaaatctcactttttgaagcaaaagtggcttgtggtaacggagagcagacattaagcagagatatctacaggctgggacatcgttttgactttttccgcatgctatcatgttatttcacgaccattggattttatataagctcaatgattgtgggcctcacatgttatgcattcctata

SEQ ID NO: 371 - DNA, 177 bp, Glycine max
  Clone ID: PAT_MRT3847_66759C.1
ccacttcaccttacctaaaatccactttgcagtgcaagattgcaccctccaaggctcgagcctcgtcctgctcgcgaaatcgcaacacgtcgagtctctgttccccgacctcattggctccgtgaccacctctctgaaagtcatgcctctacaacagctccacttgtgcaccgaagt

SEQ ID NO: 372 - DNA, 1295 bp, Glycine max
  Clone ID: PAT_MRT3847_66975C.1
gccctttcgtcgttctccgtctccctcatttgttcactttctctctctaaatccctaaaccagatctcgcactcgcgctttctctctctaggattcgacaatggcggccgctccctcgcctcgcgaagagaacgtgtacatggcgaagctcgccgagcaggcccgagcgctacgaagagatggtggagttcatggagaaggtctccgccgccgccgacaacgaggagctcaccgtcgaggagaggaacctcctctccgtcgcgtacaagaacgtgatcggagcgcgccgcgcctcgtggcgcatcatctcctcgatcgagcagaaggaggagagccgcggcaacgaggaccacgtctccgtcatccgcgactaccgatccaagatcgagtccgagctctccaacatctgcgacggtattctcaagctcctcgactctcgcctcattccctccgcttcctccggcgattccaaggtcttctacctcaagatgaagggagattaccacaggtacctcgccgagttcaagaccggcgccgagcgtaaggaggctgccgagagcactctctctgcatacaaagccgctcaggacattgcaaatgccgaactgcctccaactcatccaattaggcttggccttgcacttaacttctctgtattttactacgaaatccttaactctcccgatcgtgcctgcaaccttgcaaaacaggcttttgatgaagctattgctgaattggatacactgggagaggagtcatacaaggatagcactctgatcatgcaactccttcgtgataacctcaccctttggacctctgacatgcaggatgatggagcagatgaaattaaagaagcagcaccgaaacaggatgaccagtaaaaatattttactgctaattagaattgaacttctcctccatatctttttgaagggagaaggtgtttgttgctaatatctctttggtactgagattttaggcattcatgtttgttatgattgtggatgtactgggccgtttttagtttgtccttccattttcaagtgttttgccaaattgcctattttattaaggacgctgaagtttttattatatggaattggaattttaagattcttctcttctatctagtaaacttgatgtcacccgcttatattgtgaggattagatatatttgtattctttttgaagcctcgatatttaaatttagtttgattggaattgggtttgttctcgttgaactattttgagcattgtacacttcattctgatagaagtttctgctgttcgagatc

SEQ ID NO: 373 - DNA, 644 bp, Glycine max
  Clone ID: PAT_MRT3847_67765C.1
tggaggatagtttgcccttctcccattatagaaacccgcaataacaacctggaaatgcaatcagtaaataacaaatctctcattgaagagcttgataagcttcttgagcgattgcgtgtcccttctgagtatgccacaaatttgactggaggttcatttgatgaagctcgaatgcttcaaaatgtagaagcatgtgaatggttgaccagtgccttgcgtggtcttggagtgcctaatctagatcctagttatgcaaacatgagaactgttaaagagaagcgtgcagaacttgaaaaattaaaatctacttttgtcaggagagcctctgaattcttgagaaattattttgctagtttggtggacctcatgataagtgataaaagttacttttctcagcggggacagttaaagaggcctgatcatgctgacctgcggtacaagtgcaggacatatgcacgtcttctgcaacatttgaagagtcttgacaagaattgtttgggtccattgatcaaagcttattgcagttctctaaacttgcttcttcgcagagaattgttttcactttgtttcctattttgaaagctttgagaaaagttgatttccctgtttcttatacaaatatttgaaaatcttaaagtataaac

SEQ ID NO: 374 - DNA, 180 bp, Glycine max
  Clone ID: PAT_MRT3847_68206C.1
cttgaaggcatctatccccacaaccatcaacagtggtcgtggtgctgaattcgaatgggctgtcattgctctgttccatctgttgattacgagtaccgctagagtccgtgctcttcgtgaggctttctaccgccagaaccttccctatgtgaccaatttgcttgccactgtcttggtatt

SEQ ID NO: 375 - DNA, 1013 bp, Glycine max
  Clone ID: PAT_MRT3847_68258C.1
gagaactgtaagttcccacgcgtccgcccacgcgtccgtacggctgcgagaagacgacagaaggggatcatcaaatcaaaaaccctaattcccaaattctctcatttttcaagtttcaaccaagaaaagcagcaacaatgtcgggtcgcggaaagggtgggaagggtttaggaaagggaggagcaaagaggcatcgcaaggtgctccgcgacaatatccagggaatcacgaagcccgcgattcggagactggcgagaagaggtggcgtgaagagaatcagtggtttgatctacgaagagaccaggggcgtgctcaagatctttctcgagaacgtgattcgcgatgccgtgacgtacacggagcacgctaggagaaagacagtgacggccatggatgtcgtttacgctctcaagaggcagggaaggactctctatggtttcggaggctgagggtttggccttctttggtggctttggtttgtgtaaatggaaggaatttgtgttttgtagtgattatatatgtacttggattatcttctgctcggtacatgctcaaggttcttctgttttttttttttaattctactagtaattgcatcctaattgttttgaattgaagtaaatttagtgaatgatgaatgttggatgttctatttctcacatttattattgttagtagtggtgtgggagagataacttttaagtgggttgttaatgctaatattaatttgttccttttttgctttcttacaactgggattgatgtggagaagtttgatagttgattcttgtggtgttattttgaaacattgttttgtgttctttatcagcgaagaattgatagtttagttctgaagtgggtgtgttgagaatttgaactttttgctgaatttaacttattcaaacgcactttgttgttgttcaatgacgagaatggggcctggcttaagtgcagtcgtgttagttgaaaagtaatgtttttttcccatgggaattaacttgaagttcaatcta

SEQ ID NO: 376 - DNA, 912 bp, Glycine max
  Clone ID: PAT_MRT3847_68261C.1
gcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaaggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatgggcaggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggat

SEQ ID NO: 377 - DNA, 368 bp, Glycine max
  UNSURE (1)..(368): unsure at all n locations
  Clone ID: PAT_MRT3847_69342C.1
  unsure (1)..(368): unsure at all n locations
attntnanattaattgaattagaagaagtttttttttgttgtttatatgcattaaaatagataatattattttaaaattttaaaaaaagttatttaaaaaaaaggttataatgatacaatttaaattntatttatgttgttttttgggattaatttagaaaaatatatagaggggattattatttaagggttcctaaaagcataccaatttaaaatataataagtcttattaaaggttggtgttatcatgaaaatagctattatatgtgtgaaattgctatccgctcacatattccacacaatatattatccggaaacataaaatttaaatcctggggttccttatgaaaaaaataacttacatttat

SEQ ID NO: 378 - DNA, 2052 bp, Glycine max
  Clone ID: PAT_MRT3847_69622C.1
tgaccaccttgaccgcactatctattcttctgttgctggcctgaggaggagggcatttggtttaccttgaaattggagatggcatattacaggaagtaaagcatgcccagctagagtatgagatttcatgcctggacataaatcccattggtgaaaaccccaatcacagtaatctagcagcagttggaatgtggacagacataagtgttagaattttttctcttcctgatctgagtctcatcacaaaggaacaattaggaggggagatcatacctcgttctgttcttctttgtgcctttgaagggatatcgtacttgctatgtgccctcggtgatggccatctcttaaactttatgttgaatactagtaccggtgaattaacagataggaaaaaggtatctctagggacacaacctataacactacggactttctcctccaaaaatactactcatgtatttgctgcatctgatcggccaactgtaatttatagtagtaacaaaaaattactttatagtaatgtgaatctgaaggaagtgagtcacatgtgtcctttcaattctgctgcttttccagacagtttggcaattgcaaaagaaggtgagcttactattggcactattgatgatatacaaaaacttcatattcgctctattccgctgggggagcacgcacgacgtatctgccaccaggagcaatctaggacttttgctatttgtagtttgaaatacaacccagctagtggtgaagactcagaaatgcactttgtccgcttgctggatgaccagacttttgagttcatatcaacttattctcttgacacttatgagtatggttgcttcataattagctgctccttctcagatgacaataatgtgtattactgtgttggaactgcatatgtactgccagaggaaaatgaaccaaccaaaggaagaattattgtttttgctgttgaagatggaaaactacagctaattgccgagaaagagacaaaaggagctgtttattgcttgaatgcatttaatggtaaattgcttgcagctattaatcaaaaaattcagctgtataagtgggtgctccgggatgatggtactcatgaattgcagtctgaatgtggacatcacggacacatcctagcactttatgtgcaaactagaggagattttattgtagttggtgatctgatgaagtcaatttccttgttaatctacaagcatgaagaaggtgctattgaggaaagagctcgtgactacaatgcaaattggatgtcagccgttgaaatcgttgatgatgacatatacctaggtgcagaaaacagttttaatctgttcactgttcggaaaaatagtgaaggtgctactgatgaagagcgaggtcgtcttgaagtggttggtgagtatcacctaggagaatttgtcaatcggttccggcatggctcccttgttatgcgcttgccagattctgatgtgggccagattccaactgttatctttggcaccattaatggtgttattggggtaattgcgtctcttccacatgagcaatatgttttcttggagaaacttcagtcaaatttgaggaaggtaattaaaggcgttggagggctcagccatgagcaatggagatcatttaacaatgagaagaaaactgttgaagccagaaactttttagatggagatttgatcgaatcatttctggatcttaaccgcagtaagatggatgaaatttccaaggcagtggacgtttcagtagaggagttatgcaagagagtagaagagttgacaaggttgcactgattttatattaatctgtgtagcttcgttgtttgtttgttttttttttcttatttaatattgttcttccttttttttttgaggggttgggtgggggttaaaataacattatatgcttgtattttctccccgctttttaccttctgtttgcattttacaatacatggatcacaaatggtgtatgaaatggatgtcatgttctaagtttctatttgacacttttggacacgctatcattttcctaaaaaacaacacc

SEQ ID NO: 379 - DNA, 315 bp, Glycine max
  Clone ID: PAT_MRT3847_69723C.1
cccggggtcgacccacgccgtccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttaaaagaaccaaacttaaataccccgggcttccaacgtaaaatttttttattagggcccccaaaattaaattcctggcccggcttttaaaaacgcggaaatgggaaaacccttggggtacccaaataaaatccccttgaaaaaaatcccctttt

SEQ ID NO: 380 - DNA, 1601 bp, Glycine max
  Clone ID: PAT_MRT3847_69851C.1
aattcggctcgagaccaaaccccgcaagaaatacatggaaaccgtttcttttgtgtaaaaataaaattaaaaaagatcaattgcagctattcttgtcaccgtttctttaatttgtctcttacttcacgcaagttgttcacggctcctctttatatgtacacgtactatctctcatgcatttcattcatcacatacaacactctctccaaagttcaaattaagactgaggggtgagaaagagagaattgatatgggtgccggtctagttgcgttcctcttaatggttcttgtgcaattggtctatgcagtgatgaacattacttcaaagcttgcaatagaatctggaatgagccctcttgtccttgttgcttatcgacaactctttgctactgtgtccattgctccctttgcttattggctcgagtggaatacgcttcccaggattacacagcgtcttatgattcagatattattttcgtccctgaccggagttacaggaaatcagatgctttattttgtggggctgaaatattcatccgctacaattgcatgtgcactgacaaatttgctcccagctttcactttcatccttgcagttctcttcagacaagagaatttgggaatcaagaagagggctggtctagcaaaggtattcgggacaatattgtgtgtgagtggagccttgcttttgtcattttaccatggaaaaaccattggtttaggccaatcaagtattcactggagatatgctgagaaaatggaaggaactagctcttctggcaaaggaaacatgttcctaggccctttggtcgtaattcttagcacccttgtttgggcagcatggttcataattcaaaaagacataagcaagacatttccagctccttacacgagcactggcttaatgtgtttcatggcaagctttcaatgcgtgatcattgccgtgtgtgtcgaccacagggcctcagcttggtcactccacaatgctatgagactttcctctgccctttatgcgggaatattttgcactggattagcctattgcctcatgtcgtggaccattgagagaaaaggtcctctttatgtctctgtatttacccctttgcagcttgtcctcactgccattttgagctgggctttgcttcgggagaaattatatgttggaactgccgtagggtctctcttgatagttttgggactctattctgttctctggggaaagagtgaagaggtgaataagggagacggtattgaagaagatgcagttaaagaagcagtcaaggattcgaagaatgacatggaattgcaatcatatgtgccatccaatggtaataatggtcgtgttattgcatgaagaagggacgcggcagagtgagattcctcgcaagatgctagtagctaaggattgagaaagtttcggttatttgtctttattctatttttgctccctaccagtaaatttgaattttgatatgtgtaatcttgtgtcacatttgaaagtggtccacaactctttgcagttgcattgaagacatgtattaatattattattattattatttatatattaataaacccggaatcagttattcctttaaaaa

SEQ ID NO: 381 - DNA, 2548 bp, Glycine max
  Clone ID: PAT_MRT3847_71429C.1
ccacgcgtccggcatctgattcgttcgttcactttcactttaccaactcctaacaatttctctctgtttccttcttcaccgcatcaatggagttggacggcgttctcctcggcatgtgcaaccctctcctcgacatctctgccgtcgtcgacgacgctttcttgcaaaaatacggtatcaagttgaacgatgcgattctcgctgaggataagcacaaacctatgtatgaagaattggctaacaatcctaatgtggagtacattgctggaggtgctactcagaattcaatcagggttgctcagtggatgcttcaagcaccaggtgccacaagttacataggttgcataggaaaggacaaatttggagaggagatgaagaagaaatgtacacttgatggtgtaaaggttaactattatgaaatcgacaatacacctactggaacttgtgctgtttgtgtggttggcggtgaaaggtcccttgttgccaacttatcagctgcaaattgctataagtctgagcatttgacgagaccggaaaattgggcattagttgaaaaggccaagtatttctacatttctggctttttcctcactgtatctcctgattccatacaattagttgctgaacatgcagctgcaaataacaagttcttcatgatgaacctttctgccccatttatctgtgagttcttcaaggatgcactgaataaagttctgccatatatggactacgtttttggtaatgagactgaagcaagaacattttctaaagctcaaggctgggagactgataatgttgaggaaatagctttgaagatttctcagttgccaaaggcatcggaaacacataaaaggattacggttatcacccaaggtgcagatcctgtttgcgttgccgaggatggaaaagtgaaaatttaccccgtgataccgttacctaaagagaaattagttgacacaaatggagcaggagatgcttttgttggaggatttctttcacaattggttaagcataagcccattgaagaatgcattagagctgggtgttatgcagccaatgttatcatccaaaggcctggctgcacatacccaccgacgcctgattttcattgagtgattcctctttttctgttactgctatgaatttttttctttttatcattgagaaggattttaatagccacactctaactggtgtggggttttttaaccccccggctagggaaaacagcgtgaaaaagttgcagcaagagataaaacttgaataagttcatatatttgaagtccgatcaagcatcaattctcatattgctgtttgtgatcttttttcattttcattttttccaccttttcttctttttattacagtttatgctgtatttgtacccctatcaaggcacatgtatcttaattatgctgttcgtgatcccaaccttcaagcaacacacggcaacaagtggaagaaaattgcagcacaagtccctggtcgcacagcaaagaggttagggaagtggtgggaagtgttcaaagagaagcagcaaagggaaacaaaggggaataactgcaccattgacccaattaacgatagcaagtacgagcatatccttgagagttttgcagagaagctagtgaaagaaaggccttcaacatcaacatcaacatcatttgttatggctacttccaacagttcttttctgcatgctgatgcaccggctcctgcaccagccttgcttccgtcttggctttccaagttccaatggcactgcacctgtgaggccaccctccccttctgtgactcttagtctttctccctcgacggtggcagcgcctcctccatggatgcagccccccgtcagaggacaggacaatgctagtcctcttgttttggggaatgtggcgcctcacggggccgttctagcatttggtgagaacatggtgatgtctgagctagtggagtgctgcaaggagttggatgaagtgcatcatgctttggccgggcataagaaggaggcagcatggcggttaagcagggtggagctgcagttggagtctgagaaggctgggcgaaggagggagaagatggaggaaatcgaagcgaaaatcaaagctctgagggaggagcaaacggctgcattggatagaattgaagcagaatatagggagcagttggcagggctgagaagagatgctgaaagcaaggagcaaaagttggctgaacaatgggctgcaaaacacttgcgacttactaagtttctagaacaggtagggtgcagatcaaggctcactgaaccaaatggaagatagagtgacatcaatcattcacaaattgggaaaatctagtttgcttttacttattattatgtcttgaatttatatgatatgaactttatagtcatagtagttttgttcctgtcatttttctaaaatatgttgttacatatggttattgatatcatccctatcttttcatacaacttgaggacttgcattagcggttgagttatgtttaaatataacatcctttatgaatatgaactttgttgttattc

SEQ ID NO: 382 - DNA, 158 bp, Glycine max
  Clone ID: PAT_MRT3847_71501C.1
ctagcaacatagaaagcacaatattgtaccaataatggcagcctaaatattttgcctcattatgctccttggtgcttctgcaagtgctgctacggcgagcattttcccgcaatgctcacaagctcctatagcttcccttctcccccatacctctcacc

SEQ ID NO: 383 - DNA, 132 bp, Glycine max
  Clone ID: PAT_MRT3847_72097C.1
ggtggaaagggttggaaaaacgtccatttaacttttaacaatttgaaaataaccctactttcccaaactaaacccactgcaaaaggcaatgtttgtgaacccccaacaaagcttttggacgggaaaaagttc

SEQ ID NO: 384 - DNA, 148 bp, Glycine max
  Clone ID: PAT_MRT3847_72935C.1
cttcactcagggtgttcaactccgcaattgcctcatcaaatgcttgcttggccaaatggcatgccctctcaggagagtttcatatctcataataaatgactgagaaattgagtgcatgtccaataccgattgtatgtgttgattgaag

SEQ ID NO: 385 - DNA, 1499 bp, Glycine max
  Clone ID: PAT_MRT3847_73198C.1
tacggctgcgagaagacgacagaaggggataaaaggagatccaaagtaaagaacacagatggcatgacaccacgaaaccaaattaaaaactgcgccttctctgtctctgtttgttcttctcactttatattctctctctgtgtatatctcttcactcttattattccttctcttctcaacgacgatggaggacccatcagcagcaacaacgttgttgctgaacagcgaatattcgaggctgttcgtcgaggacacggacttgtacaatcgcattgtgttgggaaccctcttgccgcacttcgtgtggggcccactcccgcacttcctccagacgtggcttcgcaattacctcggcggcgtcctcctctacctcctctccggcctcctgtggtgcttctacatttattattggaagcgcaacgtttatgttcccaaagatgctattccctctcgaagagccatgctcttgcaaatatctgttgctatgaaagccatgccttggtacactttgcttccaactgtttcggagtacctggtagaaactggctggacaaagtgctatcctagattatataatgttggttggcttgcataccttgtgtatttagcaatttatctaagtattgtagagtttggtatttattggatgcacagagaactgcacgacataaaaccgctttacaaatatcttcatgctacccatcacatctacaataaacagaacactctctccccttttgctggtttggcatttcaccctcttgatgggatacttcaggcattacctcatagcctttgtttgttttttatgccaatccattttactacacatttagtcctcatattcattgagggcatttggactgctaatattcatgattgcattcatggaaaattgtggcctgttatgggtgctggttaccacaccattcaccacactacatatcggcacaactatggccactacaccatatggatggattggctatttggaactcttcacaaccccgaggaggacgagggcaaggctatgtgatgaaatgcagacttgctttggcagtcattgattatcatgtttggattgttgaaatgtcgttacttgcatgtatagcataaatgcgtgagctatatttttctgatgtctcatcacaaggtgatggctctatattagagagacaggggttaaagtggagcttccctgtctcaaatcccattgttagtgtatgtggttgaggttattttctttctcaaattatgtggtagagttgagatagtaatgcagttttctcttttttgaaggtaatgcagttttctctgatgtgacaatagatggtctccctattaatgctttgttttgtttcattttctttccttctatgtttatagaataaagcacactctctaagggtgtgtttggttgtaaagagaaaagttgaagctgtgactagtgaggaagaactattctctcaaaaaaaaaaaaaaaaaaaaataaaaataaa

SEQ ID NO: 386 - DNA, 800 bp, Glycine max
  Clone ID: PAT_MRT3847_7340C.1
cggtccggaattcccgcggtcgacccacgcgtccggggttctcttatttgtttgcggcgaagagtaatgaggagcttacatcaattaagagagcagcatacctcaccaccagtgtgatgaaaaactttgtggttactaaacttgagaatgtaatagatgaggagaagaaaatctctcattcaacgttgatggaggagactgagaaagttattctggaaccttcaaaagtcaattgtaagctaaaggcagataacgttgatatttgttaccccccaatttttcagagtggtggagagtttgatctgaagcccagtgctgtcagcaatgatgagttattgcattatgattctgccagcgtgattatatgtgcagttggagctcgatataagagttattgctcaaacatagctcggaccttcttgattgatgcagaccctcttcaaagtagggcttatgaggttcttctgaaagcccatgaagctgtcataggttctatgaagcctggaaacaagttaagtgttgcataccaagctgcagtttctgttgtggaaagggatgcacctgacttgatttcatatttgacaaaatctgctgggacaggcatcggcattgagtttcgtgaatcaggattgaatcttaatgcaaaaaatgaacagataattagagaaggcatggtctttaatgtgtcacttggtgttcagaaattacagtgtgagaacagtaagtctaagaacaagcaattctctttgttgcttgctgacacagtcatcatcaccaaagataagacagaaattgtgact

SEQ ID NO: 387 - DNA, 296 bp, Glycine max
  UNSURE (1)..(296): unsure at all n locations
  Clone ID: PAT_MRT3847_73437C.1
  unsure (1)..(296): unsure at all n locations
cacatacttttttctataatatatacncacttttcaccaaaggcaataaacattacacggcataaagttcatatctaagtccaagaaatttaaaaaatcaaatgatcccaccaccaaaaacattgaaaaatggtcaaagactcaggttttgttttggccctgaccctaaccatggcgggcactagagctaccaccagaccattttttaaaagtgctaagtcgatgaaatccttgtatgcaaaagccctaaccttgacgaactagaccgatagctcctcattgtagccgttgaaatt

SEQ ID NO: 388 - DNA, 1662 bp, Glycine max
  Clone ID: PAT_MRT3847_73498C.1
gaccacttcctactacacaagaactagctataggcctcaattagttattatattaatttggtctaagtagttgttattacttgtgtagtagttcttctccaatggctgatttaggttcagcctcttccaagagaatgtggtgttccgttccagaaagaatgcagcttcacttggccatgttggccttgcagtttggctatgctggattccatgttgtctcaagagctgcacttaacatgggcgttagcaagcttgttttcccagtctatcggaacatcattgccttgcttctgctccttccctttgcctacttcttggaaaagaaggataggccagccatgactttaaacttcgtctgccagttctttcttctggcacttgtcgggattacagcaaaccaaggtttctacttgctagggttggagaacacatcccctaccttcgcatcagcaatacagaactcagtcccagccattacatttctcatggcagccatattaagaatagagcaagtgagattgaaccgaaaagatgggttgggtaaggtggcgggaacagtgctatgtgtggttggagccaccgtgatcacactatacaaaggtccaacaatatatagcccaacaactggtgtgaacataaacaacacaagagtgacacaagtgtttgaattggggtcagtgtcactgggagatgcaaaggggaagaactggaccctagggtgcttatacctcattggacactgcttgtcgtggtctggttggcttgtgttgcaagcaccggttctcaagaagtacccggctcgcctctctgtcacttcctacacctgtttctttggactcttgcagtttctcgtcattgctttgctccttgaaagagacgcgcaggcatggcttttccactctggtggagaagctttcactattttatacgcgggagtggtggcatctggaattgccttcgctgtacaaatatggtgcattgacagaggtggtcctgtgtttgttgccgtctatcaacctgttcagacttttgttgtcgccatcatggcttccattgctttaggagaagagttttacttgggcgggatcattggtgccgtgttgattgtagcgggactgtaccttgtcttgtggggtaagagtgaagagaggaagtttgcaagggagcagcttgcgattgcatccactgagcatagcatcataaggcccgcaagccacgccaaagcatcacttgctcagccactcctttcttcatcaacagagaatgtttgaacaagatcaaaattccaacttcaaaccacacaccatttttttggtgagaagaagtaaaagaaaaaaggggaaaaaagataccagctataccttactagttactactgctactactacattatgtcagcaagtttgtgtgtgttggaaccggttttcatcttttcctttctttttttttttatttaattcaaatgcttttttagtaggtcatttagaatatgagagaattgtgggaatggttgtaatggtggatgccactttaagtggggctagagcctgaaatccccccatatgcttttgtatgtcaattaatttatggtttgatttaagaaatgaatttttgttttttgggtcaaaaaaaaaaaaaaaaaaaaaaaaaaaaaaaaaaaaa

SEQ ID NO: 389 - DNA, 472 bp, Glycine max
  Clone ID: PAT_MRT3847_73499C.1
cacaaaaactatagttctaggcctccgtttggtctaagtagtagttgttacacacttcttcattcattctccaatggctgatttaggctcagccccttccaagagaatgtggtgttccgttcccgaaagaatgcagctgcacttggccatgcttgccttgcagtttggctatgctggattccatgtcatctcaagagctgcacttaacatgggcgttagcaagcttgttttccctgtctatcggaacatcattgctttgcttttgctccttccctttgcctacttcttggaaaagaaggagaggccagccatgactttaaacttcgtcggccagttctttcttctggcactcgtcgggattacagcaaaccaaggtttctacttgcttgggttggacaacacatcccctaccttcgcatcagcaatacagaactctgtgccagccattacattcctcatggcagtcatatta

SEQ ID NO: 390 - DNA, 196 bp, Glycine max
  Clone ID: PAT_MRT3847_73971C.1
cgtactaatttactactgaatattgggggctggggcaccagtgaaaagggattgggtaaaaagaaaacggcttatatacacataaattagaaataacaatttttatttttaggcccgcctttttcttattctgagaacagtttcttaattaattagctatcttgaattgggactaatgggcaggagccaccgaatt

SEQ ID NO: 391 - DNA, 2084 bp, Glycine max
  Clone ID: PAT_MRT3847_74475C.1
cgctgcaggccgcccaacacaacttccttgtgcagccaccattattgttgttattggagatttcaattctttgtctttcaaactcctcaagttgggtttatgtgatgatggctctcaacatctcttctccagctgaagtcaagtccatttttttcgctgattccttcaagtctaactgcctcacagcaaaattctcaggtgggtttgcttttaagagaaaagagcgtagagcagcatctggaggacgggtttattgctcagtgcaggcaacaccaccaccaccagcctggccgggacgagcggttccggaacaaggtcgcaagacttgggatggaccaaaacccatttcaattgtggggagtactggttcaattggaactcagacactagatattgtggcagagaatccagataagtttaaagttgtggcacttgcagctggttcaaatgttactcttcttgcagaccaggtaaaaagatttaagcctcaacttgttgctgttagaaatgagtccctaattgctgaacttgaagaggccttgcatgatgttgaagaaaaacctgagatcatccctggagagcagggaatcattgaggttgctcgtcacccagatgcagttagtgtagtcacaggaatagtaggctgtgcaggactgaagccaacagttgcagcgatagaagcagggaaagacatagctttggccaacaaagagacattgattgctggaggtccttttgttcttcctcttgctcagaagcataatgtaaaaatacttccagctgattcagaacattctgccatctttcagtgtatccaggggttgccagagggtgcacttaggagagttattttaactgcatctggaggtgctttcagggattggccagttgataaactgaaagatgttaaagttgctgatgcattaaaacatcctaactggaatatggggaaaaagataactgtggactctgctaccctttttaataagggtctagaagtaattgaaactgcatctggaggtgctttcaactatgatcatattgagattgtcattcatccacaatcaatcatacattcaatgattgaaacacaggattcatctgttcttgcacaattggggtggcctgatatgcgtttgccaatcctctatacattatcatggcctgacaggatttattgttctgaagtcacttggccacgccttgatctttgcaagcttggttcacttacatttaaaactccagataatgtaaagtatccatccatgaatcttgcattttctgctggccgtgctggaggcacaatgacaggagttcttagtgcagcaaatgaaaaagctgtagagatgtttattgatgaaaagattagctatttggatatattcaaagttgtggagctaacatgtgagaagcatcaaaatgaattggtatcctctccttcccttgaggaaattattcactatgacctgtgggcgcgaaaatatgctgctagtctgcaagactcttccagcttcactcctattcttgcatgaggatgattaaactagggatgtggctgatgcttcccaattgcctgctttcaccataatttcttcgggcattgaacaatgtagaatggtgcattccacagatgttgaaaattaaataggttttttgtttatggaatgttggtgttttaacacctttcaattgatcttatagttttgtcgtaatttcatggaaaacgatgtctttttaatagtcaataggagcctaggaggttggttggttgcctatgaatgtgtcaaagtcaagaaggggaatggattttctcatattcaaaatttacatgatgtggtcaactagaagttttgtatttctctttttctaatagaattaaataggtggagtcttacaaaaattaacagagatagacacaaaagttgaccaatcaccaatcactttcataaaaggattccttttctttttcctcagcacacattcgttggctgatattattatatgaaattggtattatttggatatcatagctattacccttggagaaaagaattattgactctgcttgacggttttgcttttct

SEQ ID NO: 392 - DNA, 344 bp, Glycine max
  Clone ID: PAT_MRT3847_74488C.1
agcaaatcaccaattcctccgagttcgagcgaccatgtcggggcgtggcaagggcgggaagggtctgggctaaggcggcgccaagcgtcaccgcaaggttctccgcgacaacatccagggcatcacgaagccggcgatccggaggctggcgaggatgggtggcgtgaagcgcatctcggggctcatctacgaggagacccgcggcgtgcttaggatcttcctcgacaacgtcatccgcgacgccgtaacctacacggagcacgcccgccgcaagaccgtcaccgccatggacgtcgtctacgccctcaagcgccaaaggggcaccctctacggattcggcggct

SEQ ID NO: 393 - DNA, 298 bp, Glycine max
  UNSURE (1)..(298): unsure at all n locations
  Clone ID: PAT_MRT3847_74583C.1
  unsure (1)..(298): unsure at all n locations
cacacacaantactanaagtgcttccttacaatcagaaccaacaacnactatggcaagttatcaaaagcactactatgatcngggttcgcaanggttgangagtatggcaacgttgagaagcaaaccgacgaatacggcaaccctgttcatgctgctngtgtcacctatgtagccaccagaactgctgctggtggttacagttntgacnttaanangcaacgtgatnccaccaatgcctacgncgtaganactggnagacagcattctagtggnggtacgatggtgacactaataaac

SEQ ID NO: 394 - DNA, 674 bp, Glycine max
  UNSURE (1)..(674): unsure at all n locations
  Clone ID: PAT_MRT3847_75107C.1
  unsure (1)..(674): unsure at all n locations
cccacgcgtccgcccacgcgtccgacggctgcgagaagacgacagaagggggaaaagaggcgagggtagctcatgacatgttccttgaaggaaaaaaaacgcagttgaaagattgaagctcgagatgtcggggaaaggcgcaaagggtttgataactgctaagaacccttcttcctctaaggacaaagacaagaaaaaacccatttctcgctcctcaagagccggtcttcagttccctgttggacgcattcatcgtcttctgaagtcaagggtgacagcacatggaagagttggggcaacagctgcagtttattctgctgccatcctggagtatttaactgcagaggtgttggagttggccggcaatgcgagcaaagatctgaaggtgaagcgtattacccctagacatctacagctcgccatccggggagatgaagaacttgataccctcatcaaaggaacaatagctggtgggggtgttattcctcatatccacaagtcccttatcaacaagtcctcaaaggaatgaggagggtttatacattatttgaatcaagaaattgactgtaaatttggctatatcttttgatatggataatttgctccctgcattagtttggttgaactcaacttcaaaagaaatatgaaaatgtcttatttcttcatttgccnaa

SEQ ID NO: 395 - DNA, 397 bp, Glycine max
  Clone ID: PAT_MRT3847_75209C.1
cggactcgtgggccaacacctggctcaactcatgggctcactggctcaaggctgaccccagaaagtacctcaagatgaaggagaggcttgtcggcgtctctgaggagaccaccactgttgtcaagaggctataccaaatgcatgagaccggcgccctcctcttccctgccattaacgtcaacgattacgtcaccaagagcaagtttgacaacctgtatgggtgccgtcactcgctccctgatggtctgatgatggccactgacgttatgatcgccggtaaggatgctgcggtctgcggatacggagatgtactcacgggttgtgctgctgccctgaagcaatgctgagcccgtgtcattgagaccgagatcgaccccatctgtgccgttcaggctct

SEQ ID NO: 396 - DNA, 581 bp, Glycine max
  Clone ID: PAT_MRT3847_7526C.1
atcaccactggctacggcgcggctgtcatcaccgcaggacgcggcggagtcgagaagggatcgcaggttgccattttcggcgccggctgtgttggtctttccgtcatccagggagctgtcaagcagggcgcttccaagatcatcgtggtcgatgtcaacgactcgaagaaggagtgggccaagaagttcggtgccactgacttcgtgaacccagccaaggatctgaaggagggcgagaacatccagagcagactgatcgacatgaccgacggaggatgcgactacactttcgactgcacaggcaacgtccacgtcatgcgatctgctctcgaggcctgccacaagggctggggagagagcatcatcatcggtgttgctgctgctggccaggagatttccaccagacctttccaactcgtcaccggtcgtgtatggaagggttgtgctttcggcggtgtcaagggccgcagccagatgggcagcctcgtgcaagactacatggacaacaagctcaaggtcgacgagttcatcacgcatcgacagccgttgagcggcatcaacgatgctttccacgacatgca

SEQ ID NO: 397 - DNA, 822 bp, Glycine max
  Clone ID: PAT_MRT3847_75496C.1
ccacgcgtccgtctctgcttcggctcataattgggggtggtatgcacaagtttctcatgtcacttgaatccggccatagtagctgtccacaatgttttctcgcagatcaagtggaagagtggctagtggtagagttgcattagaaaatggagtcccattaccactgttgcctgatcctaaagcaaatttacaatgggatgaggttaaaccactttcaggaaaaccatactggcatagtgttctttcgcctacaaatcttcaaccccgttataacttgatgccggggatgaacttgcggtcaaaacttccttctaatgaggtccctactattctcatctatgggggcaagagctgggacatggtgtattatggacaaagcaaacagaaggcttttggtgtcacaggctggaaaaaatttgttattgataattgtttgagggttggagatgcttgcatttttgagctcatggaaagcagtgacaagaaagtcatacttgaagttcaaattcttagaggtgacatcccatctgaatggcttggaaatgaaatgatcataggtcaagggaatgaaatgatcataggtcaagagaatgaaatgatcataggtcacagtcgggaaaatccaattgtccttaactagtattctaaccatttatgtatttcattttccttttcattctgcgatggttcagggttattggataactttagtatgttagtatatggatgttgtccctgcctcaacttgttaggagtagtgaatttacgtgctatgttgaatgtctaaattctaaataccagttgaattttattattgtcatc

SEQ ID NO: 398 - DNA, 487 bp, Glycine max
  UNSURE (1)..(487): unsure at all n locations
  Clone ID: PAT_MRT3847_75960C.1
  unsure (1)..(487): unsure at all n locations
gaatagaggaaaacatgtaaaaacctttagggagataaaactaatgacatcaagacctcgattgagagacttgtcactttgatactatatgagagaccattcgtccatgcttgacaaacagcagcgttacaagaacatcatctcaacctagtctgcatattcacgggcttatctacacgcttattcaaaagacactcgatgatgccggcgccagacctgcggcctgggcgcatctccgcgtcctccggcccgccttttactcctagtccatgccgtcctcgtcctcctccatgatcctcatcttcttgacggcctgcgcagcgtcgttcctggtggagctgttggggacctggatcaagatgtccgacttgatccccgtctaagcgttcaccagaccgccgctccggtccaccctgtanaccatctcgtccttgccgggcgcggcgtgaatgtaaaccgtgcagttctcgtagatctcctcctggat

SEQ ID NO: 399 - DNA, 4044 bp, Glycine max
  Clone ID: PAT_MRT3847_76010C.1
ggctcgagattcgtcattcatcttccatcatccatccactttcctcaatcttccattccagatctctcaccttcttcttcttcctctgtgccacccttttgttccatgattgttttttgtgtctgtatcagcttgatctttttttttttgttttccttgttgtaaaaacatttcaatctccaaggtatgtactgggttcttgtttgaattgttcttccatcttttcatgccacaaagtatttgaatttttagattgtctgattcagttatggctcgagtacgaaatgatagtatcaaggagatattcacatgacagttattgaggaaaagaagatcgcaactcaattaatgtgatttggacacgtgcaaagaagtccactcgcattggggaggagaggttgtggtaaaggatctaaaaggacattggacaaaattattaagggagcaacacccactccttcttcctatatttcataactctcatcattcattcattcattcgtcattcatcttccatcatccatccactttcctcaatcttccattccagatctctcaccttcttcttcttcctctgtgccacccttttgttccatgattgttttttgtgtctgtatcagcttgatctttttgtttttttccttgttgtaaaaacatttcaatctgcaagataattattggcagcttcactaatatcttttaagactacatactttagctaggcaatcacatttcttgggataatgttgggaggcaacaacggaaattgcttgcttcctgttttcttggacgaaactcaatttcagcatcaaactaatgtgtcaaatcaattgcagttgtttggaaatttacaagctggatgtagtgttgacccagttaattactttggaaatgagcatatcagctccatgattcagcctaataaacgaagcaaggaaatggaagatatatcaaaacaaaggcttcagatttccttaaactacaatgttcatcaagatgatgccgaacgattagcaagtattccaaatcctaaccccgtgtcaacaggattgaggctttcatatgatgatgatgagcgtaactcatctgttacttctgcaagtggaagcatggctgccacaccgtctatcatattgtctcttgggacatatcagaactgagcttgataggcagcaagagtgagtatgttaaacttcaacaactcaagggagtgaggtccacatgcgcttagcccaagtttttttttttttttttttaggtccccaatatattcgggtgcaatgaaagcatattctgtccagaactaaatacactggccttttgttctcgtgtcaatttctaaatccaccaccacaccctctcttctattctctattattattatctccacacccttcactctctctcactcttctctcgaatcttccaccgcaatggccaccgctgccgagaaactctccgctctcaaatccgccgtcgccggattgaacgaaatcagtgagaatgagaagaacggattcatcagcctcgtcggccgctatctcagtggcgaagcgcagcatgtggaatggagcaagatccagacgcctacggacgaagtggttgtgccttacgacactttggcgccaactcctgaaggttcttcggaggtgaagaatctattggacaagcttgtggtgttgaagctaaatggaggcttgggaacaactatgggttgcactggtcctaaatctgtaattgaagttcgtgatgggttgacatttctagatttaattgtcatccaaattgagaatctcaattccaaatatggaagcaatgttcctttgcttttgatgaattcattcaacactcatgatgacactcaaaagattgttgaaaaataccaaaactcaaatattgagattcatacttttaaccagagccagtatcctcgattggttgttgaggactttttgccattgccttccaaagggcatactgacaaggatggatggtaccctcctggccatggtgatgtcttcccatcattattgaacagtggcaaacttgatgcactattgtcacagggtaaagagtatgtgtttgttgccaattcggataacttgggagctatagttgacttgaaaatcttgaatcatttgatccagaacaagaatgaatactgtatggaggtgactcccaaaacattggctgatgtaaagggtggcactttgatttcttacgaaggaagggttcagctcctggaaattgcacaagtccccgatgaacatgtcaatgagttcaagtcaatagagaagttcaaaattttcaacacaaataatttgtgggtgaacttaaacgcagttaaaaggcttgttgaagctgatgctcttaagatggaaattattcccaatccaaaggaagttgacggaataaaagttcttcagctggaaactgcagctggtgctgcaataaggttctttgacaaggctattgggattaatgttcctcgatcacgattccttcctgtgaaggcaacttcagatttgcttcttgtccagtctgacctctacactttggaagacggatttgtcattcggaacaaagctagggaaaatcctgaaaacccttctattgaactgggaccagaatttaagaaggttagcaacttcttgggccgcttcaagtcaattcctagtatcgttgagcttgacagtctaaaagtggctggtgatgtatggtttggagctggtgttatcctcaaggggaaagtcagcattgtatcaaagcccggtgtaaagctggaagttcccgacggtgttgccattgtagacaaggaaattaatggcccagaggacctgtgaggaagacagatgactttaactaaagaatgaattgtatcagaccgtatcttatctatctatatggtctagtgtttttactactcccatgtttgataggtaaagaaaataagaagtctttttgttgagaggatgtcttggtgtggatctttactccattgtcttggaattctgtttagaacagcaaaaaaatgacaagtttggtgataagtttcatgtcatttggtacaggtgtccccctgtcgaacaaatcaaggcctagaaaaaagaagtgttctcacaaggagctgaacaggggaaggaagggtttggagacagtgaagttgatgatgatgcctcatatatagatcctaataacttcctgaacattctggctgcgcctataaactctactcccaagagctaccaagatatggagaatctgacttgtagagcatgcaaggtgaagacagtttcgatgttgttgatgccttgtaggcacctgtgcttgtgtaaggattgtgagggatttatcaatgtttgtcctatatgccaattgataaaaactgcaagtgttgaggtgcatctgtcttaacttacaaagaacgggatataagtcactgttttctttgtgatttatctgcctaatttcttaatgttcagctcaaaataattttctctataacaaaaatcgactatatctaaggatattattatgtcctctttctcagtgacttttacctgattattgatgatgacattcatattattactatcatgatgaaatagagaaattggggaatataatgagaagtatgaaatggaattgtgtgaattgttcttccttcttgtcatgccacaaagtttttgactttattggtagtggattgcgttgcagttttccatttcctcctctcgtgaccatcaaaacacatgtccctgaacatcaagatagctttttgttgacatgttctgttctgtatctcaccatttaattagttttattaatctgagtgaaatttttgagtgctttcatatttacaaatttatatatcacttaagaattaagatcttcatcttggtattatgcatacatgtaacctttgattactcattttgtcttggcgatgtcgtagatgcgatcaaattctaatgaacattcctcaaatatatttgggaaggctatggcttccatttcatgctatactgttcaaaaaaaaaatta

SEQ ID NO: 400 - DNA, 1512 bp, Glycine max
  Clone ID: PAT_MRT3847_76330C.1
atgaacagtaataatttttttcatcccaataaaaatatttttttaactttaaatgctgtatttttgtttcttcttttttcctgtttccgtagtttgggtctgtttttgcgttgcagacatcccacacacaacacattcacaacacaacatttgatttctctcttttgtcatcctcaaaatccacaatctttcctccttaatatctccgaccccaacaaaaagaaacaagcaagccatggattcccagatccatggcttgtcctcgtaaagtcaacccctttaccagaagaagatcaaatcgaagaaggcttaaaaaaaatgaagggttcgaacaaccggttcttcacggtggcgctggtggcggcgtggtactcctcaaacattggggtgcttctcctgaacaagtacttgctcagcaactacggcttcaagtacccaatcttcctcaccatgtgccacatgacggcgtgctccttgctcagttacgtcgccatagcgtggatgaaggtcgtgcctttgcagagcattcgatccagggtgcaattcttcaagatctctgctctcagcctcgttttctgcgtctccgtcgtgttcgggaacatttccttgcgctacctccccgtgtcgtttaaccaggctattggcgccaccacgcccttcttcaccgccgttttcgcttaccttatgaccttcaagagggaggcttggctcacttacctcacccttgttcctgttgttactggagtcatcattgccagtgggggggaaccgagtttccatctgtttggatttattatatgtgttgcggctacagctgcaagggctctgaaatcagtgctacaagggattttgctttcttctgaaggagagaagctgaattctatgaaccttctcctttacatgtctccaatggctgtggttttccttcttcctgcaacacttataatggaagagaatgtggttggcatcacgttggctcttgccagagatgattccaagatcatttggtatctgctgtttaattcagcacttgcatattttgtcaacctgaccaactttttggtcacgaaacataccagtgctctaacccttcaggtactaggaaatgctaaaggggcggtagcagtagtagtttctattctaatattcagaaacccagtgtcagtcactggaatgatgggttactcactcacagtctttggagttatactctacagtgaagccaaaaagagaagcaatgaaaggacaacctttagttataccctacaattacaacatttagttttcgttactgcacagtcaacctcaagatttctgaaggaaaatttgtttagcatgctagtgatcagaatccagagttttctgactataatatacattttttttacccacacgccagacctcattgaacgagtttctcgttgtattagcaatgatcgatgcagaaatagcccacagaacaaaattgctataaatgatgtctctctactttacctgtgttgggataattga

SEQ ID NO: 401 - DNA, 1757 bp, Glycine max
  UNSURE (1)..(1757): unsure at all n locations
  Clone ID: PAT_MRT3847_76332C.1
  unsure (1)..(1757): unsure at all n locations
tcggaatncggctcgagataaaacctaaacaataattaatagtagttgatcggctntaaatgctgtatttttgtttcttcttttttcctgtctccgtagtttgggtctgtttttgcgttgcagacatcccacacacaacacattcacaacacaacatttgatttctctcttttgtcatcctcaaaatccacaatctttcctccttaatatctccgaccccaacaaaaagaaacaagcaagccatggattcccagatccatggcttgtcctcgtaaagtcaacccctttaccagtcaaacttaaccccccttctctccccctctgaaaccgcaggaagaagatcaaatcgaagaaggcttaaaaaaaatgaagggttcgaacaaccggttcttcacggtggcgctggtggcggcgtggtactcctcaaacattggggtgcttctcctgaacaagtacttgctcagcaactacggcttcaagtacccaatcttcctcaccatgtgccacatgacggcgtgctccttgctcagttacgtcgccatagcgtggatgaaggtcgtgcctttgcagagcattcgatccagggtgcaattcttcaagatctctgctctcagcctcgttttctgcgtctccgtcgtgttcgggaacatttccttgcgctacctccccgtgtcgtttaaccaggctattggcgccaccacgcccttcttcaccgccgttttcgcttaccttatgaccttcaagagggaggcttggctcacttacctcacccttgttcctgttgttactggagtcatcattgccagtgggggggaaccgagtttccatctgtttggatttattatatgtgttgcggctacagctgcaagggctctgaaatcagtgctacaagggattttgctttcttctgaaggagagaagctgaattctatgaaccttctcctttacatgtctccaatggctgtggttttccttcttcctgcaacacttataatggaagagaatgtggttggcatcacgttggctcttgccagagatgattccaagatcatttggtatctgctgtttaattcagcacttgcatattttgtcaacctgaccaactttttggtcacgaaacataccagtgctctaacccttcaggtactaggaaatgctaaaggggcggtagcagtagtagtttctattctaatattcagaaacccagtgtcagtcactggaatgatgggttactcactcacagtctttggagttatactctacagtgaagccaaaaagagaagcaagtgatactataatgcatcatcattcatgctctcggctgcagtgaaaggacaacctttagttataccctacaattacaacatttagttttcgttactgcacagtcaacctcaagatttctgaaggaaaatttgtttagcatgctagtgatcagaatccagagttttctgactataatatacattttttttacccacacgccagacctcattgaacgagtttctcgttgtattagcaatgatcgatgcagaaatagcccacagaacaaaattgctataaatgatgtctctctactttacctgtgttgggataattgagtactttttgtcatttattcttggaggaaagagttgtaaaattggatatctacacatctattgttcaactctatttacattcgtttattaatgatagaattcatacttttgcccatcgtccatcaaaaaaaaaaaaggacggcccgcccgcagtag

SEQ ID NO: 402 - DNA, 1919 bp, Glycine max
  Clone ID: PAT_MRT3847_77498C.1
ctcgagccgtaaattctcaacagattacaatcggtgggaagaagagattgagaaatggcagaatcctattcttaaggatgagacactacctgaatggtacaaatttacattgtttaatgaactctactttcttgttgctggaggaacaatttggattgactctcctgtgctatcttcgaatatgcggaatgaccaggatcgagtaagggagttagaaagtgcagttgtgaaagaaactgaagataaaatgagcgaccgaaaaaggacagttgtggagagtacaacggatagtacctatgattctgctgttattacaggacatgatcgtgcagatgaaaaattgtatgaagatgatgatgatgttggaagattcttgtacttggaaggagtggaatatatcatgtggtgtacatatgatgtgcacttctatgcctcatttgcccttcttgagctctttcctaggattgaattaaatatacagcgtgactttgctagagctgtcttgtgtgaagatggaagaaaagtaaagtttctggcagagggaaactggggcattcgcaaggtttatggagcggtgccacatgatttggggacacatgatccatggcatgaaatgaatgcctataacatccatgatactagcaagtggaaggacctgaacccaaaatttgttcttcaggtgtatcgagattttgctaccacaggtgatttggaatttggagtggatgtgtggcctgctgtccgtgctgcaatggagtacatggaacaatttgatagagatggggatggtcttattgagaatgatgggttccctgatcaaacatacgatacatggacagtccatggtgtgagcacttactgtggttgtctttggcttgctgctctacaagctgcagctgcaatggcccttgatttaggtgacagagaatttgcggaaaaatgcaaacggaagtttttgaaggctaagccagcatttgaagaaaaactgtggaatggtacgtattttaactatgacagtggatcaagtggtaacagtaaatccattcaagctgatcaattggctgggcaaaggtggcatgcatcctcaggactgcccccactttttgaggattcaaaaatcaaaagtgctctccggaaggtttatgatttcaatgtaatgaaagttaaaggaggcagaatgggtgctgtaaatggcatgcatcccaacggtaaggtggacgagacctgtatgcagtctcgagaagtatggacaggtgtgacctatggtcttgctgctacaatgatacttgcgggaatggaagaagaggccttcgcaactgccgagggaatatttctagcaggctggtcagaagatggatatgggtactggtttcagacaccagaggcatggacaatggatgggcactacaggtcccttatgtatatgaggcccctagctatttggggcatgcaatatgcaataaatcggcccaaggcaattcttgaggcccctaaaataaatataatggacagaatccacttatctcctgttattggaggatactctcataatgaaacaggtgtgagaaagattacaacaaaagcaagatgctttaacaattctgtatttcattgtgcttgctgatagttaacaagtaagaacataaaatttttgtataggtaacttttttcccattgtttcttacccaaccctcacctagagaagctgttaataatggcggtcaaagtctggggaaaaatgttttagaaataagcagagttcgattgtaacttttaatttatatagccacttaataggttacccactctatggcctttgctgtaactgttgtactgtacattcttatttatttgagctctcaagatataatattaattagcacattccagcttttaaaaaataattaaattatttatag

SEQ ID NO: 403 - DNA, 2256 bp, Glycine max
  Clone ID: PAT_MRT3847_77871C.1
cgacgctctaaaaaactcgaaactctgaaaaaagtacaaaccgctgcgaacaatggcaacgatcaaggccgtgaaagctcgccagatcttcgacagccgtggaaatccaaccgttgaagttgacgttattctcagcgatggaaccttccacagagctgctgtccctagcggcgcttcaacaggtgtttatgaggctttggaattgagggatggaggctcagactacctcgggaaaggtgttcttaaggctgtggagaatgttaattcaattatagcacctgctctgcttggcaaggacccaaccaagcagactgaaattgacaattttatggtacagcagcttgatggaactgttaatgaatggggatggtgtaagcagaagcttggagctaatgctattttggcagtgtcacttgctgtctgtaaggctggtgctgcagtgaagaaaattcctctgtacaagcacattgctaatctggctggaaacaagactttggtactacctgtgccttcattcaatgttatcaatggaggctcacatgcaggaaataagctagcaatgcaggaatttatgattctccctgttggggcatcttccttcaaagaagccatgaaaatgggcgtagaagtataccatcatctaaaggctgtgattaaaaagaaatacggacaggatgctactaacgttggtgatgaaggtggctttgctcctaatatccaggaaaacaaagaaggtcttgaacttctgaagactgccattgctaaagctggttacactggaaaggttgtaattgggatggatgttgctgcttcagaattttacgataacaaggataaaacctatgacttgaattttaaggaagagaataatgatggatcacagaaaatctcaggagacagcttaaagaatgtgtacaaatcatatgtgacagattacacaattatgtccatggcgattccattattccaggatgactgggagcactatgcgaaattaacagctgaagttggccagcaagtgcagattgttggtgatgatctcctcgtcaccaacccgaagcgtgtggagaaagcaatcaaggagaaggcttgcaatgcccttctgttgaaggtgaatcaaattggtagtgtaactgaaagtattgaagctgtgagaatgtctaaacaagctggttggggtgtcatggctagccacaggagtggtgaaactgaggataccttcattgctgacctatcagttggattagcaactggccagatcaagactggagctccctgccgatttgaaaggcttgccaagtacaaccagcttttgaggattgaggaggaactgggttctgcggctgtctatgctggtgccaaattcagagccccagtggaaccctattgattgtttagcccaagatcattaagcaacatttgaataagattctattgatgactgcatggcgcatgtattttttgcgaaaattaaacttgactactatcaagagaacataggtttttcgagcgtggaattttgaagcgagaaaataggggcagtagccaataaatgtgtctatggtttggcttgttataacaattatcatgtgtagtacaaattttggatgaattacgtctaaattgattttcctgcaaattactaattgtgaaatcgaaggcctatgctgtcgatcatgtggtgatctaagctctgctcgttcctcctttgaagtttatgtttgtcatcaattgacgcctaacttatttgctttgaaagaaacggaaaagaaggtccaggagctcaagtttcagcgcaagtagcttaggcctcatgatggaataataaactttgctgcgcccccttccgggggaaaaggaaatattgtagtaacttgataaaactttgttccaatcttttcgttattgtaaatgtcaataaattggtttcctagttgcttcctaattatatgttgtagttatcccaaagataccaatagaatagtagatgtgaaaagtctgtacaaaaatatcatgttctttgaacagaaatgcttattcagagggatcagaatgaataaagcttgaaggggaagaaagaaatgaatgtgatcaattcacacgactcccttatattgcctttaagtgggttccacaactgtatttgtaatttgtcatgcgttacgttatgatggcccacaataataaccatttaccgtgtcagatgtacaaataattaataattccctctcattcgttcttaaaaaaaaaaaaaaa

SEQ ID NO: 404 - DNA, 470 bp, Glycine max
  Clone ID: PAT_MRT3847_78078C.1
gttaaaagctttttttttttttttggaacgggggcaaaacactttttaacaaattagtattaacttaaacaaaggcgggtttaaacttaacaggggtaaatattgggcccccacccgcacaacaaattactttttggtttggaaattacgctatcattgggcacttccggcaacataaggggaccggattactatggaaattttcttttctataaggcaacacaaaggggttggtatttattatttgggaagggaattggaagccgcattgtttctgtttcttttgggggggcgggggaagacccgtcatttttatagtctttggcttttccccaccccccagagtataaacccactgggattatgatgcccccaatgatgcttcccaaggggaggggtttttctagaagggaggggcccaaagttgtaacaatgatcatgcaaagaggattgaaagatgttacaaaccc

SEQ ID NO: 405 - DNA, 291 bp, Glycine max
  Clone ID: PAT_MRT3847_7831C.1
gaaaaaactactgtacaaaatcatactcctctagatcagatgctggttccagaatactcggaagcttttcctgctcaacatgccgcttcaaagacaccaggtgccatattatcttattctgaaagcggctatgccgaggtacatacttgatcaacggtgactgatcatgtcacgaacaaaacaatttctgagcaccttgattccaacaaatcaaagggtagatatccggttgaccgttcctcatgtggctccaacacggcctataactgggatgtggaaactgatgcgcta

SEQ ID NO: 406 - DNA, 2174 bp, Glycine max
  Clone ID: PAT_MRT3847_7877C.1
ttcccgccccacgcgttcctgtaccggcttgcgccgacagaccgaacagacatgggggctcgagcagactcatcgagccagctgcgtttgttccttcttcagttgggtttgattgcgagtgagtgacgatgggcgcgagcagcgaccctacccaagacggttccgacgagcagcagaagcgttcggagatctacacctacgaggccccctggcacatctacgccatgaactggagcgtccgccgcgacaagaagtaccgcctggccatcgcttccctcctggagcagtatccgaaccgcgtggagatcgtccagctcgacgactccaacggcgagatccgatccgatccctccctctccttcgagcatccctaccctcccaccaaatccatcttcatccccgacaaggactgccaccgccccgacctcctcgccacctcctccgacttcctccgcgtctggcacatctccgaatcctccgttgaactcaagtccctcctcaacggcaacaagaacagcgagtactgcggccccctcacctccttcgactggaacgaagccgagcccagaagaatcggcacctccagcatcgacaccacctgcaccatctgggacattgagaaggaaaccgtagacacgcaactcattgcgcacgataaagaggtctacgacatcgcctggggcggcgtcggagtcttcgcctccgtctccgccgacggctccgttagggttttcgatctccgcgacaaggagcactccactataatctacgagagctcggagcctgacacgcctctggtgcgtctcgggtggaacaagcaggacccgaggtacatggcaacgatcatcatggacagtgcgaaggtggtggtgttggatattcgttttcccacgctccctgtggtggagctgcagcggcaccaggcgagtgtgaacgcggttgcgtgggccccacatagctcgtgccatatatgcacggccggggatgattcgcaggcgctgatttgggacctttcttccatgggtcaacccgtggagggtgggcttgaccctattcttgcgtacactgccggagcggagattgagcagcttcagtggtcgtcttcgcagcctgattgggtcgctattgctttctccaccaagcttcagattcttagggtttgaaatttgatttctctgaaacttctgtttccctgtatgtgcaaacgaaaattggggatactttagatttgaaaacaaaacacagttgtattgttgtttctttttattgttgaaactaatgctaaccccttggtaatttctggctttgggacgaaagtagttttgattagggtttagggcgtaaaactagccttagtttgtttctgctaagttagtctgcaagtattttaaagaaattttccgtcacatcaatattggcttcaatgtcgaggtttttggattatctgtggctgcattgtgaaggattgaggcgaaactgcgactgatattttgcagtttcgccgcaattgcgggaaattgtggacaaatatggctttagagagtctaaaaccttgatattgttgtttgtcgcattcttgtttactaggaaatggaatgaccttgtatgtaaatgtttttgcttcggttttgtccatgtttcctatgtgactctttaactcaaagaaattcacttatgatgcaccacaactgtccacaagattcgtgttgtgtttgatgctgtctaaaaccttgatgttgtttggcgcattcttgtttgtcgcatttgttgcattcttgtttaataggaaatagcctttgtatgtaaatgttgtgacttttgtccatgtttccactgtgcctcattaactcaaagaaattcacttatgatgtgccacaagggttgtgttgtgtgtttgacattgactatttgtggtttggattttgatggtttttgcctgagctgtccggtgattgaatgttatggtgcagatccattgtggctgactccacctagtgggaaaaggtttggttcttgttggtgtttgttgcttaagctgttttgtgttggtttgtctggatgatggatgcacttgtgtgtgtgtgtggatgctctgatatcttaattgtttaatcttttggggggggggggctgattacgagaaagctgatccaagagtggtgtcattggagtac

SEQ ID NO: 407 - DNA, 1417 bp, Glycine max
  Clone ID: PAT_MRT3847_78923C.1
ccggctcgaggcacacccccacttcaccaatttagctcctttttcttaaaaatccttgctttctctgttgggtctgtttcatttcatcttctggttttggatcattcagcgccacacagacatacatggctcttgagtcagctcctgcttcagctgacatcagaggagttcacactcatggtggaggctatgttcagtataatatctatggaaacctctttgaggtctctaggaagtatgtccctcctattcgccctgtgggaagaggagcatatggaattgtttgtgctgctgtaaatgcagagacgcatgaagaagttgccattaagaaggttggcaatgcatttgacaacagaatagatgccaaaaggaccctacgagaaattaaacttcttcggcacatggaacatgaaaatgtgatagcccttaaagacattattcgaccaccacaaaggtataacttcaatgacgtgtacattgtttatgagttaatggatactgatctgcatcaaataattcaatccaatcaacaattgactgatgatcattgtcggtattttctgtatcagttgttacgaggactcaaatatgtacactcagcaaatgttctgcaccgtgatctaaagcctagcaacttgctactgaatgccaactgtgatcttaagattgcagactttggtctcgctagaactacatctgagactgatttcatgactgagtatgtggttactcggtggtaccgagctccagagttacttcttaattgctcagaatatactgccgccattgatatttggtctgttggttgcatccttggtgaaatcataacaagacaacccctatttctggggaaagattatgttcatcagctcaggctgattacggagctcataggctcacctgatgacactagccttggatttctacgaagtgataatgctcgtagatatgtgagacagcttccacaatatccaaggcaacaatttgctgctagatttccaagtatgtctcctggtgctgttgatttgttagagaagatgcttgtctttgatccaaataggcgcatcacagttgaagaagctctgtgtcacccatacttggctcctcttcatgatattaatgaggaacctgcttgcgttagacctttcagttttgattttgagcaaccatctttcactgaagaagatatcaaggaactcatctggagagaatctgtgttattcaatcctgatccacctatttattgagatttggaatttactatcatatgtgcatagtgaaatactttttgactggattacaacactaccgaggagttgttagctctctacagaagtatttaacatattggatatactgagattcttttggtaaaaattatttgaaatttaatgaggttgtcttccatttgattatt

SEQ ID NO: 408 - DNA, 133 bp, Glycine max
  Clone ID: PAT_MRT3847_7958C.1
ggaattaggcccgaggtagctgaatgcattgataagattcgtgtaaaccctggaaattttgctgatagacgggctcaattatgaacattagagtacgcagaagcagactatcagaacgaacttgagccatatt

SEQ ID NO: 409 - DNA, 2117 bp, Glycine max
  Clone ID: PAT_MRT3847_79740C.1
cggaaggaggtaaggctgggtcgacccagatctagttgagctcaccaactcccgctcccatttccttatttatagacagagtctgattgtttcctcaccactccctccactctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgcccttggcgccgaggtccgctggtgctcctgcaacatcttctccacccaggaccacgccgccgccgctattgcccgcgacagtgccgccgtcttcgcctggaagggtgagaccctccaggagtactggtggtgcaccgagcgcgccctcgactggggccccggtggtggacccgacctcatcgtcgacgacggtggtgacgctacccttctcatccacgaaggcgtcaaggccgaggagctctatgagaagaccggcgaactccccgaccccaactccaccgacaacgccgagtttcagatcgtgcttaccatcatcagagatgggttgaagaccgatcccaccaggtaccgcaagatgaaggagcgtctcgttggggtttctgaggaaaccaccactggagttaagaggctctatcagatgcaggcgaatgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggatatggtgatgttggcaagggttgtgctgctgcaatgaagcaggctggtgctcgtgtcatcgtgaccgagattgatcccatctgtgcccttcaggctctcatggaaggccttcaggttctgaccttggaggatgttgtttctgaggctgatatctttgtcaccaccaccggtaacaaggacatcatcatggttgaccacatgaggaaaatgaagaacaatgccattgtttgcaacattggtcactttgacaatgagatcgacatgcttgggctggagaactaccccggcgtgaagcgcatcaccatcaagccccaaactgacagatgggtcttccctgagaccaacaccggtatcattgtcttggctgagggtcgattgatgaacttgggatgcgccactggacaccccagttttgtgatgtcctgctccttcaccaaccaggtcattgctcagcttgagttgtggaaggagaagagtaccggcaagtacgagaagaaggtttacgttttgcccaagcaccttgatgagaaggtggctgcacttcacctgggcaaacttggagctaagctgacccagcttagcaagtcccaggctgattacatcagtgtgcctgttgagggtccatacaagcctgctcattacaggtactaagtaattgagattatcaacggaaagtgagggaaagacaaaatcggttttatgaatcggattgattgtttaattttcctttttttgaatttttgttgttagacttttcagatttgaggtagaagaagtttagctttttttatttttaatttccgtagaatttctgttcgagtgggtgggacgggtaaggaggaagacatcctgttggtttctgtgatatgaaaccaatttgggttgaataagcatgttttgtttggggaatgtgtgtgcattttgcttttgctttattaaatactaaattatgtgtttctgtccaccttttcaatatatcaaaagaaaataagagaaaatgaaaaaattcctacatgtatccagtttcataacacatgtattgtgtattatttggtgcttctgcaatattttttaaaaaggctatcagggtaattaagtaattttattatgtaaacttttttttttttttatggaagttcagttgaaatcttctcttttttt

SEQ ID NO: 410 - DNA, 515 bp, Glycine max
  UNSURE (1)..(515): unsure at all n locations
  Clone ID: PAT_MRT3847_80400C.1
  unsure (1)..(515): unsure at all n locations
ccacgcgtccgagggcgcgccggccgtctccattgcccggcggatcctgcgatgcgagctggaccgagagggaggagcgagggagcgcgcgggtagagaaggcggggcggggggaggaaggaaggaaggagcgccggccggagcagacgtcccctcggggccctcggtcggatgagatcgacgatgaaggcgcagcacgccaacgggcgggggagcaggagccccttcctgacgtcctacgcgctcacgctcgccttcatcaccttcgtctccgtgctctactttaaggacttctcctccacgctgcaccgccccttcctccaccgcccccgccgncacgccgncccagacaaaagccaggcggggcgccgcgcggcggcggagcggctgccgttcgcggtgggcgcggcgccggcggggtgtgacgtcgggcgaggggagtgggtgtacgacgacgcggcgcggccgtggtaccaggaggaggagtgcccctacatccagccgcagctcacgtg

SEQ ID NO: 411 - DNA, 2309 bp, Glycine max
  Clone ID: PAT_MRT3847_8046C.1
gcccccaaaacagagcaaaacagaggatccactccaccactactcctaatggatcctccacccctctctgccgccactcaaaaaaaccatcccgaatcggtagagtccttttctccatgtttccgcgttgcggaaacgtggactgatgagactctaccggcggttcctggtgccaagctgcgcctcatgtgcagctacggtggccacattatgccacgccctcacgacaaatctctcagctacatcggtggcgacacgaggatcgtggtggtggaccgccactcgtcgttgaaagatctatgttcacggctttcccgaactatcctcaatggaagacccttcacactcaagtaccagcttcccaatgaagaccttgagagtcttatcactgtcaccactgatgaagaccttgacaacatggtggaagagtatgatcggataatggcaaaaggttcggcttcttcgcggctcagggtgttcctgttcttcaccaaacctgaggccacagtttcaatggggtcactccttgatgatgccaagtcggagacatggtttgttgatgcactcaacaactctggcatgatatcaagagtggtgtcagattctgctgccggggattcttttgttaaccttgatggtgttggtgttggtggtgttagtgctagtggttcaagcaacaacttggagtctttgcctgatgctaacaaggttaagaattttcctgaagtggtgcaagtgcaatcaacacctggttcgcctatgatggagaacagttcttcttctccttctttctctccttctctggttaatctgcctccaattcgggttcatgttgatgacaatggtagtaggcttcagcaagagaataaggttggtttggtggtggaggagcaatttgctcagatgacaattgcaagtggggtgaagccagatgatggattggtgaatgttgtttcttctgcagtggctgtgcctgtaattcctgcatctgtgactatggcatcagctggggtgattactactagtgataatgtgatgaatagagttgtttgtgaggatgacagatcagatcccgggtttcagaagccccctttaccattgcagcttgtgcagccaaggactagtggtggtgtgggtttgccttcacctgattcagttgcaagtgatagtagtattgcagctgcaaattctttctccaagactgtttactaccaagatcaagtccaagctgcactactagacaacaaaattgttgctatgccaaatgccaagagtgaaatatctgatcagatgattcaggtccaaggacaacttcaagattctggctacacattacccccacaattggatccaaacaagcaacatttccagcagcagaagccatttgtccatgccagcactcactacatccaccacccagcagccacaggtccagtgccagtttcatcatactacccagtttatgccccaccacaacctcaacaacttcaccctccaattggtcaacaacagtacccagtttatgtaatgccagttggacctacacaagtaacacaaccctacaacatggcattgcagcccaatatagctgatcctaatgtggtagcttcaagcaggtcattaatgccacaaagtattgttacctcagcagcatacaaagatggtactccacctatttaccccaccaagtcagttagctctactatggcatcaaattctggatatgctccaatacctaccaaccaatttcaaccacagtatgtgggtttgcatcagttccatcatccaccacagtccattgctgtggctccttctagtactactactaataataattatggttatgaatatggtggccatgtgcaagaccaagcttactacactcaacaaaccaccactgctccattgcttcctcagtaccaatccatgaccccagctgcagctgctgcagcactatcagatgcttcaaaatagtttcctgcagacaacattcagcagccaactagagcatcacaaccagtatgaatcaaaaagtggagaaaaatgaatgaatgagtttggtggaggcatgttggggaggggtggggtgaggggcaattagactttactttcattttttaaccatgaacatatgcaccctaatttctacagaaaaaaaaaaaaaaggaaataaggagtaaagcataggttatttcttttttatctataatgaaatgaatgacatgtaagatcatattctgcaaacttagctttttctggtcgtcacagtttactcagttgaataaagcaagttgttgccattagcttaa

SEQ ID NO: 412 - DNA, 268 bp, Glycine max
  UNSURE (1)..(268): unsure at all n locations
  Clone ID: PAT_MRT3847_80550C.1
  unsure (1)..(268): unsure at all n locations
gnttgattcanttcantgggttcagtaatgctcagtggnatgaaaagctnactctnagaancctaacngggaacggttaggtttcnatggttcggatttgcacggtaagaattgccaagagtgagtttcgctgntancactagtggtnaagttcnaactttagacgcatagtagtanccangtgtagtgtntcggcttccnggccaagntcgcgccaaggttcnttcagcaccacccgcggnctttggttccataggttttctcattg

SEQ ID NO: 413 - DNA, 151 bp, Glycine max
  Clone ID: PAT_MRT3847_80955C.1
cctatccgccgcatcttccgagagtaaagtgttgtaccttaaattgaatggtgattaccacaggtaccttgacgagttcacgactggagcagagaggaaagacgcagcagagagtactttgcttgcttacaaatctgctcacgatattgct

SEQ ID NO: 414 - DNA, 2260 bp, Glycine max
  Clone ID: PAT_MRT3847_81594C.1
gcagaactacaaaaaacgggcatcgtccgcagcctttgctcaaagggtccacggcttgaagggatcagcgctgcagctcgagccgggcacatagcatcggatctgatattggtctgaagatgggtgtggctgctgagtctgagtcaaatgacaacatcccgctgttactcacccaatctgcttaccctctcaaaaggacagggacggtgtggacagcagtggcacacatagtgacaggggtgataggatccggagtgctgtctctgccatggagcactgcacagcttgggtggcttgcaggccccttctccatccttctcattgcttccaccactctcttctcttcttttcttctatgcaacacttatcgccatccccatcccgaatacggtcccaacagaagtgcctcctaccttgatgttgttcatttgcatttaggaataagtaatggacggctcagtggccttcttgtcagtattagtttgtatggttttgcaattgccttcgtcattacaacagctatcagcttaagaacaatccaaaattcattttgttaccacaacaaagggcctgaagcagcatgtgagtctgtagatgcatattatatgctactttttggggctatccaaattgttctctcacagatacccaacttccataacatcaaatggctgtcggttgttgctgcaattatgtcctttacttattctttcataggaatggggctttccattgctcaaatcatagaaaaaggacatgctgagggtagcattggaggaatcagtacctctaatggagctgaaaagctatggctggtttctcaagcacttggtgacatatcattctcatatccgttctccacaattcttatggaaatacaggatactttgaaatcgcctccaccagaaaaccaaaccatgaagaaggcctcagtaatagcggtcagtgtcacaacattcttgtacctcagttgtggaggtgctggatatgctgcctttggtgataatacaccaggaaaccttttaacaggtttcgtatcctccaagtcttattggctagtgaactttgctaacgcttgtatagtggttcacctagttggttcatatcaggtgtatagccagccactttttggcactgtggagaattggttccgttttagattcccagatagtgaatttgtgaatcacacatatatcttgaaactcccgttgcttccagcctttgaacttaattttctcagcctgtctttccgaactgcttatgttgcatccacgccggtgatcgcaatgatatttccctacttcaatcagattttgggggttctgggtagcatcattttttggccgttgaccatatattttccagtggaaatatacttgagtcagtccagtactgtatcatggacgactaagtgggtactgcttcggactttcagcttttttggctttttgtttggattgttcactctcattggatgtattaaaggaatagtaactgaaaaaataagctgagaagctttgagacctctccaaggaattagactcagatagccttcttttttttctccacttttctcctttcaagacccacaaataatgaggatcatctgcaatgtcttttccacatattcactcaattactaacttggaaccattacataaagatcggacatctatctcagtaaattagacataaaacacgtatttgagatccgaactgtccgatctttattcaatggttacaaatgcactaactgtgtgagggcaaggaataggagactgcaccgaatccagttggacaataaacatgcagattctctcatattttcaataggaatagtgattctgtatttgttcacctgctgaaggtatccactgctgaaatgaatgagctcaacactcctacttcctcggttcttccactgttatacaaacaaattgaaagtggacattattattttccgtgggaaaattttcagttctatttgattattgtttgaagtcttatcgatactatttagattaagccaactttggtataaatataagttcctcacaagtgacctctcaatgttgttgaccttttacttcagtaactttgctgcaacccgatcttcgctttggataggattccctattgtaaaaaaatacagtatttaatgtagtaaatctatttacatccatgtctctgcatttccattcagggcataacaaaattggagaatttaaagaaacatgaagcattcgtgttttgattaccc

SEQ ID NO: 415 - DNA, 1658 bp, Glycine max
  Clone ID: PAT_MRT3847_81676C.1
gcacgcggtttcggtccggaattcggctcgaccgcaaacgcaactcagctttccttcgatccctgaatctggacgttactaaagcagcccagccatccacgcaccattttaaaagccaacacagaaagcacagaaccaccacatcgttgccttcctctaaacgataaatttttgggattctgaaactagtgatacattttcttgcatgaaggcagcgtattgaggaattcagttagtgtattggaagatctagttcaacatgtcttctgtaagcaagggtgataggaaggcttccattgatgcagcatcatggctgttcaatgtggtcacgtctgtgggaattattcttgtcaataaggccttgatggctacatatggttttagttttgctacaactttaactggtctccattttgccacgacaaccttgttgacactcattcttaaatcgttgggatatatccagacctctcatcttccattatctgatataatcaaatttgtcttgtttgcaaatttctccattgttgggatgaatgtgagtttaatgtggaactctgttggtttctatcagattgctaagctgagcatgattccagtatcttgcttcctggaggttgtcttggacaatgtacgatattcaagggacacaaagcttagtattgttttggttttgctcggcgttgctgtctgtacagtcactgatgtcagtgtcaatgcaaagggtttcatagctgctgtaatagcagtttggagcacagccctgcaacagtattacgtgcattttcttcagaggaagtattctattgggtcatttaacttgttgggccatactgcaccagcacaggcagcaagtttacttctagtaggcccctttatggactactggttgactggcaaacgagttgatgcctacggctatggtttgacatccacgttgttcatcattctgtcttgcactatcgcagtagggacaaacctcagccagttcatctgcattggtaggttcacggctgtaacgttccaagtccttggtcacatgaagactatcctggtcctgatcttaggattcattttctttggaaaagagggtctcaatctacatgttgttctaggcatgatcatcgcaatagcaggaatggtttggtatggcagtgcttcttccaagccaggggggaaagagcgtcgtagcttttccctccccaaaacacaagattatagttcactacctgtgtcctctgaaccagatacgaaggaatagaaaataatagaaactaattagagaaaaagtgatgaaacttctggtgaactgcatgaaaaaaatcaggtgcccattaggcgagctggttcattttctttataccaggagtgaattcccaattatttatagatcatggttatatcttttcttatgtgttaatgaattgtttgggaaagaaatgagaggaaacagcgttaagggatggaaaaatctacgttatgttcctttttttttatgacagaaaatgttactgttacttttatagtaaaagtttaattccatttttcccattagggttggttccgttgttaccttctactcatgacaactattagcatgtttggattacctagttatgaaatgttttactctataaaatacttttgaaagttttaat

SEQ ID NO: 416 - DNA, 1745 bp, Glycine max
  Clone ID: PAT_MRT3847_8188C.1
cccacgcgtccgattattgtcctcatagtgagtagaaggcagagagactagagcggggatagcaacccgggtcgacccacgtcgtccgacctggtcttactgtgtggtgactgtgctctgctctcatctcattcatattcatttcaatggcaactcaaggtcaagtcattacctgcaaagctgcggtggcctgggaacccacaagcccttaacctccaatcatttcaatggcaactcaaggtcaagtcattacctgcaaagctgcggtggcctgggaacccaacaagcccttaactgtccaagacgttcaggtggctccgcctcaggccggcgaggtccgtgtccaaatcctcttcaccgctctctgccacaccgatgcttacacttggggcggcaaggatcccgaaggtctcttcccctgtattcttggccatgaagctgcagggattgtggagagtgttggagaaggtgttactaatgttcagcctggggatcatgtcattccctgttatcaggctgagtgtggggagtgcaagacttgcaaatcagggaagacaaacctatgcggcaaggttcgttccgccactggagttggggtcatgctcaatgatgggaagagtcggttctcgattaatgggaagcctatttatcatttcatgggaacatccacttttagtcaatacactgttgttcatgatgttagtgtagctaagattgacccgaaggcacctctggagaaagtttgtcttcttggatgtggtgtttcaactggccttggagctgtctggaacactgcaaaagtggagtcagggtccattgttgctatttttggccttggaactgttgggcttgctgttgcagagggtgctaaaactgctggtgcatcccgggttattggcatagatattgacagcaagaagtttgatgtagcaaaaaactttggagtcactgagtttataaatccaaatgaacatgataaaccaatccagcaggtcataattgatcgcacagatggtggagttgattatagctttgagtgtattggaaatgtctccgtgatgagagctgcgttggaatgctgccacaagggctgggggacgtcagttattgtaggtgttgcagcatcagggcaggaaatatcaacccgtcctttccagttggtgagtggacgagtctggaaaggaacagcttttggtggcttcaagagcaggtcacaggtgccttggcttgtagacaagtacttgaagaaggaaatcaaggttgatgagtacattacccatactttgacactttcggagatcaacaaggcttttgatcttttgcatgaagggggatgccttcgctgtgtgctttctacacaagaatgaggtgatctgtgccagcctgcctggttttgtgaggaatggatgtgttgtgttgcttttccctcttgtagtggttgtagtttgaacttgaaataaatctcgagtggctatattttgtaagtaagatcattttggtctataatatggaattatggatgttatcttccgagtcttttggcaaacttgtgttcagaaagaaggtctttgcaattaatacttaaaagcatcccttttgagttatgactggtattcttccattttacctgtcaagaatcatcatcacctctccatcctttttgggtgccagacaccatagctgtttttacttttgatatgttacggtgctgtcaataagttccgaagccaggttgtgcgattttc

SEQ ID NO: 417 - DNA, 306 bp, Glycine max
  UNSURE (1)..(306): unsure at all n locations
  Clone ID: PAT_MRT3847_82083C.1
  unsure (1)..(306): unsure at all n locations
tttcacttcantgacncnaagggatcgtcgcaccctatnnttcccggcggttcanccatagcgancnatttctccgncgacncttgtcacctctctaatcactctctcncaatncntntgcaatttccaancccantcattccncacccaacgaaggaacgccagggaaacaatacgncanatnagcattgtcttaatgtnccttcnagnaattcgactantcnccanctccantatcctctctttggcggaactccantncacnttacgaaanatccacttnntattgcaagattgcaccctcca

SEQ ID NO: 418 - DNA, 1191 bp, Glycine max
  Clone ID: PAT_MRT3847_82249C.1
aggaaatgctgtttcattagatggatagaacccacaaattcaactggcttatcaccttcactattggtattactcctcggtggctcttcccagcgccatgaaaaattccaattaatgggtggtgctactagtttgttgaaagagcatcttttttcaacctcttgatttcatgagtcactattttgattgaacaagagatgagatttatgcccctttccagattaattttccgtctccctcgtcattatacacatgggcctttgcaatctcgtgccttacagactgattctgttcttaaagatcctcaggctaagccaataaagtacaaaattcctcaattctatgatccctatggccccagacctccaccctcagaaaaaatcgttcagcttgcagaacaaattgaagcactatcagaagaagaacgtggtcaaattatgcccactttgtcagaaagattaaagcttccaaagttgcagccaatttccacagatggcatggacatgggtacagaaggtggtggtgctgctggactgaaggttgaggagaaaaaggcagagaaaacagcttttgatgtgaagttggagaaatttgatgctgctgcaaagatcaaggtgattaaggaggtaagagcatttaccaacctaggattgaaagaggccaaagatcttgttgaaaaggttccagttgtgctaaaacaaggagtcacaaaagaggaggcaaatgaaataatagaaaaaataaaagctgctggaggagttgcagtcatggagtagaattttgattgttggttgagatcacaattcttcatttccaatatgtttttaagttgccatacgcgtggtgaatgactgttggaagaaaattataaaggcacgaagcagatttaagggttaataaccaattgttgaataatctatttgaatcaattttttcttagttgagttttctggttaattactgtatcacttagaactgctgtgttggtttgacatttgtaacactcgttttgcctatcctctgctcaaatattttcttccagagtgaaatatttctgggatcatagggaaaattactttatggaatttcttttagttatttgagattcctgtgcttgatatactaaacttggtggtcttctttggactggtgcctggtggacctcttatgaagtattgggccccctttttt

SEQ ID NO: 419 - DNA, 1347 bp, Glycine max
  Clone ID: PAT_MRT3847_82360C.1
aaaggataatagcttttgacctagctaatagcacacaataatgggaagatccccatgctgcgatgagaatggccttaagaaaggtccctggactcccgaagaagatcagaaactagtccaacacattcagaaacatggccatggaagttggagagccctccctaagttagctggtctcaatagatgtggaaaaagttgtaggctaaggtggactaactatttaaggcctgatatcaagagggggaagttttctcaagaagaggagcaaacaattctgcatctccattccatccttggaaacaaatggtcagcaatagcaacccaccttccaggcaggacagacaatgagataaagaatttctggaacactcacttaaagaaaaagctgattcagatgggctttgatccaatgactcaccagcctagaactgaccttgtttccaccttgccttatctgctagctttggccaacatgacagacctcatggaccatcagacattggatgaacatgctataaggttgcaagcagaggcagtccatctggcaaagcttcaataccttcattatctaatccgatcctcaaactccttgagcaccaacaagtcctatgaccaaagtgccaccaccaacatggaacctgcagctttcagtttgttgaactcaatctccaatgtgaaagagaatccagtcatgttgcaaccagctgatgatactcctgctgcctcattgtctcatggcattgttagctctcaaccactccaccacccaaacgtgctacctcatcaccttttagagccacaagtctctttcagctctcaatcatgtttgaatagtgagattggtcaaggtactaactttgcaatcataagtcaaggggatcacacgcttgatcttgactcttcctggattattccatctattactcctccaaatgcaatagggacctcagctaacaatccaggagatgccagcagcagcacttctagctatggaggaggaccctcttcttattggtccgaactactttttgaggaccccatcttgcatgagctatcttagtatttaatttgaaagaggtcccattatggtgtgtgcatgttatgccttgtttgcttcttgccacttaattaattagcccatatatatgctctagtataggtacatatagatatatatatgcccttttacatatatacgtattcacgtatcaatacatgttttgtacataactccgggacagtttcatcgagctagtttgaatgtcactatgacagtatcgttttcagcagttatatatctaaattttctttgctcaaataaaatttgtttttacgttttttattttt

SEQ ID NO: 420 - DNA, 1839 bp, Glycine max
  Clone ID: PAT_MRT3847_82686C.1
gaaaaaaggaaaccgtatagaaaaagcttctccaaagaatttgaaggagaaagattcattcatgttcattttttccttttccccttcgtccccatcaagtttctgattctctcttttcacttcctttctctttcttcattcttctttctcttttcaactattttctttacatttttttctttttctctcgcttttttcgcgttcactttctctactctgttttacgcattttatttattgttttgttagttaattttgcgattcgagtaattggtatgcttgtgttttctagaagacgatattttcacgacgattaagctgcgttttcgccggtgtcgttttaccgcaagatggtgtcgttttcggaaatatgcaaaaagggttgaagttctttcttcagcattgaatctttgattacataggttggtttctttagaactcgattcaatttcaaataattggtcctccctttttgtggaactcaattctattaggttagtggaaagagaaaaaaaaacatggttgaatcaattgctgcaacttcactccttggccaccgtccaatttgtggtggaaatttaaccagggatgtatctgttaaacgcaaatctttgaatactgttcggttcccaacaactgagtttcttggtggtggaaggattgtggtttctctggctttgcctaaatctgataagcaagataggtttgtgttttcatcaattaaggccttggctgtggagttaacaagagaagcacatgcttatagggaagagaaattgcccaacagggataccaagattgatcgtggatttgatcaaaggcctgattcgtggcctcctgcgaatagggcagataaaccgtcgcttcggaatccactactccgtcatgagaggatgggatgtggttggttgggtgctatatttgagtgggagggtgttctaattgaagacaaccctgatttagagaagcaggcttggctggcactctctcaggaagaaggcaaaccctctcctcctgcttttatcctcaagagaatagagggcatgaagaatgaacaggcgatttcagaagtgctgtgttggtctagggatccggcacagttgagaagaatggctaatagaaaggaagaaatctaccaatctttgcagggtgggatatataggttcttgtctggatccaaggagtttgttagtgttttgatgcattataagataccaatggcattggtttccacgcggcctaggaaggctcttgagtctgctataggggagattgggattgaggacactttcagtgttattgtagcagcagaggatgttcataggggaaagcctgatccagaaatgtttgtgtatgctgcacagcttttgaacttcatacctgagaggtgcattgtgtttggtaactccaatctaacagtggaggctgcacatgaagcgcggatgaagtgtgtggctgttgctagcaagcatcctgtatatgagcttggggctgcagacttggttgtcaggcgcctagatgagctttcagtggttgatttgaagaatcttgcagacattgaaatgactgaatttgggtctgtggagcctgagatggagctggaggtggaaaaagattatggctcatcatcagttgatgacaatttctggtaaatcctataaatgtacagttgattgaacctcatctgattgttgatgatattagttacaggttagttacttgtgtatatggtaatcagaataaatggggggaaaaaatgataagtggtatgcattgaacattgatgttactactaatgcattttctgttcatatacattcacgaatttttagatttgaa

SEQ ID NO: 421 - DNA, 2456 bp, Glycine max
  UNSURE (1)..(2456): unsure at all n locations
  Clone ID: PAT_MRT3847_83093C.1
  unsure (1)..(2456): unsure at all n locations
ccacgcgtccgtacggctgcgagaagacgacagaagggggagcggaagcatattcctaaaactttcttcaaaacagcgttgtgtcacgcacgccactgctcatccaacttcttcttcttcttcttcgctctctgtttctgcgtgtgcgcgaaaaaaaaaagcaaaaatgcattccagtcacttacttctcgaagaacccattcgcatggtttccatcctcgaaccatccaagcccaatttctttcccgcaatgacgaagatcgttggtaccctgggtcctaaatctcggtcggtcgaggttatttctgcttgtcttaaagctggaatgtcagtggctcgtttcgacttctcttgggatgaccctgaatatcatcaggaaactttggagaatctgaagaatgctatcaagactactaagaaactctgtgctgttatgctggacaccgttggtgcagagatgcaggttgttaacaaaagtgagaaagcgatctcgcttgaggccgatggtcaggttgttctgactcctgaccgaggacaagaagcatcgtcgcagatactgcctatcaactttgatggactggcaaagtcaatgaagaagggagacaccattttcattggtcaatacttgttcacaggaagtgaaactacttctgtatggctagaggtatctgaagtcaaagggcaagatgttgtttgtattataaagaacacagctacattggctgggtcattgttcactttgcatgcctctcaaattcatattgatttgcccactctcactgagaaagaccaggaggttataagctcctggggtgttaaaaacaaaattgattttctgtcattgtcatatactcgacacgccgaagatgttcgccaggctcgtgaatttctttcaaagttaggtgatctcagccaaactcaaatttttgcaaagattgaaaatgttgagggattgacccattttgatgagattctacaagaagctgatggtattatcctttcccgtgggaatttgggtattgatcttccaccagagaaggtttttttatttcaaaaatctgccctttacaagtgtaatatggctgggaaacctgctgttcttacacgtgttgtggatagcatgactgacaacttgagaccaactcgtgctgaagcaacagatgtcgccaatgctgttttagatggaagtgatgccattcttctgggtgctgagactttacgtgggttgtaccctattgagactatatctactgttggcagaatttgttcagaggctgagaaagttttcaatcaagacctttattttaaaaggacagtcaagtatgttggagaacccatgactcacttggaatctattgcatcctctgcggtacgagctgcaattaaggtgaaagcatctattataatttgttttacttcatctggaagggctgcaagattgatcgcaaagtataggccaacaatgccagtactatctgttgtgatcccccgacttaagacaaatcagctaaagtggagctttagtggagcttttgaggcaagacaatcacttattgtgagaggtctctttcctatgcttgcagatccacgacatcctgctgaatcaacaagtgcaacaaatgagtctattcttaaggttgcccttgatcatggaaaagcattgggagttattaagtcacatgaccgggtagttgtttgccagaaacttggtgatgcatctgtggttaagattattgagcttgaagattaaactattaaagcgcattcaaccaactacagttttagtgttatttatttatttttacaactttgcctagttatttaaagatgcaggtcgttctgccacaagtagaagttatctctacttggttttgatgaaacaaattttgatgcaaattattaatggctgtcaaacataaaatcaaggcaatgtgcccttgatgccaattttttgagtttaagattcatactagaacacagttcgaaaatgtgattattgaattggattaccaatctaatgaagctaatagcttgttatttcagacaaaaaaaaaatataagcatatttttattgtctggtctttgtggtctgcagcccgggggatccactagttctanagcggccgccaccgcggtggagctccagcttttgttccctttagtgagggttaatttcnagcttggcgtaatcatggtcatagctgtttcctgtgtgaaattgttatccgctcacaattccacacaacatacgagccggaagcntaaagtgtaaancctggggtgcctaatgagtgagctaactcacattaattgcgttgcgctcactgcccgctttccagtcgggaaacctgtcgtgccagctgcattaatgaatcggccaacgcncgggganaggcggtttgcgtattgggcgctcttcccgctttccttcgctcactgactcncttgcgcctcgg

SEQ ID NO: 422 - DNA, 3552 bp, Glycine max
  UNSURE (1)..(3552): unsure at all n locations
  Clone ID: PAT_MRT3847_83345C.1
  unsure (1)..(3552): unsure at all n locations
tcgagacggctgcgagaagacgacagaaggggacgatcgttaagtctcactctcaacaccttcgaaccctagcacagccccgtgccgtcaactgtcaaccaccctccgtccaccgcacgcgcacctcgccaccaacatccagcaactcgcaccagaacagcacctcccatcgttgacgcacaaagtagcaggccgtcgcactcgcgccctcccgtccacagtcgcagtcggaccagccaccagtgatgggaaagatgtgcaagaataagaaacaagctggtgggcatggacctccaagagagcaaactgatacacaggaacaagaaatggacataaggaagattatgaaagatgttgaaaattttagctactcacatatgtcatggaaagaacgcaaaaagattgaaaataggaatgttgtttctcttggtgggaaggtgaggactattgttgatgttctattttgcttgccatgtgctaatgcataaggatgctcaggaaacaaatttcttactgtttgtcattttcccatatttagccccaaaagaatcagagattacctttaagtgtggctcgactaatgatgaagaaacaactggagagttttctttcgcccgatttttagcaatgcaccatgtgtgtccttgtccttgtttctttgcagcagcactatccagtctttccagcgctgcttacccaatttttaacgtatttgagcttatgctctgaacgcttggggctaagcaagcataaaatccattatgtgggcctgtccactatcagatcttcataatgaaacctgtgccatcggaagattgcaggcaagttattatacgcacgtctccctttgagagatgggagttactacccctatactatatcttgtgcccctctatgtcgtaagatactgacctggagcagaaaatgcttcaggaccgtttgattcctggacaatttgggggaaagctcgtcgctagcatcaaaagatctgctgggaagcacaagccagggaacaggggtctgaaatcaagtgaaggtcattttataaatggcatactcaatgaaccatttgttaaattcagcaccatcaagagatcgtgaaactggaactaatatgtccaatgcatggaaagggaaaggtggtacggctgcgagagacgacagaaggggatcgcagaggcagagcataacaacacaagagtcgcatctcaagcttttgtctttctctacttttctgctttctttcttcttctgtgtatcgtatcgcgtattggttggttgaaaaacaaagagtgtgtgttgtgtggtgtggtttggtttttcacttttgttcatcgttttgcgagaagacacacacagagagagagatggctacgacgagggtggtggcggaacagaagccgaagacgaagattgtgtgcacgctgggccccgcatcgcgctctgtcccaatgatcgagaagcttctgcgggcgggcatgaacgtggctcgcttcaacttctcccatgggtcccacgagtaccaccaggaaaccctcgacaacctccgcgccgccatggagaacaccggtattctctgcgccgtcatgctcgacaccaaggggcctgagattcgaactgggtttctcaaggacagtaagcctatccaactgatacaaggtaatgaaataaccatttccactgactatgacctaaagggtgatgagaagacgatttgtatgagctacaaaaagctgcctgaggatgtgaagcccgggatggtcatactctgcgcggatggcaccatatcatttacagttttatcatgtgacaaacaagcaggtttggttcaatgccgatgtgagaactctgccactcttggtgagaggaagaatgttaatttgcctggagtgatagtggatctcccaactttgacagacaaagacaaggaagatatcttggcctggggagttccgaataaaattgacatgattgctctttcttttgttcgaaaaggttctgacctggtggaagtcaggaaagttctgggaaaacatgctaagaacattatgctcatgtctaaggttgaaaaccaagaaggggttgcaaattttgatgaaatccttgcaaattcagatgcatttatggtggcacgtggtgaccttggaatggaaattccaatagagaagatatttctcgcacagaaagtgatgatttacaagtgcaacatccaaggaaaaccagttgtcactgcaacccagatgttggagtcaatgatcaaatctcccaggccaaccagggccgaagctactgatgttgccaatgcagttctggatggcacagactgtgtgatgcttagtggtgaaaccgctgctggagcctatccagaccttgctgttcaaacaatggctaaaatatgcattgaagcagagagcacccttgactatggtgatgtgttcaaaaggattatggagcactcaccggtacccatgagcccattagagagtctagcttcttctgctgttagaacagccaactcggctagagcggctcttatcttggttttaactagaggagggagtactgcaaaattggtggctaaatacaggccagggatgccaattctttccgtggttgttcccgagcttaagaccgatacctttgactgggcatgcagtgatgaggcccctgcgagacatagccttatattccgcgggttggttcccgtgttgagtgcagcttctgctagagcttctcatgctgaaacaacagaagaagcaatagaattcgccatgcaacatgccaagtccaagggtctctgccacaacggggattcagtggtggcactgcatcgtgtgggcactgcatctatcatcaagatcttgactgtgaaatgatcacccccattacaaggaattcttctgctgtttttggcaaattttttggatggtgcaaaagaggtctcgttatacctcttcatatctacattggatgcaaacttcaatcaaaagcatttatcaggatgggttacctgtttttcacatatcttatattactggttttttttttttttgttacatttgccttatcattgtggcgagcagccacctgctttcatttgttaagattttgtatgaggcttttggtgaaccaaaaaactagccacttctggattttgaattctacggtctaaagttgttttaattgagaagtgtatgccttttcgtagcattggcaaaaaaaaaaaaaaaaaaaaaagaaaaatagtaacaagggtggtggtaaaaagcaccgttgagcacgtccttgtgaataacgtgttttaggaatattcaggagtcattttttaatatgtatgacctttataaatctagtatgacccttgggtaagcttttcattttgacagtgaaatggatagaatagaaaacaggacaattatgtcttgtgctttctggtaattatacaatattaaactttcatctgtcattttatgattatatattagtttataattattagaatgccctgtatttttagttcatacagaaattcttaaccttttgtcatnnggg

SEQ ID NO: 423 - DNA, 418 bp, Glycine max
  Clone ID: PAT_MRT3847_83406C.1
ccttgactctcgtcttattccatgctttttctccggcgattccgaggtcttctacctcatgaggaagggagatgacctcaggtaccttgcctagtttaagaccggggcccagcgtctggagggtgcggagagcactgtctttgcatacaaagccgcacaggacattgggaatgccgaactgcctcctactggtccaattatgcttggccttgctcttagcttttctgtattttactacgaaatccttaattctccggatcgtgcctgcaaccttgcaaaacaggcttgtgatgaagctattgctgaattggatacactgggagaggagtcatacagggatagcactgtgatcatgcaactccttcgtgataacctcacactttggacctctgacatggcagacgatggagcagatgaa

SEQ ID NO: 424 - DNA, 833 bp, Glycine max
  Clone ID: PAT_MRT3847_83528C.1
ccacgcgtccgcttcttcgtttcatctttaaatcgtttctttgttttactactttttgcattttttataggcaaattaattgttaggattgttagtttttttttttttagcagaggcgatccgaatcgtgactattttttgcattctacatgtttttgtctttaaaccttacccacatcttctttttgtagttgttttttttcttcttcttcttcttcttcttcttcttcaaattttcgtgctttcattttcagcctaattcttgtcaatataacgagaattgggtgtttgtggaaaaggaaaagaaaatgtttttcttgactaaggtctctacttggatatctgctgtacttctaaaaagaatggcatgctgttgcttcatggacttgggatgcccaggatgaaacctgtgggatttgtaggatggcctttgatggatgttgtcctgactgtaaacttcctggagatgactgcccattgatttggggtgtatgcaatcacgcatttcatttgcactgtatcctgaaatgggtgaattctcagacatcacaagcgcattgccccatgtgccgtcgggagtggcagtttaaaggatgagagcaaaattctcttttttttgaagtgtgatcacagagagcaacattataaattggtatggttaaattgaggacctttcttcttcgacttttccatgcatacaagatgtattttccttattagcaaatctgtatcttcattgtaacttgtaaggagatcgaaatcaaagtttctgtaaagtgcaagtttattttttccactaatgactaatgataatgtccttttcttttgttttc

SEQ ID NO: 425 - DNA, 622 bp, Glycine max
  Clone ID: PAT_MRT3847_83529C.1
tacggctgcgagaagacgacagaaggggggtctccactacgcattcggacaaaccctaacttctttttgctgttgttgggcaccaagatgaaagtgaacatcttgcaatggcatgctgttgcttcatggacttgggatgcccaggatgaaacctgtgggatttgtaggatggcctttgatggatgttgtcctgactgcaaacttcctggagatgactgcccactgatttggggtgtatgcaatcacgcatttcatctgcactgtatcctgaaatgggtgaattctcagacatcacaagcgcattgccccatgtgccgtagggagtggcagtttaaaggatgagagctcaggttttcattttctttttcgagtgtgaccagagagcaatgtaaattggtatggttaattcgaagatgtattgtttccttcatgttaaatctgtatcttcattgtaacttgtaaggagatcgaaatcaaagtttctgttaagtgcaagtttattttttccattaatgactaatgataatgtccttttcctttgttttccccaaaaaaaaaaaaaaaaaaaaaaccaaacgaaaaaaagatcattaagaaagccctaagaataacaataaaagat

SEQ ID NO: 426 - DNA, 1314 bp, Glycine max
  Clone ID: PAT_MRT3847_83932C.1
gagttaacgtagaaaagcttcgtctcttgtcttcgcttctttcaattccttctcctttctagctctctctcttcttatatttccacattccacgtgaaccttctagaactataatagacttatattccatggctccgccgctcgaacacaacggcgtttccaccagcggtgactctctgagatctattccgacgccgtttctcaccaaaaccttccaactcgtcgacgatcacaccatcgaccatgtgatttcgtggaacgattctggatcgtccttcatcgtctggaacaccaccgctttcgccaaggatttgcttcctaaatatttcaagcacaacaacttctccagcttcgttcgccaactcaacacttatggattcagaaaagttgtacctgaccgctgggagttctcgaacgagtatttccgaagagacgagaagcggctcctctgcgaaatacagcgacggaagatcctcccggcaacgccgccgacccgagcgactgcgaccgcggcggttctatctccgctgccgctatctacgattccgccggcgaagctgatcgtgtcgccgtcgaactcagcggaggagcaggtgatttcgtctaactcgtcgccggcggagctgttggatgagaacgaccggctgaggaaggagaacattctgttaacgaaggaattggaggagatgagatcgctctgcaacaatatattcaatctcatgtcgaattacgctaacgttcaagcggacggtggttccgcgggggtggcggcgcggtgcttcggcgaggatgcggtggaggagatgaatccgaagctgtttggggtggtgattggtacgaagcgagcgagagaagagaatgatacggttttgagtctgcatcagccgttccatgcggacgtgaaatccgaagcgttggatttcgcaagacgtggcgaaaataaaaaaacgccgtggctaaatcaatgtcatagagcaaatcagagagtgtgtaattgacacacgacgttgtaacagcagctaggaacacgttaggttaagctaggggcgtcgcagagaatcagagtcctgagcacggagacgcgcgtggcaaatgtacgtcgttaaccgtttgggactttttttcgtagaagcttctcagaagaaaacgatactttcgcgttcatttccttttgatgtttctattttttatttttttaagttaagggcatatattggacttggcatgtatatttgccttggaagggaaaaaaataattatttctctatcatattttgttttctttccaactgaataaataaataaaatacacag

SEQ ID NO: 427 - DNA, 516 bp, Glycine max
  Clone ID: PAT_MRT3847_84011C.1
ccacgcgtccgttttgagtagcagagtgggagcccttctctgccgcagctgaacatggagaagatacagatttccagttctcggtggatatgctaggagaatacagtgatgtagtgcgatcaccaaggttcaatggctcaggttccaaggtgtccagtttcagaagccctttgtctaagctcgtcgagagcgtcgacgagggcagtgacggccatgaagatcaaaacgagtctgatcgagtcttgtatgctggatggaatacatccagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagaggcactgcacgagagcgcaagggcagcagcaggtcaaaggatgaagcagcggctgggcactttatgcaagttttgagcagggc

SEQ ID NO: 428 - DNA, 160 bp, Glycine max
  Clone ID: PAT_MRT3847_84065C.1
gcaagagttcctggattacgtgcatgccgagattgatgaaacacttgcctccaaaggagcgtgtactaggtgagttgtaaagtagaggtgaagacaaaaatacatgtgtactagtatgtgatgaaagagctcaaatcttcctatccttggtggtgaaaaa

SEQ ID NO: 429 - DNA, 2231 bp, Glycine max
  Clone ID: PAT_MRT3847_85713C.1
gaatgcgggtggagggcatttttcagttgtaagaaagcattgcataagataagataagtaagaaacacttccattgggcagagcaaccagcaccatgaattatgagctgctacagatagttgcactgctgacagtgatagcatttggaggagcattaaggaaagcaacaggagcatgcggttcagatgacttggaaggtttgatgggcttcaagaatggcattcagatggatacatctggcaggttggcaaagtgggtgggtaggagctgctgcgaatgggaaggtgttgtgtgtgacaatgcaaccactagagtgacacagatcaatctcccaggtctcattgaaaaagacttgtttcaaacccaaatggttggccagctttctccttccataacactcctcacttcccttgaaatccttgatcttggtggcttagtaggcctcactggattggctcgagaaacaattggcttgcaaatgccaaacctccaaaagctttacctttatggcaacaatttaactggaccagtaccagaaagcattggtgacttgccaagactccaggaactggcactgcatgaaaataagatatctgggtcaatcccttctaccattggaagcttaaaaaagctcaaaagtttgctgctttactcaaaccaaatttcaggtacaatacccttctcacttgggaatttgaccaatttggtagaattggatgttcatgataatgccattatgggtcaagtacccaatagcataggtcagatgcaggctctggagaagcttgatctttcaagcaatatgcttagtggaagcataccttcttcactaaccaatttaactgccatttcagttttgtacatggacaccaactatcttgagggaaccatcccatttccctcaagatctggtgaaatgccttctctgggtttcttaagactccacaataaccacctgagtggaaatataccccccagttttggctacctagtttctcttaaaagagtttcattatcaaacaacaaaattgaaggagcattgccttcaagtttgggcaatttgcattctttgacagagctttacctaagtgacaactccttttctggccaaataccaaaatcaataggccaactctctcagctcataatgttgaacatttccagtaatttgattgaatggccattgcctcaagagatatcttcccttcaaaaccttcaaacccttgatctctctttcaaccctttgaacctctcttccattccaccctggctaacaagcatatcatcgctttcccgcatatcccttgctggctgtggcatcaagggccaaattccagactcattgcaaacaacacagagtccaatacaagaactggacttatcagggaaccttctcagtggatccataccatcatggataggatcactcagtcagctctacttgctaaacctctcaagcaattcacttgattcacacatacctgaatccctcacaaacttgcctgatcttggtgttcttgatcttcactcaaataagttaacaggctcgatagctggagtatttgacactgaacaaggtacactaacatacattgatctttctgataacaacttctcaagtggagttgaggcaattggtgtgggagagcagttaaacattcagtacctgaatttgtctcataaccttctgaagggtacattgccaagttctcttggaaaactgaattccattcacagcttggatttgagcttcaatgaattagcctccaacttgccagagatgctggcaaagttgaccttgttggagagactgaagctgcaaggcaatcacttcagtggtaaaataccaagtggatttctcaagttgaaaaagctgaaggaattggatttatcagataatgtgcttgaaggggaaattccagagggtaagcctctaactgactttcctgggagcacttattctggaaacaaaggtttgtgtgggaagcctcttaatccctgtaaagagtaaactttgagaattgtaagatatgattggaaacccgtgaaatcaattgagttttggctgcatatcattgtgaaatatttgcttctattttcgtggtgtaaaatcataaagtaggacattcactagtttcatttcactatggaaagtagagaatctcatgtgttccttaacctaaaaacttgcatccctctagaaatagaaacttgtgagttgtgacaacccc

SEQ ID NO: 430 - DNA, 2429 bp, Glycine max
  Clone ID: PAT_MRT3847_8643C.1
ttgtttattttttttggaatactctaacaaaccattacatttaatttaaatgtcatacaatgggaatatgggataatgtctgtccccacaaatgaaaagttttcttgtgtatttttcttggtgtaaaggatagaaaaactggcaagacagttcagtgcactaaccatggtccttgaatctaaaaaggatagaagtacaacaaggagttggagctttaggatattctgctgaaacatattctgatcctttcctcagtacatctcaacatatgattatccaagaatctgagatgagactgaaatgaaagaaacctacaacaagttcagtgaatctcagtatctccaatatgtttcatatcttgtgtccgctgcaacttgactctaacaaaccattacatttaatttaatttaaatgtcatacaatgggaatatgagatactgtctgtccccacaaattaaaagttttcttgtgaatttttcttgatgtaaaggataggaaaaactggcaagaacagttcaatgcactaaactatggaccttgaatctaaaaagaaggatagaagtacaacaaggagttggagctttaggatattctgctgaaacatattttgatcctttctttcctcagtacatctcaacaatatgattatccaagtatctgagatgagactaaaacgaaagaaaccttcaacaaactcagtgaatctcagtatctccaatacgttttcatatcttctgtgcgctgcaacttgccaagtagtggtcataaaatgtatatattagtcatcagatatttcactaaacatatatggttgcaggattgaacttcacagattctctccagatgagttccttgatgtcttcttcagtgaatgatggttgctcaaagtcaaaactgaaaggtctggtgcaaacaggttcctcattgatgtcatggagaggtgacatgtatgggtggctcaacgcctcgtcaactgtaatacgcctgtttggatcaaagatgagcatcttctctatcaagtcaaccgcaccaggagacatgttgggaaatctagcagaaaagttttgttttggatactgtggaagctgttttacatatctacgagcattatcacttcgtagaaatccaaggctggcatcatcgggcgaacctatcagctctgtgataagtctcagctgatgaacataatctttgccaggaaagagcggttgtcttgttatgatttcaccaagtatgcaaccaacagaccatatatcaatggctgcagtatattctgagcaattaagaagtaattcgggagctcggtaccatcgagtgaccacatactcagtcataaagtcagtttcagatgtagttctagcaagaccaaagtccgcaatcttaaggtcacaattggcattcaatagcaaattactaggctttagatcacggtgcaaaacatttgctgaatgtacatatttgagccctcgtaacaattgatacagaaaataccgacaatgatcatcagtcaattgctgattggaacgaattatttgatgcagatctgtgtccattaactcagaaacaaggtacacatcattgaagttttccttctgtggaggacgtataatatctttaatggacataatatttgcatgatccatgtgccgaagaagtttaatttcccgtaaggtccttttggcatctattctgttgtcaaatgcattgccaatcttcttaatggcaacttcctcacctgtctctgcatttacagcagcgcaaacaataccataagcacctctaccgacagggcgaataggagggacatactttctggaaacttcgaagagattgccatagatattgtactgaacatagcgtccaccatgagttggtactcctctgatgttgttgtgttcagctgactcaacagcagacatgtcttgtgtgtgtgtctatgacctcttcttttcttctcaactcaattcaacaccaacaccaacaccaaaaacaacttggaaggaagaagaaagatgagagacccaaaataaatagggtgattcagagtggaaaagaagcaaactttccgacacttgagtttggaggacaaagtgagagagagagagacggacgaatagccgcggcatgttgcactacgaagttagattgatcatttggagcgacagtacatctcaacaatatgattatccaagtatctgagatgagactaaaacgaaagaaaccttcaacaaactcagtgaatctcagtatctccaatacgttttcatatcttctgtgcgctgcaacttgccaagtagtggtcataaaatgtatatattagtcatcagatatttcactaaacatatacaacataaatacaaaatctcagtagcctggtggaacaggattgaacttcacagattctctccagatgagttccttgatgtctt

SEQ ID NO: 431 - DNA, 1982 bp, Glycine max
  Clone ID: PAT_MRT3847_86591C.1
ggaggcacaacagctactccagctcttttgcattgcttgtagcagaagctgctgttgcatcatagtaaaagaaagaaagcctccaagacaagatggttgagatggatggcgttggcagcaagtatcatcaacaaacacttaacgtctccatcgacattcatcaacaaggaatctctaagtgtttcgacgacgatggtcgccccaaacgaaccgggacggtgtggactgcaagtgcacacataataactgcagtgattgggtctggggtgctgtctctggcttgggctatagctcagcttggatggattgctggtcctattgtcatggttatcttttctgccatcacttactacacttccactcttctctctgattgttatcgcaccggtgatcctgtaactggcaagagaaactacacttacatggacgctattcagtctaactttggtggaaatggctttaaggtcaagctgtgtgggctagttcagtatattaaccttttcggagtggccattggttacactatagcggcttccactagcatgatggcaattgaaagatctaattgtttccacaagagtggagggaaagatccgtgccacattaacagcaacatgtacatgatttcatttggtatagtggaaattcttttctcacaaattccgggcttcgatcaactgtggtggctctccattgtagctgctgtcatgtccttcacatactccactattgggctaggccttggtattgggaaagttattgaaaatggaggagttggaggaagcctaaccgggataacaattggtaccgtgacccaaactgataaagtttggagaaccatgcaagctcttggtgacatagcctttgcttattcatactccctcatccttatagaaattcaggacacagtgaaatcccctccatcagagtcaaaaacaatgaagaaggctagtttcatcagtgttgcagtaactagcattttctacatgctttgtggttgctttggttatgctgcttttggagatgcaagccctggaaaccttctcactggttttggcttctacaacccatactggctccttgacatagctaatgctgccatagtgatccaccttgttggttcataccaagtttactgccagcccctcttcgccttcgtcgagaaacacgcggcgcaaatgttcccagatagtgattttctgaacaaagaaattgaaattccaatccctggtttccatccctacaggctcaacctcttcaggttggtttggaggacaatatatgtaatgttgagcactgtaatatcaatgctcctcccattcttcaatgacataggtggacttcttggagcatttggattttggccccttacagtgtatttcccagtggagatgtacattattcaaaagagaataccaaagtggagcacaaagtggatctgcctccaaatacttagcatgacttgccttttgatgactataggagctgcagctggctctattgctgggattgccattgatcttcgaacttacaagccattcaagaccaactattgattaaactatgattgccattgatagagatttcagaaaccaaatttcatttcttggtcatattcttatgaagccaaggatatatggtgatcttgtttgtttatggcctagcagccctgtgtgttccacttctttctactgtgtatctgttactctctagctcgttctgcaacctaattcaaaatggaagaaatgaagtaaaagcacataaatctagtgtaattataatcatattttcattttttcccttctgttttacttttatttaagaataaaatatgttttttttataccaatataggtctagttggtaaggaacaaattcatgttccaaaattatgagtttggttcccactatccatgtaggaatcttattaggagtcatttgtgttctttgaatgaaatctgtcctgaggtagtacattctcg

SEQ ID NO: 432 - DNA, 476 bp, Glycine max
  Clone ID: PAT_MRT3847_86809C.1
cggctcgagcaagcacacaataataatatctaccttaatgagcttctctgcaatttgcactgtggtaccaaccaacaccattcacaacatcacaccatgaggaacaacaagccacagttatggctttctctttctctcatcatcacatgcttctcgttccacacttcccttgctgctttgaccaccatctcagcaaaccaatctctctctggggatgaaactcttgtctcccaacatggaaacttcgaattgggtttcttcaacacaggtaacaactccaataaattctacataggcatgtggtacaaaaagatatctcaaagaacctatgtttgggtagcaaatagagaccaaccagtttctgataagaattctgccaagttaacaatattggagggtaatttagtgcttttagaccaatcccaaaatctagtttggtcaaccaatttgagttctcctagctcaggttctgctgt

SEQ ID NO: 433 - DNA, 1652 bp, Glycine max
  Clone ID: PAT_MRT3847_87205C.1
ggggtggtggtggttgggggtttttgggttgtgggggtttttttgttcacttattttttttctaacatgaataaaataataattttcctattaatctcagggttaggcctagaatatgccattttccttgcgtatacccatcataattctatctcctttgccctccttttctcttctataaaaactatgatgcttttaatttaactacacagtatacacaatgatccctccacatgatgctatatgtgttcacacaagagcaacctcttgagcttgttcttgctgcttctgaattcctgtgatgtgtccaacgtaaagatgagtcccacaagaatcagattctggaagcctttgtctttttccaccttcagacatgcttttcacaaactccacaaagagcctccaattgtctccctcaaatagaaagatttttcatttttctctttaaagagtttgaacatatgattggaacaaattaacaaacgaattcatgtgaaatacaacataagatcaattcgcgggaattaaccgcacagcacttattggatttctaacatgaaataaaacaatatttttcctaatgatctcagggtttggtctagaatacgccattttccttgcgtatacccatcataattctatctctttttctcttctataaaactatgatgcttttaacttaactagacagtatacacagtgacccctccacatgatgctatacttattcacacaagagcaacctcttgagcttgctcttgctgcttctgaattcctgtgatgtgtccaacataaagatgagtcccacaagaatcagattgaggaagcctttgtctctttccaccttcagacatgcatttcacaaactccacaaagtgcctccaattgtctccctcaaacaacctcctattcattctcagataagtgaatgcagccaatccagaaccagagttacttgttgacagaacttgagaaaatgcacctgcatcatatctctcaagtgcattctccccagcaagttctgctcctgctgttctggctgccatcttcacttgatgaaccaacccctcaggggaacaatgctcatgttgctctctgtccctcatttccatgcaggtgaagtttaacacaactccatgttttgccaccatttgtgctattggtaggtatccatcgcgaaaccgcgtgttgtagtagcctgcagttagttcagccgcgtgtgacctagtcttgtagtgccaatgaattccagctactttggcagatagtttcaccccacatgagttgaatatgcctttggctgatacaaggattttctcaccatgttcaacaagtttggtggagtaccagtcaaggaagaattgtccatattctgtgttccatgtaccttcccttttgaaaaatcctcaggaaattggttgtattggcctgagtcatgtggtccattttttccccactctttcttcccaatggcctcagttgatgcttccaaggaagctctcatatacttgtcatagcactgaaattctccaattccaggaaacctccatgttccattgctttctggataagatggatatctcagctccccacaaggacccatccccacttgaatttcaatgataacactgcccaaatagtctctgaatctg

SEQ ID NO: 434 - DNA, 1203 bp, Glycine max
  UNSURE (1)..(1203): unsure at all n locations
  Clone ID: PAT_MRT3847_87237C.1
  unsure (1)..(1203): unsure at all n locations
ccacgcgtccgcagaaattgcgaatggccacttcaccattatcacaactactactatctctgattctcctccagaattttcaccattcacattccttctccctctccgttgagaaccacaatgaagacgtcatagtttcatcacccaatgccacattcaccgcaggtttttaccccgtcggtgaaaacgctttctgcttcgcaatatggtacacccggccacctcgtaccgtcgtttggatggccaaccgggaccagccggtaaacggaaaacgctccacgctctcccttctcggaaccggtaacctcgaactaaccgatgccggtcagttcatcgtgtggtccacaaacaccgccaccccatcgaaacaaaacccccggttacatttgtacgacaccggcaacctcgtactaatagcaatcctcgacaactccgaagatcatgttttgtggcaaagcttcgattttccgacggacacgcttcttcctaaccaacctctgagcaagagcaccaacctcgtttcatcgagaagtgggaccaactattcctccgctcaccgtccgctcttcttcgacttcgagaatgttctgcgtctcatgtaccagggtcctcgagtttcgagtgtttactggccttacgcttggcttcagagcaataacttcggtaatgggaatggtagatccactttcaatgatagcagggttgttgtgctggacgatttcggcaaactggtttcttctgataacttcactttcactacaattgatagcggaacggtggtgcttcgacgaagattgaccctcgatcacgacggaaatgcgagggtgtatagcatcagagacggagaagataattggaaggtgacgggaatattccggccacagccttgttttattcacgggatttgtggacccaatagttattgcagtaataaaccaactactggaagaacgtgttcctgccttccaggatatagatgggttgatagtcaagactggtctcaaggttgtgaatcaagtttccagctttggtgcaacaacactgagaaagagtctcacttcctacgcttacctgaatttgattnttacggatacgactatggctattatccaaaccacacgtacgaacaatgtgtgaatctgtgcttggagttgtgcgaatgcaaagggtttcacacagcttctcagagaaaagtgactctac

SEQ ID NO: 435 - DNA, 263 bp, Glycine max
  Clone ID: PAT_MRT3847_87591C.1
ggatattgctcttgctgatctggctccaacccaccccatcaggctcgggcttgctctcaacttctcagtgttctactacgagatcctcaactctactgaccgtgcttgcaaccttgcaaagcaggcctttgatgaggcaatctccgagctagacagcctgggagaggagtcctacaaggacagcactctgatcatgcagctcctgcgtgacaacttgaccttatggacttccgacaccaacgaggaccgcggggatgagatca

SEQ ID NO: 436 - DNA, 666 bp, Glycine max
  Clone ID: PAT_MRT3847_8787C.1
gtacaccacgtcacaatccctaattccccaaaattttctctgaagaagaagcaacaatgtctggtcgcggaaagggaggcaagggtttgggaaagggtggagcgaagaggcatcgcaaggtgctccgcgacaacatccagggaatcacgaaacccgcgattcggaggctagccagaagaggcggcgtgaaaagaatcagcggcttgatctacgaggaaaccaggggtgtgctcaagatcttcctcgagaacgtcattcgcgacgccgtcacctacaccgagcacgctaggagaaagaccgtcacggccatggacgtcgtttacgcgctcaagaggcagggaagaaccctctacggtttcggaggctgagggcttgggctttttctgggcctggatttgttcttcgctgggctttaaaatgttgttgggaatttgtgttttgtttaatggttatgtatattatcttctgctcggtaatgcaagacttactcaagtttcttctattattctaatttctactaataattgcatcctagttagtgtgaatttgaagtaaatttagtgaatgacaaatggttatatgaatttcgtgtgttgaatactttctatttggattttcgttgtatgtgataattcggctactgtggattaagttgaagttcaagct

SEQ ID NO: 437 - DNA, 457 bp, Glycine max
  Clone ID: PAT_MRT3847_88032C.1
agcgtcttgtcatccgccttcaagcaaaatacgggaacaaatggaagaaaatcgctgcagaagtcccagggcgcactgctaagcggttaggcaagtggtgggaagtcttcaaagagaagcagcagagagagaaaaaggatgtcaatagaatctccgacccaattaacaatagtaagtacgagcacatacttgagagttttgcagagaaactagtgaaggaacgcccttcaccatcatttttaatggctgcttccaatggggcatttctgcacaccgatacaccagcacctgcatcatccttgcttccttcttggctttctaattctagtagtcctgccgctgatgggccaagttccctttcggtgacactaagtctttcttcctcaatggtgatcgcgcctccattttcatggttgccacccaagagaggaccagacaatgctccttttgttttggg

SEQ ID NO: 438 - DNA, 1592 bp, Glycine max
  Clone ID: PAT_MRT3847_88033C.1
ctcgagccgcccgtccccatatcctctctctcttccctgtcttgtctattctcattttctctctctgtctctttgctccatttcagtgctctgtcttctcccccaccaccgcactctctcagatattatcatttcatatcacacattcacatcctatcatcatcgacaacacgctatccccattgcttcttctcttctccctctctcgtttcctacttgacggcgccgtttcgttctccagaagatgcttctgagtacttcgcgctgcaactagacatgatgagttcaagtttcaagacatgggctgtgggatttgcacttggaaatgaaggagaggcaacgttggagagctgaagaggatgctttattacgttcttatgtcaaacagtatggtcctagggaatggaatcttgtgtctcagcgcatgaacacatatcttaacagggatgctaagtcgtgcttggagaggtggaagaactacctcaagcctggcatcaaaaaaggctctcttactgaagaagagcagcgccttgtcatccaccttcaagcaaaatatggaaacaaatggaagaaaatcgctgctgaagtcccagggcgcactgctaagcggttaggcaagtggtgggaagtcttcaaagagaagcagcagagagagaaaaaggagatcaatagaattgccgacccaattaacaatagtaagtacgagcacatactcgagagttttgcagagaaactagttaaggaacgcccttcaccatcatttgtcatggctgcttccgatggggcatttctgctcactgatacaccagcacctgcatcttccttgcgtccttcttggctttccaattctagtagtgctgcagccatcggcccaagttccctttctgtgaaactaagtctttcttcctcaacggtggccacacctccattttcatggttgccacccgagagaggaccagacaatgctccttttgttttggggaatgtatcagcgcttcatggagctattccaactctaagtgatagcatgcatatgtctcagatggtggagcactgtaaagagttggaagaggggcatcgtgctttggccacgcacaagaaggaggcagcttggaggttaagtcgggtggagttacagttggagtcagagaaggccaaccgaagaagggagaagattgaagaatttgaagcaaagattaaagctcttcaggaagaggagaaagctgctttaggtagaattgaagcagaatacagagaacagttagctgcattgaggagagatgctgaaaacaaggagcaaaagttggcagaacaatgggatgcaaagcatttacggtttactaggttactagagcaattaggatgcagagcagggctccttgagccaaatgcaagatgaagatatattttggcaaaatggatattggtgctcttctgactaaaattatatgcagtttgtgatcttggtatatttttattttagacgtgtatgaatttcctatctattcatacaacttgagtaacttccgttaacagttgaattacctgcatatggtatcacatccgagtttataaacttagttatattcctg

SEQ ID NO: 439 - DNA, 1638 bp, Glycine max
  Clone ID: PAT_MRT3847_8803C.1
ctcttgaatacaagtactatacgacgacagaagggggattcaattgaaattcgagtttcctttttaatcacctggtttttttttttaaatttgaaggagatccaatccaaatgcatcgaatgccaatcacctgaaattccgccagatctctccctcttacacgctcttgataaaccgaaacgaagcaatagctatagcatcacacacacacaccaccgctagggttagggttagggttgggggtgttccgaagtaacaacaatggcggtctccgacggcgtcgtgaagaaaatcgtcctctcctacacctacgtcgcgatatggatcttcctcagcttcacggtcatcgtgtacaacaagtacattctggatcgcaagatgtacaactggccctacccgatctcgctcaccatgatccacatggcgttctgctcctccctcgcgtacattctcgttcgcgtcttgaagctcgttgaaccggtttcgatgtcgcgtgatctctacctcaaatccgttgttccaatcggtgcactctattcactttccctctggttttccaattccgcgtatatatacctctctgtttcgttcattcagatgctcaaggcgcttatgcctgtcgcggtttattcaattggtgttattttcaaaaaagaggcctttaagaacgagaccatggcgaacatggtttccatctcgctcggtgtagcggttgcggcttacggcgaagccaaattcgatgcatggggtgttaccctgcagcttatggcggttgcgtttgaggcaacacggttggttctgattcaaattttgctcaattcgaaggggatttcgctgaaccctatcacctcgctttactacattgctccctgttgcttggtgttcttgtccgtgccttggattatcatggagtacccttcgttgagggacaactctagcttccatttggatttcgcgattttcggcacgaattcggcttgtgctttcgcgttgaacctcgcagttttcttgctggtgggaaagacttcggctttgacaatgaatgttgctggggtggtcaaggattggcttttgattgcgttctcttggtctgtgataaaggacactgtgaccccgattaacttgattggttacgggttggcgtttttgggggttgcgtattataatcattgcaagttgcaggctttgaaggcttcggaggcgcagaagaaggctctgcaggctgatgaagaggctgggaggttgttggagcagaaggatggagaagggactggaaggaagaacgacaaccagaactgattcaagtgctgatctcattatttggtcactctcttcgattaatgttggatgacgcaggttttgtttttggttttgttctgtaatgtactctgctattaggtaattattattatcgtcgtcgttattgttattatcgttataattatattattattatgatgttacatgttacttctcacagtttaattttcatacccatatttagttatgtattggaggctgagattgacttttgttccttatattactgattcgtgtttatgggtagctaatgaaattgcattatgatttttaataatttattaatgtcctgcaagtttatagtggaacagctaagtt

SEQ ID NO: 440 - DNA, 110 bp, Glycine max
  UNSURE (1)..(110): unsure at all n locations
  Clone ID: PAT_MRT3847_88136C.1
  unsure (1)..(110): unsure at all n locations
ttttatctatctccgcncctttnntgtngttccttctactcanttcgtngctttgngatctctctctgcaaccatgtccgtcgagaaagagagagagacccaggtntact

SEQ ID NO: 441 - DNA, 171 bp, Glycine max
  UNSURE (1)..(171): unsure at all n locations
  Clone ID: PAT_MRT3847_88256C.1
  unsure (1)..(171): unsure at all n locations
ctcnagaaaaccattgntggcactcccttcactccatctntgcnttagccaccacactgcacactctcctncgccaacaaccaaaccccagaaagttaacccctttcccttttnctcgaaccanaagacacgattttnaacgaaacaaacgcgacccagaagcagangaag

SEQ ID NO: 442 - DNA, 103 bp, Glycine max
  Clone ID: PAT_MRT3847_8838C.1
aatataaggaacaaaagacaatctcagcctccaatacataactaaatatgggtgtgaaaattaaactgcgggcagcaacctgttgcatcctaataataatata

SEQ ID NO: 443 - DNA, 121 bp, Glycine max
  Clone ID: PAT_MRT3847_88927C.1
gggtaattggggcctgctttacatcacatcacaattttttagcatctgattataatcaagggccccccacctgcattttaattttgcaacaaaagcaaaataagacggccccgggggcccc

SEQ ID NO: 444 - DNA, 117 bp, Glycine max
  Clone ID: PAT_MRT3847_89506C.1
ctacagggtccaacaggcaatcgcagctggcatcttacctttagcacctctgttgctccagcgatcatcaggcgtattcgaacagttacctttggtgcattgattggtacaaaacat

SEQ ID NO: 445 - DNA, 307 bp, Glycine max
  Clone ID: PAT_MRT3847_89565C.1
cccacgcgtccgcccacgcgtccggaaaaaaagcaactacatcagtccatggcaacccccaaccctaccagattctcccttgccatggagagaaccgggcaatgggttttctccccagaaatcccaaccgatgttattgttgcagttggagaatccactttttctctccataagtttattctggcggctaagagtaactacatcagaaaagtgataatggaatcagaagagagtgacctaacaagaatagagatttccaacataccttggaggacaagaagctttttaagaaagccgcgaaattttg

SEQ ID NO: 446 - DNA, 599 bp, Glycine max
  Clone ID: PAT_MRT3847_89776C.1
acttcccccactccgcatcttcaacgcgtctcatcgtcatctacacaacatcgcgacaacgcgtcacattcatctcttttcatcaagactttatcaccttaatctatcatcatgactggacgtggcaagggcggcaagggtctcggcaagggtggtgccaagcgccaccgaaagatcttgcgagacaacattcagggaatcaccaagcccgctatccgacgtctcgctcgtcgtggcggtgtcaagcgtatttctgctatgatctacgaggagacccgtggtgttctcaagaccttccttgagggtgtcatccgtgacgctgtcacctacactgagcacgccaagcgcaagactgtcacctccctcgacgtcgtctacgctctcaagcgacagggacgtactctctacggtttcggtggttaaacggttttctcccttgtttggtggctcgctcttgagaaggattattcagctgcgcttatacggcactgggatggatgtatttgactaaggcgttggggaaacggatatgatattaccatgggcgtcatggaagacgaccttgcaaatgaataccacattgaacattgaacacttgc

SEQ ID NO: 447 - DNA, 1250 bp, Glycine max
  Clone ID: PAT_MRT3847_89886C.1
cgccaccttaaatataacaaatacttgtctggtaaatgtaagttttatcctcctatcctcttcacaacacttgacaaagtgatgatgagaacaccaataagcagtgatgaaagtggtttgaagaaggggccatggagcccagaagaggacaaaatattagtggatttcattgagaaacatggtcatggaagttggagagcccttccaaggcttgcaggcttaaacaggtgtggaaagagttgcagactgaggtggactaattacctcaggcctgacatcaaacgcggaaaattctctgatgaagaagagcaactaatcatcaatttacattcagttctcgggaataagtgggcggctatagcatctcatctgccagggaggactgataatgaaataaagaatttgtggaacacgcatttaaagaagaagctaatgcaaatggggttagacccagtgactcaccgtccaagaactcatcacctaaaccttcttagcaacctacaacagatattggctctaattaggttacagtcagatgctaataaactccaattattgcaaaacatatttgaagcctcaaactcagacccactgccagattcttcttattctttgctaaatgatgttttgggggggttgaataatcttcactccaatgatctccataacctttatgatggtaattcactttctgtccaaaactttgatcagaacttgaatggtggcagaaacgctgagccttcaccgtcatcaaactcgcttccaaatctggtttcagcctcacctgatcgttccccagttgttaaggaagcacaaaacatattggtaaactcgaaggacttttccacctccgcttttgagttaacgtggggagatttcatggatgaagaagaaacaaaccagacttattggaaaggttttatggaccaacattctaaccagacatggtcgactttcccatgatcacggaatttgagagctatcacagcaataacgggatttattcgctgttctatctataataaaaaaaaaatatactgttcatttagttatatataatggttggtttaatttgtatgtattatttgacgatggattgatttcagatccaaatatagaaagctcttgtattgtatattaaatgtacaacgtggaaattaaatcaatcatagaatagaggcctatgatgttctttttctttgtataaactatactataaaataaaatgctgtttgtaggctttccttctt

SEQ ID NO: 448 - DNA, 528 bp, Glycine max
  Clone ID: PAT_MRT3847_9026C.1
gccgtgacttttgtagcagctggtctttcttcaggaaaaattggttccatagcatatgcttgttccattcactgtattgggagccactttgatggataagtctggaagaagaccacttataacggcttcagcaagtgggacatttttaggctgctttatcactggagttgctttctttctcaaggatcagagctgattgcttgattgggtaccaatattagcagttgctggcgtgctgatctacgtaggggcgttttcaattggaatgggaccggttccttggataataatctctgagatctttcccatacacgtcaagggaactgcaggaagcttggtggttttggtgaattggctaggatcttgggtagtttcatatactttcaactttctaatgagttggagctctcctggtactttatttttgtatgctggatgttctcttttgactattcttttcgtagcacagttagtcccagaaaccaaaggaaaaacactggacgaagtcaagcatgcatcaattcatag

SEQ ID NO: 449 - DNA, 466 bp, Glycine max
  Clone ID: PAT_MRT3847_90691C.1
ggctcgaggatgatgatcgatatctagctgaatttaaggcatgcaatgacactaatgaagctgctgatcactctatcagagcatatgaatctgctgcccttgcagtacatgctgatacacctcccacacatcccatgcgactgggagtagctggaaacaactctgaacgctattatgagatcctgaactcccctcggagagcctgtcatcttgctaagcaggcttttcatgaatctatttctgagcttgacaccttgcatgaggagtcatgctaagattgcaccttaagcatgcaccttctgagggacaacctaactgtgtggacttctggcatcccagaagatggagaagatgcccctaaagtgaatggcactggcaagcttggtagaggtgaggatgcaccgtgagccctatggatgatggaatgtatcctatgagtcgagcatgcgatggagaatgaaacatg

SEQ ID NO: 450 - DNA, 269 bp, Glycine max
  Clone ID: PAT_MRT3847_91167C.1
tccatagacgatggctaatttgaacttgctggacactctacagcaagtggtacatcatcattatccaagctaaaggttagagcgtgaatctgtagcatgtgggaaagggcttgagccatatcaaagatgcatatctgatgtgacagctactgatagagatgagcaatgtatacatcgtttcttgtagcttatacctcactggattcttgcttgaaaaagtgttcactttgagatgattagctgtaatggatgccttggttgctgctgga

SEQ ID NO: 451 - DNA, 315 bp, Glycine max
  Clone ID: PAT_MRT3847_91658C.1
tacggctgcgagaagacgacagaaggggataaaaggagatccaaagtaaagaacacagatgggatgacaccacgaaaccaaatgaaaaactgcgccttctatggctatgttagttcttttaactttatatactctatctgtgtatatatctctactctaattattgcttctcttcttaacgacaatggaggacccatcaacagaaacaacgttggtgctgaacagcgaatattctaggctgttcgacgaggacacggacatatacaatacgcattgtggagggaaccctattgccgaactttgtgtggagcccac

SEQ ID NO: 452 - DNA, 1117 bp, Glycine max
  Clone ID: PAT_MRT3847_91852C.1
tgcaaacgcattgaatgttaacagcttaaggatgctattgcataggtcatctacacctcaatcatctaatgcaattcaacgaatccaaagctcagatattgaatattcacattttactcggtcattggtaaggaaagtcctagaggaaagtctactgaaattgaaggaagaaaccactagacacagtaagtctatcagatgggagcttggggcatgttgggtacaacatttacaaaatcaagctactgggaaaactgagccgaaaaaggaagaagaggctaaagttgaaccagctgttaaaggccttgggaagcaaggtggattactaaaggaattaaagaaaaagattgatatcagaaactcgaaagttgaagtaggaaaagatatttcgccatgtaatggcaatgacataaacaagccagaagccactaaacaggaattagagagacaagatgaagaaaaggaaattatatggaaaaaactgctatctgatgctgcatatacacgccttaaggaatctaaaactgatcttcatctgaagtcacctgatgaattgatggaaatggcacataaatattatgttgatactgcacttcccaagctgttggcagattttgggtcccttgaactctcacctgttgatggaaggacgttgactgatttcatgcatactaggggcttgcaaatgtcttccttaggacgagtggttgagcttgcagataaacttccccatgtgcaatctctatgtatacatgagatggttgttcgagcctacaagcatatcttgcaagcagttgttgcagcagttgataatgtttctgagttggcttcatctatagcatcatgcttaaatatattattgggaacaccatcacctgaaactaatgatgaagttactagttgcgctgatgtagaaacccttctacgatttttgggagaatgctaaccagtgcccttagggcattggtcaaggaatcaaaagttgaaagtttttataggaaagtgtaatgttttatgctacaaaagctccccccaacttaatttccaatggaaaacctatttattccttaaccagttccttaggatactggtgaataaactttttattttaatattt

SEQ ID NO: 453 - DNA, 664 bp, Glycine max
  Clone ID: PAT_MRT3847_92215C.1
tacggctgcgagaagacgacagaaggggaccaagttagtttaatttgagtgtatattcagagagaaaaacgaagaaaacatcgtgaagcatgtctggaagaggaaagggagggaagggtctaggaaagggaggagcgaaacggcaccgtaaggttctgagggataacattcagggaatcacgaagcccgcgattcggcgtctggcgcgacgtggtggcgtgaagcgtatcagtggtctcatctatgaagaaactcgcggtgttctcaagatcttcctcgagaacgtcattcgcgacgctgtcacctatactgagcacgctcgccgcaagaccgtcactgctatggacgttgtttacgctctcaagaggcagggcaggaccctctatggtttcggtggttagagatttggggagtggattagggtttctcatcaatttcgttgttgatagttctttagctcttcttgtttgcctttgagttgtagctatgagaaattttaatatgtttatctgattaacttggatatatatatttatatcgtggcctgggtagattcattgttttctcgttattttgcttgtgccaaactgaatttaattgcaatgtttgttctttcggctaagttgaatttgattgttcaatttaattttgagtcattgcccgc

SEQ ID NO: 454 - DNA, 665 bp, Glycine max
  UNSURE (1)..(665): unsure at all n locations
  Clone ID: PAT_MRT3847_92216C.1
  unsure (1)..(665): unsure at all n locations
gtttcggnccggaattcccgcacctgacccaaatcgcgtcctctatattcattttggcatcgaggttgaatctcatcggagagagaaaaaccataaccatgtctggaagaggaaagggaggcaagggtctcggaaagggaggagcgaaacgacaccgtaaggttctgagggataacattcagggcataacgaagcccgcaattcgccgtctcgcgagacgtggcggcgtgaagcgtatcagtggtctcatctacgaagaaacccgcggtgttctcaagatcttcctcgagaacgtcattcgcgacgctgtcacctacactgagcacgctcgccgcaagaccgtcactgccatggacgttgtttacgccctcaagaggcagggcaggaccctctacggtttcggcggttagagaattaccgatttctgcattgcgtcgtggattagggtttcttatagtgtcagtcaatttcgctgttgatattatgcaacggttctttagctgtagcttgagatttaacgattgttctttgagtcgtagttatgagaatttttagtatgtcaatttgattatatttatgccttcttggtactcagcatgcaacgctaaactgaaatttatttgcaatggtcctatgccccaaaaaaaaaaaaaaaaaggccccct

SEQ ID NO: 455 - DNA, 1059 bp, Glycine max
  Clone ID: PAT_MRT3847_92218C.1
cccacgcgtccgtacggctgcgagaagacgacagaaggggacctatcaagttaatttgcgtctatattcattttggcatcgaggttgaatctcatcggagagagaaaaaccataaccatgtctggaagaggaaagggaggcaagggtctcggaaagggaggagcgaaacgacaccgtaagggtctgagggataacattcagggcataacgaagcccgcaattcgccgtctcgcgagacgtggcggcgtgaagcgtatcagtggtcttatctatgaagaaacccgcggtgttctcaagatctttctagagaacgtcattcgcgacgctgtcacctacactgaacacgctcgccgcaagaccgtcactgccatggacgttgtttacgccctcaagaggcaggggaggaccctctacggatttggcggttagacaattggggatttcagcactgcgtcctcgattagggtttcttatagtgtcaatttcgatgtttatatcctgcaatagttctttagctgtagcttgaggtttagcaactgctcttgtttcgctttgggttgtagctatgagaacttttaatatggtaatcaagattaacttcaactttttatgatgtggcctggttaaatgcattgtttatttatgccttctcgttatttaaaaaggccgcagaagcagagaaagaggacaaaaaatgaggtccttgagaagacagtttgtaattcatattatagttgtgagaaaattttgtttgatgttctgcccccttagctttatggagatcatgagttttaaaaccccgctattgcatttttttttttgaactcaagtctgttaatttaattagcactctggtctgttttgattatttctttggttttgtccttggttgttcaagttgtcttttttaattgttagcatgcacgctttccaggcattgaacttgatctttcttagctatattggggggggatcgctaactaatttcacgacattatagctggggacaggaaattgtgtgagtagagttgaaggcatatgatgaatcgtcgtgtggtt

SEQ ID NO: 456 - DNA, 1747 bp, Glycine max
  Clone ID: PAT_MRT3847_92219C.1
cttaaatgctttcattcaacaagagccaagagccagccgggccgcgaggcctggaaagcgtgcatgctaacaattaaaaaagacaacttgaacaaccaaggacaaaatcaaagaaataatcaaaacagaccagagtgctaattaaattaacagacttgagttcaaacaaaaattgtaagggtggtgctttaaaactcatgatctccataaagctaagggcgcagaccatcaaacaaaaatttctcacaactataatatggattacaaactgtcttctcaaggaccttatttcttgtcctccttctctgcttcagcagccttctttaggcgggcaccatggtggcgtttgttggtgcgttcaagacgaagcttatagtatgctttgaaggccttcatttcatctgttaccttaacaaggtcaacagttggcttctccctcacaatgggcaagaatggaccctggacttgagtggcatttgccagctcttcaaggctagaatcaccagccttgaccttgtgtgcccttcttgggaacacaaccaacttagccttgtaggttttgagcctctgcacattggcctgcagactctccaaagaacgattctttctgcggtgatcaacagaaatcccaatagttggagcaagtttcttgggaattcctgcagccttcaattcttccagtgaaaatcctctcccggctctgactttcatgttgtatttcagagtctggccatgaacaataggcctgagagatccagcagtaggcctggggaaaatcttgacagccttcttctgccgagccaaccgtcttctggtctttcgggctggttgattaaaccaagtcttcacatagttttgccagtgtttccggaagtgcccattggggataacattattatgcttaaccattgcttacctgcggatggctcttcagctgaaacggcgaagaagtgtggctgctgcggagagaggtttcctgccgttcctattcggggataacttttttatgctttaccatatcttacctgctggtggcctcttgatgctgaaactggcgaagaaggctgctgcggtagtgataaaatgaatatacaatcatttcaccagtggcagccgctatcataaaaagttgaagttaatcttgattaccatattaaaagttctcatagctacaacccaaagcgaaacaagagcagttgctaaacctcaagctacagctaaagaactattgcaggatataaacatcgaaattgacactataagaaaccctaatcgaggacgcagtgctgaaatccccaattgtctaaccgccaaatccgtagagggtcctcccctgcctcttgagggcgtaaacaacgtccatggcagtgacggtcttgcggcgagcgtgttcagtgtaggtgacagcgtcgcgaatgacgttctctagaaagatcttgagaacaccgcgagtttcttcatagataagaccactgatacgcttgacgccaccacgtctggccagacggcgaatcgcgggcttggtgattccctgaatgttatccctcagaaccttacggtgtcgtttggctcctccctttccgagacccttgcctccctttcctcttccagacatgcttgtcgatgtttctttttctctgagattcaaccttgatgctaaaatgaatatacacgcaagcaaacttggttccccttctgtcgtcttctcgcagccgtacccttctgtcgtcttctcgcagccgtaaaa

SEQ ID NO: 457 - DNA, 2173 bp, Glycine max
  Clone ID: PAT_MRT3847_92419C.1
cactgtcggagtaacaccttctgatcctcgaaaatcacttcctcaatggggtcttcatttcctctcctacactcacaggctcaaccagattaagaaaaggtcaagtggggtatatgcatcactatccgagagagagagaggagagtattattcccagagaccgccaactccgctactagacaccgtcaactatcctattcatatgaaaaatctctctaccaattgtttctagaactgggggccatttgggctcaagtcttggtgtggtggaactcaccgttgcactccactatgtctttaatgcccctcaggacaagatactctgggacgttggtcaccagtcttacccgcataagatactcaccggtaggagggacaagatgcataccatgaggcagacaaatggcttgtctggcttcaccaaacgttccgagagtgaatttgattgttttggcactggtcacagctccaccactatttcagccggacttggaatggctgttgggagagatctgaagggaagaaagaataacgtggttgctgttataggtgatggtgccatgacagcaggccaagcttatgaagccatgaacaatgctggatatcttgattctgacatgattgttattctaaatgacaacaaacaggtctctttaccaactgctactcttgacggacccataccacctgtaggagccttgagtagcgctctcagtagattacaatcaaataggcctcttagagaattgagagaggttgccaagggagttactaaacgaattggaggtcctatgcatgaattggctgcaaaagttgacgagtatgctcgtggcatgatcagtggttctggatcatcactttttgaagagcttggactctactatattggtcctgttgatggtcataacataaatgatcttgttgccattctcaatgaagttaaaagcactaacacaaccggtcctgtattgatccatgttatcactgaaaaaggccgtggatacccatatgcagaaaaggcagctgacaaataccatggggttaccaagtttgatccaccaactgggaagcaattcaaatccaaggctaccactcggtcttatacaacatactttgctgaagctttgattgcagaagccgaagctgacaaagacgttgttgcaatccatgctgctatgggaggtggaactggcatgaatctcttccatcgccgtttcccaacaagatgctttgatgtggggatagcagaacagcatgctgttacatttgctgcaggtctggcttgtgaaggtcttaaacctttctgtgcaatttactcatcattcatgcagagggcttatgaccaggtggtgcatgatgtggatttgcagaagctgcctgtaagatttgcaatggacagggctggattagttggagcagatggtcccacacattgtggttcttttgatgtcacatttatggcatgcctgcctaacatggtggtgatggctccttctgatgaagccgaacttttccacatggttgccactgcagcagccattaatgatcgacctagttgtttccgatatccaaggggaaatggcattggtgttcaactaccaactggaaataaaggaactcctcttgagattgggaaaggtaggatattgattgaaggggaaagagtggctctcttgggctatggatcagctgttcagaactgtttggctgcagcttccttagtggaacatcatggtttgcgtgtaacagttgctgatgcacgtttctgcaaaccactggatcgttccctgattcgcagcctggcaaaatcacatgaggttttgattacagttgaagaaggatcaattggaggatttggttctcatgttgctcagttcatggcccttgatggccttatagatggcaaattgaagtggaggccaatagttcttccggatcgttatatcgaccatggatcacctgctgaccaattgtctttagccggtcttacaccatctcacatagcagcaacagtgttcaacatactaggacaaacaagagaggcactagaggtcatgtcttagaaatattaaggggttcaatttttcactttacacgatgtacaatgcataacatgattcaccacgtgtaatataatatgaaaaagtaatgtaatactgtgaaattttgaagt

SEQ ID NO: 458 - DNA, 2377 bp, Glycine max
  Clone ID: PAT_MRT3847_92420C.1
atttattttctttctgcttctcatggatctctcctcactctcttcataccgcactgtcggagtaacaccttctgatcctcgaaaatcacttcctcaatggggtcttcatttcctctcctacactcacaggctcaaccaggttactgccatttatgaatgcaatgcctcctcttttataactacctttgtttattgctgaattagtcaatgggtgtatatatatttagattaagaaaaggtcaagtggggtatatgcatcactatccgagagagagagaggagagtattattcccagagaccgccaactccgctactagacaccgtcaactatcctattcatatgaaaaatctctctaccaatgagctgaaacaactcgcagatgaactgcgttctgatgttattttcagtgtttctagaactgggggccatttgggctcaagtcttggtgtggtggaactcaccgttgcactccactatgtctttaatgcccctcaggacaagatactctgggacgttggtcaccagtcttacccgcataagatactcaccggtaggagggacaagatgcataccatgaggcagacaaatggcttgtctggcttcaccaaacgttccgagagtgaatttgattgttttggcactggtcacagctccaccactatttcagccggacttggaatggctgttgggagagatctgaagggaagaaagaataacgtggttgctgttataggtgatggtgccatgacagcaggccaagcttatgaagccatgaacaatgctggatatcttgattctgacatgattgttattctaaatgacaacaaacaggtctctttaccaactgctactcttgacggacccataccacctgtaggagccttgagtagcgctctcagtagattacaatcaaataggcctcttagagaattgagagaggttgccaagggagttactaaacgaattggaggtcctatgcatgaattggctgcaaaagttgacgagtatgctcgtggcatgatcagtggttctggatcatcactttttgaagagcttggactctactatattggtcctgttgatggtcataacataaatgatcttgttgccattctcaatgaagttaaaaatactgaaacaactggtccctgattgatccatgttgtcactgaaaaaggccgtggatacccttatgcagaaagagcagcagccaagtaccatgtggtatctaagtttgatccagcaactggagaacaattcaaggccaaggccaccaccaggtcatattcaacatactttgcagaagctttgattgcagaagcagaagctgacaaagacattattggaattcatgctgcgatgggaggtggaactggcatgaatctcttccatcgccgtttcccaacaagatgctttgatgtggggatagcagaacagcatgctgttacatttgctgcaggtctggcttgtgaaggtcttaaacctttctgtgcaatttactcatcattcatgcagagggcttatgaccaggtggtgcatgatgtggatttgcagaagctgcctgtaagatttgcaatggacagggctggattagttggagcagatggtcccacacattgtggttcttttgatgtcacatttatggcatgcctgcctaacatggtggtgatggctccttctgatgaagccgaccttttccacatggttgccaccgcagcagccattaatgatcgacctagttgttttcgatacccaaggggaaatggcattggtgttcaactaccaactggaaataaaggaactcctcttgagattgggaaaggtaggatattgattgaaggggaaagagtggctctcttgggctatggatcagctgttcagaactgtttggctgcagcttccttagtggaacatcatggcttgcgtgtaacagttgctgatgcacgtttctgcaaaccactggatcgttccctgattcgcagcctggcaaaatcacatgaggttttgattacagttgaagaaggatcaattggaggatttggttctcatgttgctcagttcatggcccttgatggccttatagatggcaaattgaagtggaggccaatagttcttccggatcgttatatcgaccatggatcacctgctgaccaattgtctttagccggtcttacaccatctcacatagcagcaacagtgttcaacatactaggacaaacaagagaggcactagaggtcatgtcttagaaatattaaggggttcaatttttcactttacacgatgtacaatgcataacatgattcaccacgtgtaatataatatgaaaaagtaatgtaatactgtgaaattttgaagtggaaaatgcagattgccc

SEQ ID NO: 459 - DNA, 3106 bp, Glycine max
  Clone ID: PAT_MRT3847_92633C.1
tgcgcgcgtaaacactttcgggcgagtgtgtgtgtagcagtttctggttctgtttttggtttcgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggttttggcgctctcgagttcgttttgtactgttttacgtgtgacatgtgaattggaatgcttattccagcttatacaaaacagagacggatctcttcctattgttctcgctttgtttcttttgcagtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgttaagactagaaaaccatatacaatcactaagcaaagggaacgatggacagaggaggagcataataggtttctagaagctttgaaactacacgggcgagcatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccatgcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggtttgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattc

SEQ ID NO: 460 - DNA, 263 bp, Glycine max
  Clone ID: PAT_MRT3847_93042C.1
gtccaaagccgcgagaggcaggggcgcagaaaaccctagccgccttcctctccttttcctttcataaaccctcagccgcgccgcaatagctcgccccctcgttcgccgcctctcctgctcctaccgcagctctccctcagtttagtgttcgcaatggcggccttcaacaagcttggtggccttctaaggcacagtgctctggtgcccggtatcactggtggctcttctcctgcagtgttcaatgctgcacggctcatgtctac

SEQ ID NO: 461 - DNA, 461 bp, Glycine max
  Clone ID: PAT_MRT3847_93101C.1
tacgcctgcggtaccggtccggacccccgggtcgaacccacgcgtccgtctccacgctgggggtctgctctccccttgtgtactgtgtgtgttggtgacttcttcctctctctctcttaagatctgaatagtttcagggtttaaaaaaaaaaactacatcctttgcagtttgcccataagctgagggattatgaattttccttgcgttttggaaagaaagcttctttttgttataattattattatttttttccagattccttaggttgtggctgtgtgaaaagggtagcagattccttgcaaatgcttcttgattatatgcttcttagcagctccactagtccactactcttcatcacatcttctctctctttgaactttcttcaaagagagtgtgtaactagtaataactgtgtatttgtgtgtatgtttttatgatcatataataataaatatgtttt

SEQ ID NO: 462 - DNA, 565 bp, Glycine max
  Clone ID: PAT_MRT3847_93738C.1
ttcggaggcttttcgcactctcttgatgtggctgtgcaggtacaagcacgtggaagacgcagaagctttgtttcacaattcggtgaagaagggtttgagggctgatataaagatgtggaacgtgatcctgaatggttggtgtgttttggggaactcgcatgaggcaaagagggtgtggagagacatagtggcttctccatgcaagcctgatatatttacctatgccaccttcatcaaggcattgaccaagaaagggaaacttgggacggcactgaagttgttccgtggcatgtgggacaagggtggtaaaccggatgttgtgatatgcaactgcatcattgatgctctttgtttcaagaagaggattcctgaggccttggagattttctgtgatatgagtgagcgaggttgtgaaccgaatgttgctacttacaattcacttattaagtacatgtgcaagatacagcggatggagaaggtttatgagctggtggatgagatggagaggaagaaggggagttgcttgcctaatgctgttacatattgttacttgctcaagagcttg

SEQ ID NO: 463 - DNA, 259 bp, Glycine max
  UNSURE (1)..(259): unsure at all n locations
  Clone ID: PAT_MRT3847_9385C.1
  unsure (1)..(259): unsure at all n locations
gtccacggngaaggagagagagacccatgtttgcgtggccaagctctctgagcaagccgngagatatgaagagatggttgaatgcatgaagacaattgcaaaacttgatctagaactgactgtggaagagaggaacctgctctcagtgggatataagaatgtgattggtgcaagaagagcctcttggcgcattatgtcatcaatcgaacagaaggaagagtcttaaggaaatgagagcactgcgnaactgctcaaaaat

SEQ ID NO: 464 - DNA, 101 bp, Glycine max
  Clone ID: PAT_MRT3847_94325C.1
cgtcgatcagggtcgcaagtatgacgagtatggcttcgttgagaagcaatccgtcgaatacggcttccctgttcatgcttttagtgtcacctatgtagcca

SEQ ID NO: 465 - DNA, 277 bp, Glycine max
  Clone ID: PAT_MRT3847_94669C.1
gagcgctcccactacacgcgaagactacgagtacatggctaaactggctgatcaatccactcgctacgaggagatggaggagttcatgaataaggtctacctctccgcttagagctacgagctgaccgtggaggagcgtaaccttctctccgtcgcctacaagaacatgatcggcgctcgccgcgcctcctgacgcatcatctcctcaatcgagcagaaggaggagagccgcagcaactaggaccactgtcccgtcatacacgactaccggtcaaga

SEQ ID NO: 466 - DNA, 1771 bp, Glycine max
  UNSURE (1)..(1771): unsure at all n locations
  Clone ID: PAT_MRT3847_94687C.1
  unsure (1)..(1771): unsure at all n locations
ctttcacaacataacatattgctttctaattattcgtgttgtcagtgtctctttgaggccattttgctagctatttaataatggcaattgagaagcatgaggatgttgagagtggatatttgcacgagcccttcattcaaccagaggatgctgctgctgcttgtaaagaaaatggatcagataagagtgtgaaaaatggatccattggaatggtttttcttagcacacttgttgctgtttgtggttctttcacatttggaacttgtgtgggctattcagcacccactcaagcggctatcagggcagatcttaatctatctcttgctgagttttccatgtttggttcattagtgaccattggtgcaatgcttggagctataacaagcggccggattacagatttcattggccgcaaaggggcaatgaggatttcaacaggattctgcattactggatggatagctgtcttcttctcaaagggttcttactcccttgacatgggaagatttttcacagggtacggcattggagttatctcttacgtggttcctgtatatatagcagaaatagcacccaaaaatcttcgaggaggactagcaacaacaaatcagcttttgattgttactggagggtcagtctcattcttattaggaagtgttataaattggagagaacttgcattagcggggctagtgccttgcatttgcttgctggttggtttgtgctttatccctgagtcccccagatggctggctaaggttggccgtgaaaaagaatttcaactagctttaagtagacttcggggtaaagatgctgatatttctgatgaagctgctgaaattctggattatattgaaactcttcaaagtcttcctaagactaagctgttggatttgttccaaagcaaatatgtgcactctgtagttattggggtcggcttaatggcatgtcaacaatctgttggaattaatggcataggattctacacagctgagatttttgtagcagctggactttcttcaggaaaagctggtaccatagcatatgcttgtatacagattccatttacattattgggagccattttgatggacaagtctggaagaagacctcttgtaatggtttccgcagctgggacattcttaggttgctttgttgctgcctttgctttctttctcaaggaccaaagcttattgcctgagtgggtacctatattagcatttgctggcgttctgatctacatagcagcattttcaattgggctcggatcagttccatgggtgataatgtctgagatatttcccatacatttgaaggggactgctggaagcttggtggttttggtggcttggctaggagcttgggtagtttcatatactttcaactttcttatgagctggagttctcctggtacattgtttttgtatgctggatgttccctcttaactattctatttgtagcaaaattagtcccagaaaccaaaggaaaaactttggaagagatccaggcttgtattagttcatagagataaaagatcaaaaacgcactgcaggacccagtcaaaccattaccaccatttttcaaattcttttacatccatttaggaccgtcaaggcataaaataacataatgttgccatatcgatccatttttgttgttgtataataataataataataataataatgtatcattagcttatttgataagaaaaaaatcattctgtaacactgtgcctctgcctgtnctgatttttnnnatggannnngc

SEQ ID NO: 467 - DNA, 409 bp, Glycine max
  UNSURE (1)..(409): unsure at all n locations
  Clone ID: PAT_MRT3847_9479C.1
  unsure (1)..(409): unsure at all n locations
caaaaaaaagcttaagtttaggatgacccaatgcaggaacatgcagggggatctaatagattatgtccccggattccctaaagaatccgacatgaacattgttgaatgcaccatattattgaatgtgccacaaggttacagtgatgtcctgataaaaaatctctacttgtcatgtgatccatacatgcgacttctcatggccaaagaccgtgctttcggagatggctacttcacccttgactatccattgaaaggatatggtgtgtctcaagtgctggaatctggacgttcagattacatgaaaggtgacttaatgtgggggattactgaatgggaagagtatagccngtggccgtcatctatcatacatttcataattgagcacactgatgntccactttgctactac

SEQ ID NO: 468 - DNA, 2609 bp, Glycine max
  Clone ID: PAT_MRT3847_95346C.1
ggctcgaggagaaacacgcgaacaatgaggggagtgcatcatgcaagcctctgcaattttttctttcagcagctcgaccttccttttgtgacataagaggttgagtggagttgccccatctgcataaagagaccgagaaatgattgctttttgtaacttatgtgcagtaacaaaataattctgtgatttatctgaaataggtagttggatgattttatgtcttgctttttctatctaaatatggctttggaaaggaaaattgcaaagttgtgtttctgttgattctaagggaaagagtgagtatggctgttgatagaggtgagatatggctacactgacggggcagtaacagtccaaatatatgattttaaattggattgggcggtgtagtacgaggcaggaatttgctggctttatcaccattttcattgaataagtaatactactttatagctcccggggattttgatcaatgaaccaaacctcctcctcctcctcccctcctcctcttcttcttcttctttaccctttcttttctctctgggtctttttcatcactagcaaaacttgaacttggaattggagttggctcaaaaagggaaacttggatctcagtcatatgaggataccttcaactctcgtggaagtgcttctggtacttgcattgttctgttgtagcccatggacagtgtggagcagcaacactctttgccaacagacgaacgaggaagttcgacctcacagtgtcagcatcactgaatttggtgcagttggcgatggggtcactctcaacacaaaagcatttcagaatgccatcttctacctaaattcctttgcagacaaaggtggagcaaagctttttgtcccggcaggccggtggttaactggtagttttgatctcatcagtcatctaactttgtggttggacaaggatgcagtaattcttggatcaacgaaccctgaagattggccagttgttgatcctctaccgtcgtatgggagaggaagagaattgccaggtggaaggcataagagcctcatttatgggcacaatctgactgatgttatcataacaggtaataatggaactatcgatggtcaagggagtatctggtggaacaggttttggaacagaagtctggattatacacgtccccatttggtagaattgatgaattcaacaggggttctcatttcaaatttaaccttcttgaattctccattttggacaatccatcctgtatattgcaggtttgtcccccactgaaagattgagtttatatattattccttgttttccgtagttcaagtacttccattgcctttttaaaactgtgcaatagaggagctttcatgagtagggggagatttgagactgtttttatggatgaacagccaagttacagttcagaatgtcaggatccttgctcctcatgattcgccaaacacagatgggattgatccagattcttctgacaatgtatgcattgaagactgttatataagcactggtgatgatctgattgccatcaagagcgggtgggatgagtatggcattgcatatggtcgcccaagcacaaacattatcatccacaggctagttggtaaaactcaaacaagtgggattgctattggaagtgagatgtctggtggtgtatctgaagttcatgcagaagatattcaattctatgattcatataatggaatcagaataaagacttctcctggcaggggtggttatgttagaaatatctatgtctctaacgtgagcttggctaatgtagatattgctatttggttcactggttcatatggggagcatccggatgatgcttatgacccaaatgctctacctgtaatagaaaaagttacaatcaaggatgtggtaggagaaaatatcaaaactgcaggtcttatagagggtatagaaggtgacaattttgtcaacatttgcctgtcaaacattatccttaacgtgacctcaaactatccatggaactgctcctacgttaaaggatattctgacttagtccagccagaagcttgtgagcctctcaaggagagaatattccctgatcattgttcagattgttactatttgacaaatcaaattcagagttcgaatagtcaaaatagagcaggacaaacttcaggtgacataagaggttgagtggagttgcccaactgtgagccatctgcagaaagataccgagaaatgattggtttttgtaacttgtgtgcagtaacaaaataattgagtgatttatcagaaataggaagttggatgatttcatgtcttgctttttctagctaaatatggctttggaaaggaaaattgcaaagttgtgtttctgttgattctaagggaaagagtgagtttggctgttgatagaggtgagatatggctacactgacataattccctcttgccaaaaatgttatcggacacaggagattttgcagtagtacgaggcaggtgcttgttggctttacaccccttttcattgaataaggaatccaataaataaacttcctagataggtggaattcactcaattacatacatgcctcttcttttacgctcactacatgaatagagttactatttt

SEQ ID NO: 469 - DNA, 1330 bp, Glycine max
  Clone ID: PAT_MRT3847_95870C.1
cggacgcgtgggcggcacccctgacttgaacctcttaccgtgcgcatcttctcaatccataacaacttcgccaccgttgcaccgaaaccaatcgccacaaactcgggatctcagattcgacgcgccaaaccatgtcgaaggcgcgtgtctacacagatgtcaatgtccttcgccctaaagagtattgggattacgagtctctcacccttcaatggggtgatcaagatgattatgaggttgtgcgaaaagtgggcagggggaaatatagtgaagtttttgaaggcataaatgtcaatagcaatgagcgctgtataatcaagattctgaaacctgtcaagaaaaagaagattaaaagagagataaaaatacttcagaatatttgtggaggcccaaatattgtcaagcttcttgatattgtcagagatcaacattcgaaaactcccagtttgatatttgagtatgtcaacagtacagattttaaagttttgtatccaaccttgactgattatgacatacgctattacatatatgagctccttaaggctttggattactgccattctcaaggcattatgcatagggatgtcaagcctcataatgtcatgatagatcatgagttacgaaaacttcgcttgatagattggggtcttgctgaattttatcatcctggaaaggaatataatgtccgtgtggcttcaagatactttaaggggcctgaacttctagttgatttgcaagactatgactactcattagacatgtggagccttggctgcatgtttgctggaatgatatttcgcaaagaacctttcttttatggtcatgacaaccatgatcagcttgtcaaaatagctaaggtgcttgggactgatgaactgaatgcatatcttaataagtatcatctggagcttgatcctcaacttgatgcacttgttggaagacacagtcgaaaaccctggtccaaatttatcaatgcagataatcagcatcttgtgtctcctgaggcaattgattttcttgataagctccttcgatatgatcaccaggacaggctaacagctagagaagcaatggcacatccatatttctctcaggtaagggcagctgaaagtagcagaatgaggacacagtaacttgatcacatatggatccataaacttgagttaatatatttgggattgttttatgataccctaacacgcacctccgttaccttctgtttattacagagattagttttcctggggagtgtatcgatattatgttttcagttgaggaataatgccattgccagttattgaaaattgaaattgtcttgaaagttgtgact

SEQ ID NO: 470 - DNA, 262 bp, Glycine max
  Clone ID: PAT_MRT3847_96578C.1
ggcggccgctccctcacctcgcgaagagaacgagtacatggcaaagctcgccgaccaggccgcgcgctacgaagagatggtggaaaccatggaaaacgtctccgccgccgtcgacaaccaggagctcaccgtcaaggaaaggaacctcctctcgcccgcgtacaagaacgtgatcggagcacgccgcgcctcgaggcgcatcatatcctcgatcgagcagaaagacgagagccacaccaaccaggaccacgaatccgtaatc

SEQ ID NO: 471 - DNA, 331 bp, Glycine max
  Clone ID: PAT_MRT3847_9664C.1
ctcaagccgttcgacccgcgaaaaaaccaactccttaagttcatggcaccccccaacccaaccgaattttcctttgccatggaaagaaccggccaatgggttttttcccaaaaaatcccaaccgttgtaattgttgcagttgaccaaaccaatttttctttccacaggttatttctggcgggaaagagtaactacgtcaaaaaaagtgataatgggaatcagagggagagtgacctaacaagaaatagagatttccgacataccctggaggatcagaaagctttgaaaaaagcggcgaaattctgtttacggcgttaaacttcgagaatca

SEQ ID NO: 472 - DNA, 993 bp, Glycine max
  Clone ID: PAT_MRT3847_96842C.1
aaaccaactgttttaaatggaggagtgtgagtggtgaggaccctctcaccacccctttatctccatgcttcttcaagaaccatggatggatgtttgccaacaaagctccatatttgctcaccagattcaggacttgatagattggtttagagggtgtgtccaaagggctttacacagaaaaactaggttttttttttttttttttttttttttttttttttttttttttttttttttttttttttttttcgttaaaacagtttctgtcacatccataaacacagttgataacttccatgactccgaggcttaacaagatcatacaaaaatatataactttgcttaaatgaaaacaacaaactacaagcaattgaggctagttctttggcccaatatccttcagggcacaaatctgctcctcacccattgcagacataactgacacaacaaggtccttaccctcagcaaacccatcctttatctgagtaagcaaactctcatcagtaggaagcttcaggtcatccttggtgttcccattttcagtaagcaagctaagaaatccatcctcagcaatgtcaatcaactggtaatcagtacgattcacatggggaacatcacagttgtgagaagagggcacaatatcttcaagcttcttggcagtgaaaatatcaatcccaacaaagtgacacttggcatgaccgtgcttaccagtcttggaagtagaaacttcaacaaccttgcagggacgacccttgatgacgatgtaaccgtttttgcggatggttccggcttgttgaggataggtcttggaggctccagcatcggccttggattcgaaatggtgttcttcgtccgacatggttcgactcggtcactgactcacaccgattcaactcgaccgactcagagagagtgtgtatggagggtgggtgagtgggggcggagaagacagagactaggaaggaggaaatggatttatataattctcgagcc

SEQ ID NO: 473 - DNA, 856 bp, Glycine max
  Clone ID: PAT_MRT3847_96843C.1
tttatttattttagttagaatgcaaaatacgttaaaacaaaaataatttgatagtcgtattttatcaaaaaaatatcaagacaacatcgaaacagagaaatgttaaacagtttctgtcacatccataaacacagttgataaaactagtctgacttagagtctccataactccggggtttaacaagatcatacaaaaatatataacttttgcataaatgaaaacagcaaactaccagcaattgaggctagttctttggcccaatatccttcagtgcacaaatctgctcctcacccattgcagacataactgacacaacaaggtccttaccctcagcaaacccatcctttatctgagtaagcagactctcatctgtaggtaacttcaggtcatccttggtgttcccattttcagtaagcaagctaagaaatccatcctcagcaatgtcaatcaactggtaatcagtacgattcacatggggaacatcacagttgtgggaagagggcacaatatcttcaagcttcttggcagtgaaaatatcaatcccaacaaagtgacacttagcatggccgtgcttaccagtcttggaagtagaaacttcaacaaccttgcagggacgacccttgatgacgatgtagccgtttttgcggatggttccggcctgctgaggataggtcttggaggctccggcatcggccttggattcgaaatggtgctcttcgtccgacatggttcaactcggtcactgactcaccgattcaactcgaccggctcggaggagtgggagagtgtgtatgtaagtggggtgggagagtgggggcggagaagacaaagactttgggggaggatatggattta

SEQ ID NO: 474 - DNA, 289 bp, Glycine max
  Clone ID: PAT_MRT3847_97352C.1
ctcggatttaggtagagctcgagccgtatcagctcgagcagggttaagcggtgtgattttcgaatctgagaaatgggctattcttctcgggaggagaacgcttacatggagaaattggcggagctctccacacgtttcaatgagatggttgatttcatgtaaaatggttgcaatagactgtggaggttgaggagttgacagtggaggaaaggattctcctctctgtggcttacaagaacgtgatagactcgaggagggcttggttgatgatcatattcttcattgagca

SEQ ID NO: 475 - DNA, 230 bp, Glycine max
  Clone ID: PAT_MRT3847_97372C.1
cacacaactactacaagtactttcttacaatcaaaaccaacaaccactatggcaaggtatcaaaaacacttccatgatcaaggtccccagggtgaccaattttgcaaccgttataagcaaaccgaccaataccggaacccctgttcatgctgctaagtgcacctatgtagccaccaaaactgctgctggtggttacagtgatgacattaataagcaacattgattccacc

SEQ ID NO: 476 - DNA, 444 bp, Glycine max
  Clone ID: PAT_MRT3847_97721C.1
cggacgcgtgggaacagattgagagcctacagcgtcctattacaatggaagcaggctcgattgttctaatggatttattatggtctgatccaacagaaaatgatagtgtggaagggttgcgaccgaatgctcgaggtcctgggttggttactttcgggcctgatcgtgtcatggagttctgcaataacaatgatcttcagttgatcgttcgagctcatgagtgtgttatggatggctttgagcgctttgctcagggacatttaatcacccttttctcagcaactaattattgtggtaccgctaataatgctggtgcaatcttagttttgggtagagatctagtggtagttccgaaactcattcattctttaccccctgcaatgtcatccccagaagcatcatcggaacgtcttatataggatacatggatgcaggagctgaatg

SEQ ID NO: 477 - DNA, 321 bp, Glycine max
  Clone ID: PAT_MRT3847_97804C.1
ggctcgagatacagtcgttaatcctagcttcttcaactcctcgctggcaacaacagcagcactaccatgagccgtgttcttcaaacgtgactatcgagaattaccgatgggaaatgaaagaggaggattcaagggattcatgagcgcttggagcgtgccgaccaatccgtgcgatacctgcaagctggcctcggcggcactcttctgccgccccgaactcatgatttctgtgcgtcggctgcgagtccaacattgactggacgatcaaactcgcgacgagccaccagcgcatgttgatgtgttaagagtgccagcactcac

SEQ ID NO: 478 - DNA, 911 bp, Glycine max
  Clone ID: PAT_MRT3847_98128C.1
cccacgcgtccgacggctgcgagaagacgacagaaggggagatacagaaaagaaaaaggaaaccctagctggataggtcaaacatcatcatgtcggacgaagagcaccatttcgagtccaaggcagacgccggtgcctccaaaacctaccctcagcaagccggtaccattcgcaagaacggctacatcgtcatcaaaggacgcccctgcaaggttgtggaagtttcgacttccaaaactggaaagcacggtcacgccaagtgccactttgttggaattgatattttcactgccaagaaacttgaggatattgtgccctcttctcacaactgtgatgttcctcatgtgaatcgtactgattaccagctcattgatattgctgaggatggatttttgagtctgcttactgaaaatgggaacaccaaggatgacctcaagcttcccactgatgagagtctgctcactcagataaaggatggatttgctgagggcaaggatcttgttgtgtctgtcatgtctgctatgggtgaggaacagatttgcgccctgaaggatattgggccaaagaactagcttttggtgctggcagcctgttgtttctatttaagcaaagatccttttgtaagcctttatattggtttgttcaagacctggcttatggcttatagattctagtcagactagtcttaacaatggtgtttatggatgtggtcacagaaactatatcacattttttctggttttctatgctgtcctatgactttgttataaaggaggagtcaaatgtgggaaggtttttttttggtatgatatgatgagattttcattgcctgcattgatgaaaacttacattctaatgtcaaattacacacagcattatcagacctgatgcaaataaaccaattgtgtatg

SEQ ID NO: 479 - DNA, 851 bp, Glycine max
  Clone ID: PAT_MRT3847_98129C.1
tacggctgcgagaaaacgacagaaggggagagacgcagatatctgtaatttgtgtctgctcactcgctcttctccgccacttctgaatctattgaatcaacaatcatgtcggacgaagagcaccatttcgagtccaaggccgacgccggagcctccaaaacctaccctcagcaagccggtaccatccgcaagaacggctacatcgtcatcaaaggccgcccctgcaaggttgtggaagtttcgacttccaaaactggaaagcacggtcacgctaagtgtcactttgttggaattgatattttcactgccaagaaacttgaggatattgtgccctcttctcacaactgtgatgttcctcatgtgaatcgtactgattaccagctcattgatattgctgaggatggatttttgagtctgcttactgaaaatggtaacactaaggatgacctcaagcttcccactgatgagagtctgctcactcagataaaggatggatttgctgagggcaaggatcttgttgtgtctgtcatgtctgctatgggtgaggaacagatttgtgccctcaaggatattgggccaaagaactagcttttggtgcttgttgcttgttatttctattttctatttaagcaaagatatttttgtaagccttttatattggtttgttcaagacctggcgtatagattctagtcagactagtcttaacaatggtttttatggatgtggtgacagaaactattatcacatttttctggttttctttgttgtcctgtgattttattataaaggaggagtctattgtgggaagcttttttttggtatgatattatggagatttcattgcctgcac

SEQ ID NO: 480 - DNA, 1184 bp, Glycine max
  Clone ID: PAT_MRT3847_98366C.1
tttggaagttttttttttttttttttacttgcaaaaaaaaaaatccaacgttgttctcgtcaataaaaaagaggcaactacatagcaacaataaaaaatttataaatcactaaaccaccaagccacattgttctcgtcaataaaacacatacacgactgaaacattgtaaatctcaagcgcaacccgcaattgaaatcacgaaactcattaatacacagttccactatggcaagccacattggatgtatattatcggtaatacatatcccatcaactactgccatcgcctattcacctggttgttgcttagatgtttccttgatctcatctccagcatcgtccgtgatgtctgatgtccacaaagtcagattgtcacggagaagttgcatgatcaacgtactatccttgtatgactcttcacccaatgtgtcaagctcggaaattgcctcatcaaatgcctgtttggcaagattacaagcccgatctggcgagttaaggatttcataatagaagacagaaaagttgagagcaagtcccagcctaatggggtgagtgggggccaagtcagcaagagcaatatcctgagcagatttgtaagcaagcaaagtactctctgctgcctctttcctctctgccccagtcttgaactcggcaaggtacctgtggtaatcacccttcattttaaggtaaaacactttactctcgggagatgcggcggatgggatgaggttggactcaaggaggttcaaaatcccgtcacagatcttgctgagttcagcctcaattttgcccctgtactcctttataatggccacatggtcctcattgcccctgctctcctccttctgctcaatggaggatatgatcctccacgaagccctcctcgcaccaatcacgttcttgtaagccacagagagaagatttctctcctccaccgtcaactcctcaacctccacagtctttgctaccttctccatgaactcaaccatctcctcgtaacgctcggcctgctccgccaatttcgccatgtaaacattctcctcccgagaagaatccgacatttctcagattcacgaatctcaccgcttaatcctaaaaaatggaagatgcagatctggaaaggagaaacaaaaaggaaaccctaaaaggagaagaaagtgggacgatgaaccccgaggccgaa

SEQ ID NO: 481 - DNA, 1525 bp, Glycine max
  Clone ID: PAT_MRT3847_98379C.1
atcctcccgcttctctctctctctctctctctctaactctcttctaaaacttaccaacacatccatctacacttccttcatttccatccccttctctcttttaaacctcacgcacaacgaaatcgtgattctgttgttcttttgaaatggaaaacgctccggtggtgtgtaaggaagatgatcagatggatttgcctcccggatttcggttccacccgactgatgaagagcttataagccattacctctacaagaaggtcattgacaccaagttctgcgccagggctattggagaagtggacctcaacaagtctgagccttgggatttgccatggaaagccaaaatgggagaaaaggagtggtactttttctgtgtgagagacagaaaataccccactggcttgagaaccaacagggccaccgaagctgggtactggaaggccacaggaaaagacaaagagattttcagaggaaaatctttggttggaatgaagaaaactcttgttttctacagaggtcgagcacctaaaggtgaaaaaagcaattgggtcatgcacgagtacagactcgaggggaaattctctgttcacaacctcccaaaaactgcaaagaacgagtgggtgatttgcagggtgtttcagaagagttcagctgggaagaaaactcatatctcggggataatgaggttggactcttttgctgatgaattgggttcttctgctctgccacctctctcggattcttcgccttctatcggtaacactaaacctcttaatgatacggcttacgtgccctgcttctccaatccaattgatgttcaaagaaaccaagaaggtgtctttgattccttcaccaactctatctatgcggtttcttcaaatcctatgggcattcttcccagaatgccaccttctggctccttctactccactcaaggtgttcaagctgcgcctaatttggcatttcctggttctgtttacacccttcaggatcacaccatcctgagaaccttatgtgaaaacaatggttacaagccagagagggacatgatcagtgtttcgcaggaaacgggtctaactactgatatcaacgctgaaacctcttcaaattttgatatgggtaggaggccctttgagaatcacaatcatgcatctgtttctgttgccccattggatcttgatggtttgtggaattactaaaagtttaaataaaaggatcaattacagtgaaaagtgaaattaaccccacttttgagctgaaaggaagaggaaaaagaagagcctcggatggggttgatgctattgttgtaatttctctgaatagattttatctaagacatgtatttactgaagcatatgttgttaagtgtaagaaatgttgtggaatgaattaggctggtttggtctgttgacactttaggcttgtgcgtggctggcatgagcatgagcatgagcatgagcatgattaatttgtttcagtttggattaaaaataatagtagaatgggactggtggattaaaattag

SEQ ID NO: 482 - DNA, 1583 bp, Glycine max
  Clone ID: PAT_MRT3847_98380C.1
gcgtacgtaagctcggaattcggcctctctcgctcacgctcttctaaaacttaccaacacaacaaaatcgagtttccaataaagagttttgttgaaatggaaaacgttccggcggtgtgtaaggaagatgatcagatggatttgcctcccggatttcgattccacccgacggatgaagagctcataagccattacctctacaagaaggtcattgacaccaagttctgcgccagggcaattggagaagtggacctcaacaagtccgagccttgggatttgccatggaaagccaaaatgggagaaaaagagtggtactttttctgtgtgagagacagaaaataccccactggcttgagaaccaacagggccacagaagctgggtactggaaggccacagggaaagacaaagagattttcagaggaaaatctttggttggaatgaagaaaactctggttttctacagaggtcgagcacccaaaggagagaaaagcaattgggtcatgcacgagtaccgactcgagggaaaattctctgctcacaacctcccaaaaactgcaaagaacgagtgggtgatttgcagggtgtttcagaagagttcagctgggaagaaaactcatatctcggggataatgaggttggactcttttgctaatgaattgggttcttctgctctgccacccctttcagattcttcgccttctattggcaacactaaacctctgaatgattcggcttacgtgccctgcttctccaatccaattgatgttcaaagaaaccaagaaggtgtcttcgattccttcaccaactctatgtatggggtttcttcaaatcctatggacattcttcccagaatgccaccttctggctccttctactccactcaaggtgttcaagctgcgcctaattttgcatttcctggttctgtttacactcttcaggaccacaccatcctgagagctttgtgtgaaaacaatggttacaagccagagagggacatgatcagtgtttcgcaggaaacgggtctaactactgacatcaacgctgaaacctcttcaaattttgatgtgggttggaggccctttgagaatcacaatcatgcatctgtttctgttgccccattggatcttgatggtttgtggaattactaaaagtttaaataaaaggaacaattacagtgaaaagtgaaattaaccccacttttgagctgaaaggaagaggaacaacaagagcctcgggtggggttgatactgttgttgtttctctgaatagattttatctaagacatgtaattactgaagcatatgttgttaagtgtaagaattaagaaatgttgtggaattaggctggtctgatcttttgacactttgggcttgtggttggcatgaacacgagcataattattttgtttcagcttggattaaaaatcatagtagattgagcctggtggattaaaattaaaatttaaaaagtcatgatgatgattatgtaccgtagcttgttgatcttgcttttctggattggattatcagtccacgccccatccagctaatactgagaccatgaccaagagcttgattcggtt

SEQ ID NO: 483 - DNA, 1836 bp, Glycine max
  Clone ID: PAT_MRT3847_98690C.1
ccggggtgtgttccttctctcgagacgatccggagggatgggaggtcctggtggccctggatttcctcttgcttttggtcaatccaaagccaagtttcaaatggaaccaaacaccggagtgacatttgatgatggtgctggggtggatgaagccaagcaggactttatggaggtggtggagtttttaaagaagcctgagaggtttactgctgttggggctcgcattcctaaaggagttcttcttgttggtcctccaggaactgggaagaccttgttagccaaggctattgctggtgaagctggtgttccatttttctctatatcaggttctgagtttgttgagatgtttgttggtgttggtgcttctcgtgttcgtgatttgttcaagaaggcgaaagagaatgccccttgcattgtctttgttgatgaaattgatgctgttggaagacaaagagggactggaattggtggagggaatgatgaaagagagcagaccctcaaccaacttttgacagaaatggatgggtttgagggtaacacaggtatcattgtcgttgcagcaactaacagggctgacattcttgactcggccttgttgagacctggccgatttgatagacaggtgacagttgatgttccagatataaggggaaggactgaaatcctaaaggttcatgctagcaacaaaaagtttgatgctgatgtttctcttgaagtgattgcaatgagaacacctggctttagtggagctgatcttgcgaatctgttgaatgaagctgctatattagctggtcgccgtggaaagacagctatttcatctaaagaaattgatgattctattgataggattgtggctggaatggaaggaacagtgatgacagatgggaagagcaaaagtttagtggcatatcatgaagttggtcatgctatttgtggaactttgactcctggtcatgatgctgtgcaaaaggtaacactagttcctcgcggtcaagctcgtggacttacatggttcattcctaacgatgacccaactctgatctccaaacaacaactctttgcaagaattgttggaggactaggtgggagggctgcagaagaaattattttcggtgagcctgaagttacaactggagcagctggtgatttgcagcaaatcaccagtttggcaaaacagatggtgaccacatttggaatgtctgatattggtccttggtcacttatggaaccatcagcacaaggtggggatgtcatcatgagaatgatggcaaggaactcaatgtcagagaggcttgcagaagacattgatgctgccatcaagaggatctcagatgaagcatatgaaattgcactggagcatataaggaacaaccgtgaggccattgacaagattgtggaagtccttctggagaaggagactctgagcggagatgaattccgtgctatattgtctgagtttgttgaaattccagctgaaaaccgtgttgctccttcaactccagtaccagccactgtttgaatagcctatatatgtaacatctttcatatgtattatcttagaatacagaatgccctctgcagcctgctccatatttgtgaatgattaaagattctaccttactttttcattttttgtagtgttgacaaatgacaacagagagtatgtataaaagagaaactgtttttagtgtaaaaatttgtagtttctttacgtctataatacagtgtaactttaataaacctttatttttaaatgtagagttgtaacgggtgagacacaatgtttagtttttttttataaatggaaatgaaaaaaaatactaacttaaatacttt

SEQ ID NO: 484 - DNA, 1479 bp, Glycine max
  Clone ID: PAT_MRT3847_98960C.1
ctcctccatccagaacgaacaaaaatggataaacatttttgatcttccttcctctgaaacaagaaccaaaatggagaattcgaccgaagaatcccatctccgatcggaaaactccgtcacttacgagtccccttaccctatctacggcatgtcattctccccctcccacccccaccgcctcgccctcggcagcttcatcgaagaatacaacaaccgcgtcgacatcctctctttccaccctgacaccctttcggtaactccccacccttctctctccttcgaccacccttaccctcccaccaaactcatgttccacccccgcaaaccctccccttcctcttcctccgacctcctcgccacctccggcgactacctccgcctctgggagatccgtgataactccgtggatgccgtctccctcttcaacaacagcaagaccagcgagttctgcgcccccttaacctctttcgactggaacgacatcgaccccaaccgcatcgccacctccagcatcgacaccacctgcaccatctgggacatcgaacgcaccctcgtcgaaacccaactcatcgctcacgacaaggaggtttacgacatcgcctggggagaggccagagtcttcgcctccgtctccgccgacggctccgttagaatcttcgaccttcgcgacaaggagcactccaccatcatctacgagagcccccaccctgacacccctttgctccgcttggcttggaacaaacaggacctgaggtacatggccaccattttaatggacagtaataaagttgtgattttggatattaggtctcccactacccctgttgcggagttagagaggcaccgtgggagtgtgaacgccattgcttgggctcctcatagctccacgcatatttgttctgctggtgatgatactcaggctcttatttgggaattgcccacgcttgcttctcccactgggattgatcccgtctgcatgtactctgctggctgtgaaattaaccagctgcagtggtccgccgcccagcccgattggattgccattgcttttgccaacaagatgcagcttttgaaggtttgaggtcagaacaaacaattacacattctagccacttcattgtggcatagacatagcaacttctgatcacttgagtgactgagttatatatattattgtagttgtgcaaactagtttgccctcctcatgttttacttgtggcgaaattaacgatgttcaatttgtctgttaaagatggatttttaacctgttgtgaagtaagatttcttgtctgtgatgtggaagccatagctattagtttcttagttaacatgagaaatcacatgtagtatgtggaatcaattaccacacatccagattataggtcgtaaaatcttcagtgtttgtattcccatttgattttaaacaccctacctctgatatgtatggactatggatctgtattcttgagcttttgccat

SEQ ID NO: 485 - DNA, 1252 bp, Glycine max
  Clone ID: PAT_MRT3847_9915C.1
cccgacgcactcactctatctcttttctccagcagcaccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttcaagtttatgtataaattaaataaaagaaaaatctagttttggttatgaatctttgttaaagtagaaaaaaatctttaaagagtctgcaggccaatgtgcataggctcaaaacagg

SEQ ID NO: 486 - DNA, 540 bp, Glycine max
  UNSURE (1)..(540): unsure at all n locations
  Clone ID: PAT_MRT3847_99178C.1
  unsure (1)..(540): unsure at all n locations
gctttcagnnattcatccgagaagttcaagaaagcaggagcagtggttgttggaataagtggtgatgatgctgcctctcacaaggcatttgccagcaagtacaggcttccatttactttgttgagtgatgagggtaccaaggtgaggaaagaatggggagtgccaggtgatttctttggatcattgcctggaagagagacttatgttcttgacaaaaatggggtggttcagctcgtctacaacaatcagttccaaccagaaaagcatatcgatgagaccctcaaaatacttcagagtctttgaggattctgattcttttgtttgctatctcagctggcttgattcagagtcagacaagtatgtaactatgaattgtaagtttgtaatcactgtaattatgtagctgattttggagcctttgatcacattcacatgggggtgatgatgcctctccagatggaaataatgccttcatttgccacaaatacagtcagattatatatgtatcttttgcacatcgtaagtttagcgtccgttggc

SEQ ID NO: 487 - DNA, 1005 bp, Glycine max
  Clone ID: PAT_MRT3847_99180C.1
ctcccgtccgggaaatcctctctgtatctttggttcagcagccattagcgatttcccttatctctctccatcttaactccaagcacaagaatcatcttcccatttcgtttctgaccaatggcttccctcactgtcccaaaccattgtgttcccactttgcttcgcactcactctctcaactacccatcttcccaaaacctcccacttccttccgcgccatcaaattctcaattttttggcctcaagctatctcattcttccttttccacaattccctcttcttcttcttcactcaaaggctccattttcgccaaggtgaataaaggttcaaagccaccgaattttacgctaaaagatcagaacgggaagaatgttagcctctccaacttcaaaggaaaaccagtaattgtgtatttctaccctgctgatgagacccctggctgtaccaaacaggcttgcgctttcagggattcatatgagaagttcaagaaagcaggagcggtggttgttgggataagtggtgatgatgctgcctctcacaaggcatttgccagcaagtacaaacttccatttactttgttgagtgatgagggtaacaaggtgaggaaagaatggggagtgccaggtgatttctttggatcattgcctggaagagagacttatgttcttgacaaaaatggggtggttcagctcgtctacaacaatcagttccaaccagaaaagcatattggtgagaccctgaaaatacttcagagtctttgagacattctgattcttttgttggctatcttagctggcctgattcagagtcagacaagtatgtaactatgaattgtaagtttgtaaccactgtaattatgtagctgattttggagcctttgatcacattcacatgggggtgatgatatgtattctcctatagagagcaaacatttataacctctccggatggaataatgccttcatttgccacaaatacaatcagattatatctgtatcttttgc

SEQ ID NO: 488 - DNA, 801 bp, Glycine max
  Clone ID: PAT_MRT3847_99342C.1
aactcaccccccaacattgattaatatatatacataaaaggggataaattaccaacatataaagaaataaatattgtgaaagtcaagacaaagagttagtaggagaagcaagggaacagtatgccatcttttctttgttaaatacaggcaatgacattctttcttttcttttctttattttataataaaagtgcattaacctgaatctctcctcagcttttcaggcaaatctgaacccgctacctgctgtacaaaagtgtgagactctgaaccaggagcatttgagtcaattgcagaaggattgagttggtaatgaactgaaattaaaccatcctctgattcacctgctgatacaggagatccctggaaacttgccactgaggttttaccagatgacatgccttggagtattatcacaacaaagaagacaacagtgaaaatcatagccaaaaggctgctggcattggaagatgatggtgctgatgatttagcaattttccggacgcgcatacgctccatcctcgcgcgcttcaacatggcaagttcagatatctccctgattagcttatggtcagctgcatccaatgatggagcctttgggggtcttggaggtttgggagcctttttattactggcctttttccgtttctccctcactggggtttgttgtgcacggtttgccgaatctctccccatcattggtttgtttgttactctcatcacatccgcatatacttcacttaaacttggttcattgcagcataaacttggcccatcatcacctttaacagaacctccagc

SEQ ID NO: 489 - DNA, 768 bp, Glycine max
  Clone ID: PAT_MRT3847_99499C.1
tttttttttttttttactaaaattttttttaatttatttacgaaaaatgagatgttgcacaacacaataaaatataggtcaaggattcccaaataaagccattcaagtgttaccacatcttgtaagaatggcacaaactttggctgatttagtatacaaacccacataaaagtgaaaaataaaaataaatacaatatataatctcaattccaaatctattacttggggccaatatccttaagggcacaaatctgctcctcacccatggaagacataacagacacaaccagatctttgccctcagcaaatccatccttgatctgcgtaagcagattttcatcggttggaagcctaaggtcatccttagtaccaccagtctcagtctgcagactcacaaacccatcctctgagatgtcgatgagctggtagtcaatgcgattaacatgaggaacatcacagttatgggaagatgggacaatatcctcaagctttttcccagtgaatatgtcaattccaacaaagtgacactttgcgtgtccatgcttgccagttttggaagtggaaacctccacaaccttgcatggcctgttcttgatgacaatgtaaccatttttgcggatggttccagcttgctggggaaatgtctttgatgccccagcatcagcctttgactcgaagtggtgttcctcgtctgacatggttatggttaataacacgcatcataatgtgtgatgcgtctgccccttctgtcgtcttctcgcagccgta

SEQ ID NO: 490 - DNA, 1932 bp, Glycine max
  Clone ID: PAT_MRT3847_99501C.1
tccatgcgtccgcggacgcgtgggtcaatatccaccagtagttggatactggtcgtgctagctagcgggccaaagtagtgcctaagtcttcctcatatcttccaccctttggcttattagtgggagcaatacatatcattcattcagaggcaacaaaggagttgtaaattaagagcatggctgcacaagctcttgtatcatcatcatcatctcttaccttctcagccgaggctacaagacaaagtcttggaccaagatcactccaatctccatttggcttctcaagaaaagcctcctttcttgttaaggcagctgctactccccctgtcaagcaaggatcagacagacctttgtggtttgcatcaaagcaaagtctttcctacttggatggcaggtaaatttcatcctagttcatcaatagcttaacataacgatatgatcatgtctggatatataaacttctcatgagcacttgaagaataaaaaggtaaaatgaagtttatttcatgagttaaaacataattaagttaatttatagtagctctttcgcttaatttctccaataaacttatgaaagaaacttaattcattttattccgttcctgggaaccttgttcgaataacactagtgtatctatgcaatttagaagagaagtaaataattagttactatgctggtgctgaaattgactttatctggcatcatgtgcattgcagccttccgggtgactatggatttgaccctctgggactttcagaccctgaaggaacaggagggttcattgagccgaaatggctagcatatggtgagataatcaatggtcgttatgcaatgttgggtgcagttggtgcaatagcacctgaaattctaggcaaggctggtctgatccctcaggagacagcactcccatggttcagaacaggtgtattcccacctgcaagaacctacaactactgggcagactcctacacactgttcgtgttgaagaaaggtcctcctggataagctggctcaccagaacctccaagacccttctctagtcctaggaagtattgtttgcccatagagcctggtttggcccagtcttggaatcttctgtgctctgcctggtgccgaattcggcacgaggtcagacgaggagcaccacttcgagtcaaaggctgatgctggagcatcaaagacatttccccagcaagctggaaccatccgcaaaaacggttacattgtcatcaagaacaggccatgcaaggttgtggaggtttcaacttccaaaactggcaagcatggacacgcaaagtgtcactttgttgcaattgacatcttcactgggaaaaagcttgaggatattgtcccatcttcccataactgtgatgttccccatgttaatcgcattgactaccagctcattgacatctcagaggatggatttgtgagtctgctgactgagactggtggtactaaggatgaccttaggcttccaaccgatgaaaatctgctttcgcagatcaaggatggatttgctgagggcaaagatctggttgtgtctgttatgtcttccatgggggaggagcagatttgtgcccttaaggacattggccccaagtaatagagttgtgtcagttgaatatctggaaagcagaagttgaaactgagatgataaatagtatttattattattttttcacttttatgtgggtttgtatactaaatcagccaaagtttgtacctttcttacaagatgtggtcaaacttgaatggctttatttgggagtccttgacctactatatttttaaacgtgttggatcaatgctagaaccatattctgttaaatggtgtgaagttatattggtcactggccattaaatctatttatacgcttagaagaccttataacctttataataaatttttcttcattatgatgtttctt

SEQ ID NO: 491 - DNA, 226 bp, Glycine max
  Clone ID: PAT_MRT3847_99856C.1
cacccaacaaacactctctttggtaccaagcggttgattggtaggcgctttgatgacgctcaaacacataaggagatgaaaatggttccattcaagattgttaaggctccaaatggagatgcatgggtggaagccaatgggcagcagtattcccctagtcaaattggtgcctttgttctcaccaagatgaaggaaactgcagaagcttatctaggatagtcaattt

SEQ ID NO: 492 - DNA, 2020 bp, Zea mays
  UNSURE (1)..(2020): unsure at all n locations
  Clone ID: PAT_MRT4577_100006C.1
  unsure (1)..(2020): unsure at all n locations
caaactgatctacaatacatcaaatagntataagttctgtggagagactagggcagaattatatcgcacaaaagaaaggtactccatgaagctgcgcatgcttttagatgagcctactgcgcaaaaaatatggccctctcctatagacaaagctagctgtcgctttcttcccaactctcggacaccacttagtggattatgtccaggaactttacagaataagaagcttgatttgaaagctcaagtaagccatcaaggatttcaaaggagagatgctctaacttcttctgatcctcctaattccccacgaggatacaatcgggtaatgttattgctaggaagagacgagttcaagcacagttcaatgagcttcaagaatactacctgcaaagacgtcgtactggagcacaggcacgcagacaagaagaaagagatatcgttgcaatgaatagagaaggctatcatgcaggtcttcaggatttccagtctgtgctaacaacgttcactcgatacagtcgtctacgtgtcattgcggaactaagacatggagacttgtttcactctgccaatattgtatccagtattgaatttgatcgtgatgatgaactatttgctactgctggagtctcgaaacgtattaaagtcttcgaattttctactgttgttaatgaaccatcagatgtgcattgcccggttgttgaaatggctaccagatctaaacttagctgcctaagctggaacaagtactcaaaaaatattattgcaagcagtgactatgagggtatagtaactgtgtgggatgttcagacccgtcagagtgtgatggaatatgaagagcatgagaagagagcatggagtgttgatttttctcgcacagactcttcaatgctagtatctgggagtgatgattgcaaggtgaaagtgtggtgcacaaatcaagaagcaagtgtgatcaatattgatatgaaagcaaatatttgctcggttaaatataatcctggatcaagcttctacgttgcagtcggatctgctgatcaccatattcattactttgatttacgtaatccaagttcgcctgtccatattttcggggggcacaagaaagcagtatcatatgtgaaattcttatctaacaatgagcttgcgtctgcatcaacagatagcacattacgcttatgggatgtcaaggataactgcccggtacggacattcagaggacacaaaaatgaaaagaactttgttggcttgtctgtgaacaatgaatatattgcttgtggaagtgagacaaatgaggtttttgtttatcacaaggctatctcgaaaccggcagcaagccatagatttgtatcttctgacccggatgatgccgatgatgatcctggttcttatttcattagtgctgtctgctggaagagtgatagccctacgatgttaactgctaacagtcaggggaccataaaagttcttgtacttgctccttgatgttatggagggcgttcaagaggttcacagtactgtccagttgtttcctttcgtgtcattatattcccccaaaattgggaacgggggcataattgatctccggttagggaatgaagttttgcagatggtcagctgacgtagggttttgaggtatcagaatgtgcatagtcatgtttatgttgtataggtgtaattgtgtaaagcagccaagttattggttacaagtgtaacacgagaaatacacattaacaaaaaaaaaacctccagctcgtttgtacagagattgtgtttgaacccagaaccttatgtggtaattgcgattagtaatatatctacctgatatgatcagcaaaaaaaaaaaaaaaaaaaaaaaaaaaaaaaaaaaaaaaaaaaaaaaaaaaaaaaaaaaaggggggaagaaaataaaggaaaaaaaataagggaggcgggcatgcaaagaaataaattttttataagggggggggggcctttttaaatggccaaatttttaccccgtgggtacggaaaaaaccttttt

SEQ ID NO: 493 - DNA, 311 bp, Zea mays
  Clone ID: PAT_MRT4577_100058C.1
ccgcccttttttttttttcttgtgtccaacgtaagtgtcagtgcatcccatgatggcatacatacatattttgcgtacatacacatcacatgactggataaatacatatgtccaacgtattagtcagtgcaccccatgatggcacacatacatattttgcatacagtagacacatcacatgactggcaaatcaggcatagatctctcatctcattctcagtcagtatcaggaactatgaagtaggcctcgtcgactgagtcaggcacctcgatgcgtgacttcgtgaacaggcgcgctccgattctcgtgg

SEQ ID NO: 494 - DNA, 954 bp, Zea mays
  Clone ID: PAT_MRT4577_100095C.1
cgtgtcccccttcatcccacctcctcggggctccaggaagcgtctccagcccagatcgacaccgcctcccccttctccccccaccgccgcgcgatcccatctgacgccgccccggccgacgacccccgcacgccggccgccatggcgcacggcgaccgcatgaccaccttcgaggagggcgagcgcgagagcgagtacggctacgtccgcaaggtctctggacccgtggtcgtggccgatggcatgggcggtgccgccatgtacgagctcgtccgtgtcggccacgacagcctcatcggggaaatcatccgtctcgagggcgattcagctacaatccaagtttacgaggaaacagctgggctaacggtcaacgatcccgtgttgagaacgaaaaagcctctttcatgtgagttgggacctggtattcttggaaacatctttgatggaatccagcgccctctgaaaactattgctattaagtccggagatgtctacattccacgtggtgtttcagtccctgctcttgataaagatcagcagtgggagttccagccaaataagctaggtgttggagataatatcacaaatggagatctatatgctaccgtatttgagaacacattgatgaagcaccatattgcgctccctcctggtgctatgggaaagataagttacattgcccctgcgggtcagtacagtctgcaggacacagtgctggagttggagtttcagggcatcaaaaaggagttcactatgctccacacatggcctgtgcggacaccacggcctgttgcgtcaaaacttgctgctgacacgcctcttctaacaggacagcgtgtacttgacgcactgtttccctcggttcttggaggaacatgtgctattcctggagctttcagatgtggaaaaactagtattagacaggtgctctcacagtattccaattccgacact

SEQ ID NO: 495 - DNA, 321 bp, Zea mays
  Clone ID: PAT_MRT4577_100187C.1
ccgacggggaaagcaagttatacatattcgacaactaacttgctcctagcgtttacaaatgataatgaaattaggagagtcaacaagacaaaactgtttctggcaaagcacattgactcaccccatccgaatacaccattattcttcacgaaaagcaaacagttacttctcctgccacctgagttcatgcgattaccataagaaaacctgctacgctactgcctatatgataatgcatatgcatgcaaaagataactgacaggccagtgcagcgaacttcatagcacacaacggcccgagtgagctggaagccgggtgcct

SEQ ID NO: 496 - DNA, 192 bp, Zea mays
  Clone ID: PAT_MRT4577_100196C.1
gagaaatcaagttcgaaagcaactgtttgcatacatcaccatagagccggttggttttctgttcatcgcatgctcatcgcacctccagatgcaccacgaccatcacacacactcatgttttgtcatcacaagctaaacacactcccagcccagatgcacgtaaagaacacctgttgactgcccaacaaacct

SEQ ID NO: 497 - DNA, 1594 bp, Zea mays
  Clone ID: PAT_MRT4577_100216C.1
cccacgcgtccggcgtcccacgttgccttggttcccccaccctgctgtctccctccctccttccttccttccccgccactgcgcagcgcgagtgcggcgacagccagtcacacactcacactccctcgaccgctctcggccccgtccgcgtcgccgcagggcgaggaggcaatggcggcgggcgggaatggcgccggcggggacaccagggcggccttcgcgcggatctacaagacgctcaaggaggagctgctcaccgacccggccttcgagttcaccgaggagtcacgccagtggatcgaccgcatggttgactacaatgtactcggaggcaagtgtaaccgtgggctctctgtggtcgacagctacaagctgctcaagggcgctgatgctctgggcgaggaggaaacgttccttgcttgcaccctcggctggtgcattgaatggcttcaggctttctttcttgtgcttgatgatatcatggatgactctcacactcgtcgcggccagccttgctggttcagggtgcctcaggttggcttaattgctgcgaatgacgggatcatccttcgcaaccatatctcacggatccttcggcgccactttaagggcaaaccttactatgctgatctccttgatttgttcaatgaggttgagttcaagacagcttcaggtcagctgctggaccttatcactacccatgagggagaaaaagatctaacaaagtataacataacagttcacggtcgaattgttcaatacaagacagcctattattcattttatctgccggttgcatgtgccctgctgctctctggcgagaatttggacaattatggtgatgtagagaacatccttgttgaaatgggaacatactttcaagtccaggatgactatctggattgttatggtgatcctgaatttatcggcaagattggaacggacattgaagattacaagtgctcatggctagttgtgcaagcccttgagcgtgctgatgagagccaaaagcgcattctatttgaaaattatggcaagaaagatccagcctgtgtggcaaaagtgaagaacctctacaaagaacttgacctagaggcggtatttcaggagtacgagaatgagagctacaagaagctgattgcagacattgaagcccagccaagcattgcggttcagaaagtgctgaaatccttcttgcacaagatctacaagaggcagaagtagggtgctcttggataaacgagctcaggagtcgttactccttcgcatgcttgacataaccggacttcctcacctggttgctctagtatgatgtggagcgtctagttaaaaaaaatcgatgtagtatgaagcaccttgctgctctgaatattaacaggcaattaaggcaaggtgctgtttcggtttggtggaccgcatgttgcagataataaattagttgttttgtcaaaaaaaaaaaaaaaaaaaaaaaaaaaaaaaaaaaaaaaaaaaaaaaaaaaaaataaaacgctctgaagaaatgttcaaagaaaaaacgatccctctctatctctctctgtcgctgtcgctgccggccttccttgccttttctgtt

SEQ ID NO: 498 - DNA, 670 bp, Zea mays
  Clone ID: PAT_MRT4577_100218C.1
cacgtgcaatgctgatatatgaaatttctctatctccctcccttcaaacagatggttgactacaatgtactcggaggcaagtgtaaccgtgggctctctgtggtcgacagctacaagctgctcaagggcgctgatgctctgggcgaggaggaaacgttccttgcttgcaccctcggctggtgcattgaatggcttcaggctttctttcttgtgcttgatgatatcatggatgactctcacactcgtcgcggccagccttgctggttcagggtgcctcaggttggcttaattgctgcgaatgacgggatcatccttcgcaaccatatctcacggatccttcggcgccactttaagggcaaaccttactatgctgatctccttgatttgttcaatgaggttgagttcaagacagcttcaggtcagctgctggaccttatcactacccatgagggagaaaaagatctaacaaagtataacataacagttcacggtcgaattgttcaatacaagacagcctattattcattttatctgccggttgcatgtgccctgctgctctctggcgagaatttggacaattatggtgatgtagagaacatccttgttgaaatgggaacatactttcaagtccaggatgactatctggattgttatggtgatcctgaaatta

SEQ ID NO: 499 - DNA, 2070 bp, Zea mays
  Clone ID: PAT_MRT4577_100294C.1
ggccggccgggtgtctccgagggagtgcatctccgtgttcgcgattcagcgccgtgctcgacgcccctcctcccttcagaagtcagcgccgcatctccggttgcagagacttgcgctgccacctctccgcttttcgtccttcagttgctcgacgcccctcctcccctcagaagtcagcgcagcgtctccactctccacgccgtcgcgtcggcgacgcgggtccttcgaataagacggtttgttctcgcatcgggcgtcagccggattcgagggacatagatgatggaagtcgatcttgggtgccaccacgtcgaagcggcttgtgctgtgtagatccggcgaaagcgcgcaggcaaagcccgggtctgcgtcgtcattggcctcatgatcttcgtattgccatcgcgctaaagggaacgaaggcgacgaggtcttaaactttgattgatatatgcggatatgaaaatgcatgcaactacatgctagaagtctgtcttggttgtgttggagaaaaattctttgttacgtttttgttgatagtgttgagtgccaaaaatggagcttctccctgttgaagtcgttggcaacattctttcccatcttggtgttgcgcgtgatgttatgattgcctctgcggtatgccgcaagtggcgagatgcatgcaggaggcatctccgtttgctgtccttcaactccaatgactttccacgggacatgactacacgtcagttggagattgtcatcacacagactatatttcagactattgggctgcaacgcctttcgattcacattgataacacccatgagttctctgcagcaccagtgattgcatggctcatgtataccagggagaccctccgaagcctgtcttacaatgtcaggacaatacccaatgtaagcattcttgaaaagtgtggtaggcaaaagctcgaagtgctagatttggaattggaccataacaccatcacaggtgttgaaccaagctatcagaggttcacttgtctgaaatccctttccctgaggcatgtcagcattttggccttggatttgagccttttagttgctgcttgcccaagaatagagtcattagcacttgatgtccttgaggttgtcacttcagaattacagtctacgatggagctcacaagccatacattgaaaagtctatttgcaaaatcggtaggtgtagataagatcatacttgatgcagataatttggaagttctgcacctgaatgctttaaatctcgatctgtttgagcttaacgggaaaggaacactaaaacattttaagattgatgatgtcagtgttactcatttggatattggggacaatactgatcatttagaggcagtagacgtgagcaacttcacaatagtctggccaaaattctatagcatgatatccagggcatctaatttgcgtatgctacgattttggggtgttgtgtttgatgacgaggatgagatcgtggattcagaaactatagctgtttcatttcctcttcttaggcatctttcattgagttatgaattacgagatgggttacttcactacagccttcagggatcatcattactggagaatgtctcagttctggaacttggttggacagtaataagtgagcactttggaccctgggtatttggtatgattggaaggtgtccaaatctcaagaaacttgttattcatggtgttctttctgagacaaaaacgcgagaggatcgccagatgttagcaagctttacctcattcatagtctgtgtcatgaggaagtatgtgcatgttgatgtacaatttgagtatgagtgacagctactaggttgggtgggcatcttgtcattgttcagatgaagctgtgccatcagttgcttgatactgggttcttccacattgatccacatctaggcaatatgatcagaacacctgacggagattatgttgcagaactgtatcaactccctctaattttatgttatattatatttggtaggaatttctactgggtctgaaacttgtaacatacagttttctgaagatctacgaaagatagtggatacttatcag

SEQ ID NO: 500 - DNA, 4442 bp, Zea mays
  UNSURE (1)..(4442): unsure at all n locations
  Clone ID: PAT_MRT4577_100586C.1
  unsure (1)..(4442): unsure at all n locations
aattcggcacgaggcgagaccagagttggcagagccgtcatcaaacccggagtcacctcctgtggcaagatcagaagcgaagacaacagcaacatcggcagcagcagaaagcggcaccagcaccacccctgcggctgcccaacctgagacttcacgagagtcagagaaggcggaggaccgtggtagaaacagagactcagagctccggcccaacgaatcagatcggcgagatcacaggttggagagccaggctgtgccgccgtcgccgttgccgttgccgttgccagagcctccagtcaagccggatgctgaagcaaagccggtgagctccgaggccaggaacggcgaagctactgccacgacaaagattgagctggcatcggatggcgctcggcatgacaagaggttttccattgatctcatggctccccctcctgggaagctatctgatgatatagatggctcctccgaccctgatgcagataagaagggattggattctgagatggacatgttggggagaggaaattcggaaaagaaggctagtgaaaggactcggagaggactggatattgatttggaggaccagaaggtgcgaagaattccagtcgatgagttcgcgccgaagaagctcacactgcagttggatttggagaagcccagtctcggtgatgaaaagtcgccatcagagagacggcagccgcagccgcagccacaacaattgcagcagcagaagccctcaaaggctgagataaagcacgagaaatctgctatgcctgctgctgttacaccacctatgcctatacctgttggaggctggcttgggaatttcccaccgtttggttatctcagtccagtcccaggcctatcagcagctggtcttcatcatcccatggacgtgaaaccagggtcatctagtggattacatcattctgcattgcttccaccgccatcacgctcaaagagatgtgctacacattgctacattgcacaatttatccagcaccagcagcgagttgcaaagatgaactctttctggccgccaactgctgctgctgcagccgccgccgccgccaatagaccaccggggccattctttggtgcaaggccattcagcatgggtgttgtgccacccacggatgccgcctctatgcttgtgaacccaatgcagggaagctaccctgttagggcgcacactccgatgcaagaagcaaaggctcctatggctacatcaccattccaggggagtctctcgaaggacaaaacactaggcaatgctgctggtgctgaatcaagccagaggaaacaaccaccttctcatgaaacactgcagtccactcccttgccaaacatgctgcaagccccggcattcatctttccattcaatcagcagcatgctatggtggcagctgcaaatgctgccaaccgagcaggggatgcaaaatcatctggtgccggcaatacattgccgccatctgccagtgctcacactttggcaacaaactctggtgccgcggccatgaacttgagctttgccaacatgcaaccggctgatgcccagtttttggcaatcttacagaatggatacccgttccaggttgctgcccatcctggagggcctccatatcgaggcatggcaccgccaggcccagctgttccattcttcaatggtcatgtgtattcctcccccatgctgcacccatcacagcagcaaggtgcgcagtcacaaagtcatcagaagacccaaatgccaaacttgcccagttcatcacagaagcatcagccacaacagtcccaagggctattgggatatgcaccaaatgctaacgcagcagcagctgctagtaattcgcagaattattcaagtggcaatcagcgccctgtccttgcgcaccgacaggagagtgacaaaactggagaagatggtctatcgagtgatgacaagccatctcactctcagaagagtgggtatgaacacaattttgccgttccagtccatctaccgaattttgcaatgatgccagccgctcaacctgctgtcagtcagagtgagaagaagttaagtgaccaccaccaccagcagcagcagccacaagtcagccgaggccagggtgtgaggattgatcttgcctcttctcagccttttgtgatgccctttggctccattggtcctcctggatctaccccaagtggtcttgacttttcggcattggcgcagaaccatgcagttttccagagccatcaagatgcagcaaggcatggttatccccagcttaattttgctgcagctcaatccacgcagcacaagccccagcatggagaaacaaaatctgtcgctggggattcatccttgacacacattgccggagacagccagagaaagaaatcaacttctacaaagtattctggtgattcacagcagcattcgctgtccttcaccaggacagaaagcaagaatcatgtgcctcctttccttagtggcagcacaaatgaaagttcgtcccgaaccctaagccttattggaacagaatcttcaaatacatttatgggaagcaaatccacaaattccaccactcctgcctcaacaccacctgcagcttcgtctagcatttctcagcagcaccagcatttccttcagatgcaagtgcagcataagcatcagcatcagcagatgattcagcaccaccatttgaatcggcctagatctgccgcaccaagtacacaaaatagtgcaggtgggtacccagaccgtctcaatatggcgagctttcagaatatgatgtacccaccaaatgctgcccaaggccaagggagagttcaatccccccagttgaaggcatcctcagggagagggacaccttcatctactgctaccactccccctgctgctgcaccccctaatttgattgtgatgaagacaagtagtctccacccgcaacaagcaaagattcctatgcaggctctctccactcctggtcaccaatcccagagttctctaagcatgagttcatcaaaaatggctcctgtaactaacctttctactggaggaggggatctatctcgatcttcaaatgcccctgttgcttctggttcaccatccaattcggtgtccaaaagcactggtggcagcccgcctgccacaggaaatgcaaagggtgttcagcagcctgtccaattgccatcaccacaacagcagttagccaagaactctgtgtcgacgtgtggctccaagtctactcctgcaaaccatttcagtatggctatgccatctatccttggccaacagcctaattcatcgcctggttctaataccgggagcaagcagcagtcacatatgtcatcgtcaatgaaacagcagccgttccctcaaggccatttcttcatatccagcacgtatgctcctcaggctccaggagccggcggtgctgctgcccttggcctataccagaagcgaccaggcgacaagacacagccacaggcaccacaccagcagaacgccttgtcagccgctgctggcagtaacatgaaatcgcttcatccttcgtccggtggatttatgcatctcgcagcggcaacccagtctgcaggtggtggcatgccacacacccacatgcccgcggcgcaactgagtttcggaacaatgccggtgcctttaaaaccctcaagcgaccagaagcccgctgctggaaaataaacagagcccaggtgaccatgcgtcggagtggtaatctgagctggcgagctcaagtgcttatccagcggaagccccaaatggaggaggaaagatacaatgagaagagaaaagcaggccacagctcgaagaacctgcttttggttgctgctgtggtgatcaggaagggggaggaggggcactgcgaggacacgccttgctaacttaaaaggttgttcgggtctgggaatggctgatgtgagtgaatacttttgtgtagttttggctggttatccatcctcccatcccatggtgtaaaggtcggaggagtgcatagaatctgtctcgtagccccgttttttgtgcatggatggatgtcgaaggctgttctctccctctattctcttgtagcttctccagttcctcgtttcttttgggtggggggtctcagctttaaccggaggaggaaagattcaatcagaatgcagatctcaggtaactttgttatgcaactgatgctcccattacacactgtctgtcgatacactctgactggattgttttagtaccagcaagaagaggagaaaacaaaatctattccaactaaaaaaaagaaacttcccgccatgattggcgggggacaagatttggggtttggtgttgaaagaagctttggcaggggggtgggcgaaaggaaattaattaattaattcgaagtgcctttttctggnaccccccccaaaaaagaaaaaagaaaaaaaaaaaaaaaaaa

SEQ ID NO: 501 - DNA, 532 bp, Zea mays
  UNSURE (1)..(532): unsure at all n locations
  Clone ID: PAT_MRT4577_100678C.1
  unsure (1)..(532): unsure at all n locations
aaagaacaaagctccaanatggcacgaccatcttcagtgttggtgcttaaatttccatggccgggtgactgtcgcctccgtgaagaacttccagcttgtggccacagccggctctggtggtccatggggcgttggagacgaggaaacggtgatcctgcagtttgggaagatcgaggatgatgcgtttacaatggactaccggcagcctctgtctgctttccaggcgttcgccatctgcctcaccagctttggcacgaagctggcttgtgaataagtgattgccttgtttaccaattatatgttggggatcaaattgtaggggatagtctgaactagttgccctgagcccctgagatgggagaaaactggcgacaagaaacgggcagacgttgcccctagcttgacttcttgtgatcgcctaaacgattgatttatatgatgtgcgtctatgtgatttatatgatgtgcgtctatgttgttgaagagatgacgatgacttattgttgtaaatgacattcactcataatgcctt

SEQ ID NO: 502 - DNA, 849 bp, Zea mays
  Clone ID: PAT_MRT4577_100772C.1
cagggtatcatagagatggaaacggaggaagcctatgagatggtacttaatgatgtcctggggttcatgttgctctccaccccacgtgtcgactctcaactcccaaggtccctttttttttctcgatctggaagcgccgcagtagcagccatggacgtgagcggagcaggcggtaaggcgaagaagggcgcggcggggcgcaaggccggcgggccgacgaagaagtcggtgtcgcggtcctccagggccgggctgcagttccccgtcagccgcgtcgggcggtacctcaaaaagggccggtacgcgcagcgtgtaggcacgggtgcccccgtctacctcgccgccgtcctggagtacctcgcggccgaggtgctcgagctcgccggcaacgcggcaagggacaacaagaagacgcgcatcatcccgcgccacgtgctcctcgccatccgcaacgacgaggagctcggcaagctgctggccggcgtcaccatcgcccacggcggcgtcctccccaacatccacactgtgctcctccccaagaaggtggccgagaaggcggccaaggagcccaagaaggccgccaagtcccccaagaaggcgtagagtgatctcctgtcttagaacaatattaccattagcaatcgtgcagttagactagatcatgtttagtgtagatccgcaatgttcttgtccctgcagccatctggaacggtttatctagtacatccgtgcactttccttgctaattgcaaaaaaagcggtctaatcttttgtttaaaaaaaaaaaaaaaaaaagcggcctatgctcgttaatacacttatttaatatacaaaaaaaaaagcgcggcc

SEQ ID NO: 503 - DNA, 1660 bp, Zea mays
  Clone ID: PAT_MRT4577_100776C.1
ggcggagatcgagtcgagcgcccgccacggcgatggcggctagagtcctgccgccgccgctcactctcgtactcctcctgctgctgctcccgctctcagcccgggacaccgtcgccgcgggcgaggatttcccacgcgacgggcgggtgatcgacctcgacgagagcaacttcgaggcggcgctgggcgccatcgacttcctcttcgtcgatttctacgcgccatggtgcggccactgcaagcgccttgcgcccgagttagatgaagctgcaccaatgttggcagggttgagtgagcccattgttgttgccaaagttaatgctgataaatacaggaaacttggatcaaaatatggagttgatgggttccctaccctcatgctttttatccacggtgttccaattgaatacactggttcgaggaaggctgatcagcttgtccgcaatctgaagaagtttgttgcgccagatgtttctatccttgagtcagattctgcgataaagaactttgttgagaatgctggtacaagctttcctatgttccttggttttggggtgaatgactcattcattgctgaatatggaaggaaatataagaaaagagcatggtttgctgttgctaaagatttctctgaggacgtcatggtagcctatgaatttgacaaggttccggcgctagttgcaatccatccaaagtataaggaacaaagcttgttctatggcccatttgaagaaaatttcttggaagatttcgtacgacaatcccttctccctttggttgccccaatcaatacagagacgataaaaatgttgaatgatgatcagaggaaagttgttctcacaattatggaggatgattcagatgaaaattctacacagctggtaaagattttgagatctgctgctagcgcaaaccgtgatttggtgtttggatatgttggaatcaagcaatgggatgagtttgtggagacttttgatgtttccaaaagctcacagctgccaaagctacttgtgtgggatagaaatgaggagtatgagctcgtggatggttcagagagattagaagaaggtactgaccaagcatctcaaataagccaatttcttgagggatacagagcaggaagaacaacaaagaagaaaattagcggcccttctttcatgggtttcctgaattctctggtcagcttgacctcgctgtacatccttatattcgtcattgcccttctgtttgtcatggtgtactttgctgggcaagatgatactccacagccaagacgaattcatgaagagtgatggaagcttggggagcttcttgcacctgaagtgtaaagatggctaatgtaccaggagatgtagctcagaggttatagatttcaaactttcaacggacgcaagtcttgaagagtggatttggctattgatgctgagattcttcaatttctattggccacaccaacttctacatcctgcctatttatgtttctgttttgtgcccttcaatttgttctttaatttagagcttagaaattagcctctgcctgtgtattttagaaattgtccattccagagtccatttctgtgaaaatatatttattatcatactctgctactgaacgtttgtacaattaatacatgatgtatagactgttctggtgctcgct

SEQ ID NO: 504 - DNA, 2416 bp, Zea mays
  Clone ID: PAT_MRT4577_100777C.1
actgtgcggcgctcgccggggcgttcggctagttcattttcaccttgcaacagccgccgcatcgctggcgtctgggcgcttggtgtccttttcctttctctgtttctgttgttgcaccgcagtgagctgctctctgtgtattttcttcactaggaaactgagaagccaagtgtctgtgctgtattcttgccaccgtgatgcacatggacaagaaacagctcttggtctctattccttctctcttttcctgtgtttggccgaacgtctattcgttctctatttttttttgtttatttcttctttggttctagcagttggccgtccatcagttcaaaaaaaaatgagcactgtgggtgagtgatggctcaaaaaaaaaaaaagaaaaaaaaaaaaaaaaaaaaaaaaaaaaaaaaaaaaaaaaaaaaaaaaaaaaaaaaaaaaaagcgagcgcccgccacggcgatggcggctaaagtcctgccgccggctctgctctctttcatactcctcctgctgctctcgctctcagcccgggaagaaggagttccgtttccatacttccggcgcggcggagatcgaatcgagcgcccgccacggcgatggcgactagagtcctgccaccggctctgctctctttcatactcctgctgctgctctcgctctcagacctcgaggccggcggggggcccggggaaactagtcaagttcagtgcccccatacttccggcgcggcggagatcgaatcgagcgcccgccacggcgatggcgactagagtcctgccgccggctctgctctctctcgtactcctcctgctgctctcgctctcagcccgcgacaccgtcgccgcgggcgaggatttcccacgcgacgggcgggtgatcgacctcgacgacagcaatttcgaggcggcgctgggcgccatcgactttctcttcgtcgacttctacgccccttggtgcggccactgcaagagacttgcgcccgagttagatgaagctgcaccggtgttgtcagggttgagtgagcctattgttgttgccaaagtcaacgctgataaatacagaaaacttggatcaaaatatggagtggatgggttccctaccctcatgctttttatccatggtgttccaattgaatacactggttcgaggaaagctgaccagcttgtccgcaatctgaagaagttcgtttcgccagatgtttctatccttgagtcagattctgcgataaagaactttgttgagaatgctgggataagctttccgatattccttggttttggggtgaatgactcattgattgctgagtatggaaggaaatacaagaaaagagcctggtttgctgttgctaaagatttctctgaggacatcatggtagcctatgaatttgataaggttccagcactagttgctatccatccaaagtataaggaacagagtttgttctatggcccatttgaagaaaatttcttagaagattttgtacggcaatcccttctccctttggttgtcccaatcaatacagagacactaaaaatgctgaatgatgatcagaggaaagttgttctcacaattttggaggatgattcagatgaaaactctacgcaactggtaaagattttgcgatctgctgctaatgcaaaccgtgatttggtgtttggatatgttggaatcaagcaatgggatgggtttgtggagacttttgatgtttccaagagctcacagctgccaaagctacttgtgtgggatagagatgaggagtatgagctagtggatggttcagagagattagaagaaggtgaccaagcatctcaaataagccaattccttgagggatacagagcaggaagaacaacaaagaagaaaatcaccggcccttctttcatgggtttcctgaactctctggtcagcctgaactcgctgtacatccttatatttgtcatcgcccttctgtttgtcatggtgtactttgctgggcaagatgatactcctcagccaagacgaattcacgaagagtgatgaaagcttgttgggcttcttgcacctaaagatggctaatctaccgggagattagcttttgtattaattgtacaaaagcttcaactgacgcaagtcgtgaagagtggttttggcaatttggccattcatgctgagtttcttcaatctctattggcgacatcaatttctgcatcctgcctatttgtgtttctgctttgtgcccttcaatttgttctttaatttagagcttagaaattagcctctgcctgtgtattctggaacctgccattccagagtccatttctgtgaaaatatatttattattatcatactctgctaccgagcttttgtacaattaatacaggatatatagactgttctggtgctcgctaaaaaaaagaaaaaaaaaaaaacccta

SEQ ID NO: 505 - DNA, 476 bp, Zea mays
  Clone ID: PAT_MRT4577_101009C.1
attcggctcgaggtggtctcaagcggttggtttccgctggagggagctgcaatcctgtgtgcgcacttgaagacggtgcctcgagacgatggcccggtccaacttgcgacttgatatacatggtggtaggaaatgtgaaggatgaggccttgacattcaagacctgtctcacgatggatgctggggctagcttaaaacctctggaaccttcaacccgagcaagggatgcacactctgcgacctacgtcgactggtggatgcgcgggtcgctcaaaaagtccatcttcaagaattcatgactgatgcggttgccgcaaagtgtgtatgcactttcgaggaccgtgatcaaagctaggatggaatgcataatggacggcgagcatccaacgatcgacgtggtggtaaggcttgctggcatcacgattgaaatgctggccaaactgatagcgaaaaccaggaaagtacggtacatgcac

SEQ ID NO: 506 - DNA, 366 bp, Zea mays
  Clone ID: PAT_MRT4577_101107C.1
acgactccgcgccgcgtgcggacccggagggtcttcggggctcgggttcgcgggggagcggactcgagatggcgagggtccgatgttgagaaccggtggttgcccggcggcctagcctgcgccacggacgaccactccctccacaacgccttcagcacctacggcgaggcactggagtccaagatcattctcgatcgggagacgcagaggtcccgcgggtgcggcttagccaccttcttcacggaggaggcgatgcggaacgccatcgagggcatgaacgggaaggagctggacggtccgaacatgaccgaaaacgaggtccagtccctctgcgggcgtggaggcggcggcggtgggtacggtggt

SEQ ID NO: 507 - DNA, 1113 bp, Zea mays
  Clone ID: PAT_MRT4577_101123C.1
gttccttaatatggcccagtggtttgtgttattagttaggtgtttgaggtgctgggttcaatccttccttgggcctttttaaaaaaaaaaaaaaaaaaaaaaaaaaaaaaaaaaccgcaaggatccaccacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatgggcggcacggcggccgggactacgccgtgcccagcctgttctcaggtaatattttccgtgatccgcttagtgcgccgcacagcattggccgcctgctgaacctgatggacgacttggcggtggcggcgccaggtcgtgcggtgcgccgtggctggaacgcgaaggaggacgaggaggcgctgcacctgagggtggacatgccgggcctggggaaggagcacgtcaaggtgtgggcggagcagaacagcccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggagcctggaggggcactgccaaactaggattcctctctctcaatctgatctggattctggaatcagatttctcttctttcatttttctcgtctatcttctatcagtatgaaataagcaacgtcgcttcagttttcgtgtcaaggccggtggagtcgcctatgtttattttattttctttgtatttcctacctggacacacgttctctatgccgtgtttggtttccgcagatttttaaaatatgcatgttcaaacc

SEQ ID NO: 508 - DNA, 1188 bp, Zea mays
  Clone ID: PAT_MRT4577_101127C.1
gctcgaattccgttgctgccgcaacagcgaaggagaaagcagaccaacctagccacccagggagaaaggccaaacattgggtacctcgaggccggccgggaccgcaaggatccaccacaacagcgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgcctgctgaaccttgtggacgacttggcggtggcggcgccaggtcgtgcggtgcgccgtggctggaacgcgaaggaggacgaggaggcgctgcacctgagggtggacatgccaggcctggggaaggagcacgtcaaggtgtgggcggagcagaacagcctggtgatcaagggcgagggcgagaaggaggatagcgaggacgaggccgcccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggaggggcactgccaaactaggattcctctctctcaatctgatctggattctggaatcagatttctcttctttcatttttctcgtctatcttctatcagtatgaaataagcaacgtcgcttcagttttcgtgtcaaggccggtggagtcgcctatgtttattttattttctttgtatttcctacctggacacacgttctctatgccgtgtttggtttccgcagatttttaaaatatgcatgttcaaacccaaaaaaaaaaaaaaaaaaaaaaaaaaccaaaaaaaaaaaaaaaaa

SEQ ID NO: 509 - DNA, 899 bp, Zea mays
  Clone ID: PAT_MRT4577_101162C.1
ctcaacagcaacagctaagcctctcccacaagacagcaacatggctgaggaggaggccaagaaggtggaggtggaggtcaccaaggagcccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcctaagaagccttccaagtcagaccgagcagaaagtgaaaacgtcagccagtgattgcttggtcctctcgctctatcaagtgtgtagtgtgtcttcgaaagtttgtaaagcctactgctgctgctgtatatactgatatcgcttccaaggcaggcgtttggtggtgtacatgttgaatgcttgacgagaaacattcttgtgtgtagttaagaggtcacgctgttgttgttgttgttgacattcaagcagacattttgttctattctggtgttattgtttttgtgcccgtctctttgttccttgccgcggatttaagtttgtagtattcc

SEQ ID NO: 510 - DNA, 2335 bp, Zea mays
  Clone ID: PAT_MRT4577_101166C.1
aattcggcacgaggcagccactctctcctgtcatcctgtgtcctcgtcctttccacccaaaatccccgatcctcgaatcgattaaaccctaagcggcatggcgggtagcgactactgccggccggcagtgcgcccgcgcgacttctgagccaccggaagccgcccttgtcccggctccactgtcgccccacccatcactgggggagtgggagttcagagccgcagacgctgggcaaccgggaggacgcgaaggtgtggccgcaaccgcaagacgcaggcaagaggcaatcaactcaccgatgtctcagtcaccgggaggacgggaaggcatatattacagcaggcagaggaaaccttcggaacgcaacggcagtgtatttacacccatagctgcaacgtatcccagcggtcacgcacttcctgatgcaaacaggaaccacggtttggtatttggcggtacgagcaaggactgggacaacatccgtcagttcattgctagtctggaacgcgcctctgaaaactcctctgcgatagccagcaaaatcggaggtggcaaatcgaccaaccattccgtggagccagccgaacaaaaaggaaagggtgacataatagttctcgattcagatgatgctctccagttcaggcgtccagcttcgcccagagtccagacacggccaacagttaaacgcgccaccgccaccacgctcgcacgcacgccccacaggtacagctagacgcaaagacacacacccacgcacacacacactcaacagcaacagctaagcctctcccacaagacagcaacatggctgaggaggaggccaagaaggtggaggtggaggtcaccaaggagcccgaggcggcggcgaaggaggacgtagccgatgacaaggccgtcatccccgcgaccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcctaagaaaccttccaagtcagaccgagcagaaagtgaaaaacgtcagccagtgattgcttggtcctctcgctctatcaagtgtgtagtgtgtcttcgaaagtttgtaaagcctactgctgctgctgtatatactgatatcgcttccaaggcagaagaaaaaaaaaaaacgatggtgagcaaaacgcggtgaggaggtcctgaaggccgaggagatggctgccaagtaccgggccaccggccacgctcctaagaagctcatcggttgcttcggagcctaagaaaccttccaagtcagaccgagcagaaagtgaaaaacgtcagccagtgattgcttggtcctctcgctctatcaagtgtgtagtgtgtcttcgaaagtttgtaaagcctactgctgctgctgtatatactgatatcgcttccaaggcaggcgtttggtggtgtacatgttgaatgcttgacgagaaacattcttgtgtgtagttaagaggtcacgctgttgttgttgttgttgttgacattcaagcagacattttgttctattctggtgttattgtttttgtgcctgttgttaaaaaaaaaaaaaaaaaaaaaaaaaaaaaaaaaaaaaaaaaaaaaaaataaaaaaacgagtgagtacaacttgctctgcttaattctccctctgtgtagtggaaggcttgcgatggaaaggtggtgttggcgtactggtttctgctctaagaattctgagaagctttcctcctccctactctatgctttggttcgtggtctctgcacttcctggtagctgtacagtgggagtactaggtaggtactcagcacttgtgatccttgacagttggtttgcctttttcttttcatgggtttctggtttgttgttggccaactcatttggtccgactacttttcgcagaaaacaaaaattttcttctt

SEQ ID NO: 511 - DNA, 1914 bp, Zea mays
  Clone ID: PAT_MRT4577_101168C.1
tttggtgggtgtaccacaaatactagaagaatattcagttttgtagtcactagttttctttaaaattattttacattaactatgctggtgagtggtgacctggtcatggatcttcagaagaccaaccactttcattttctgaacaaaaagacaagagctctgccactctttgagaagaagagcagaagactgaccattgaatacttagaagttggaacactatgtcatcatttggtaattccttcctgaaagatctagagaggtttctatggttactatcaatactatctattgctttgtagttcgtgtagtgtagaataagattaatcctacgcatgcaagagtgtactactcaaataagagaaaggaaatctacaatctttctcactgaacaagctatgtaagcagaagttacgcaggacctggatatggacacaaataagttgaggattgcaaactcaagtgcatgctcctgcaaagataatagtatagcgacataaattacattttgctctgtgatgctaatgggttggattggatcattgatcagcatacaaccacttgctagcttctttcttccatataaaatttcagcaaaaactgtttatgaatctgaatttagtttttgcaccaaagcaggcataaattctctattttttttctccagccacgcgtccgaccaaagctagcctccgctccctccccttccagcttcgtctagacagagtccagcagacacggccaacagttaaaaccggttgctattagtacgcgccaccacgctcgcgcagacacacacacacacacacactcaacagcaacagctaagcctctcccaccaccagacagcaacatggctgaggaggaggccaagaaggtggaggtggaggtcaccaaggagcccgaggcggcacccgcgtccgccgcggaggcggcggcgaaggaggacgtcgccgacgacaaggccgtcatccccgcgaccgacccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcctaagaaaccttccaagtcagaccgagcagaaagtgaaaaacgtcagccagtgattgcttggtcctctcgctctatcaagtgtgtagtgtgtcttcgaaagtttgtaaagcctactgctgctgctgtatatactgatatcgcttccaaggcaggcgtttggtggtgtacatgttgaatgcttgacgagaaacattcttgtgtgtagttaagaggtcacgctgttgttgttgttgttgacattcaagcagacattttgttttcttctggtgttattgtttttgtgccccaaggcaggcgtttggtggtgtacatgttgaatgcttgacgagaaacatttttgtgtgtagttaaggagtcacactgttgttttcgttgttgttgacatttaagtcgatttttttgttgacagtatgtttctcaccttttccgatccccctgaatcgtct

SEQ ID NO: 512 - DNA, 1183 bp, Zea mays
  Clone ID: PAT_MRT4577_101170C.1
cccacgcgtccgcggacgagtgggaacacaccaaagctagcctccgctccctccccttccagcttcgtctagacagagtccagcagacacggccaacagttaaaaccggttgctattagtacgcgcccgccaccacgctcgcacagacacacacacacacacacacacacacactcaacagcaacagctaagcctctcccacaagacagcaacatggctgaggaggaggccaagaaggtggaggtggaggtcaccaaggagcccgaggcggcggcgaaggaggacgtagccgatgacaaggccgtcatccccgcgaccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcctaagaaaccttccaagtcagaccgagcagaaagtgaaaaacgtcagccagtgattgcttggtcctctcgctctatcaagtgtgtagtgtgtcttcgaaagtttgtaaagcctactgctgctgctgtatatactgatatcgcttccaaggcaggcgtttggtggtgtacatgttgaatgcttgacgagaaacattcttgtgtgtagttaagaggtcacgctgttgttgttgttgttgacattcaagcagacattttgttttcttctagtgagcaaaaaaaaaaaaaaaaaatttgcggagtgtgggcggccctcgcgagcttgtactgcccccggcgcctgcggtatatactgatatcgcttccaaggcaggcg

SEQ ID NO: 513 - DNA, 569 bp, Zea mays
  Clone ID: PAT_MRT4577_101249C.1
ccgctgctgagcggggtggcgtacgcgcagcgggtggtgcacgccgacagggagggcttcgagcgccaccaggggtggatcatcaagaccatgaagcacgagccgtccccggcgcaggacgagtacgcgcccgttgtatactcgcaggagaccgtctcctacatcgaggggctcgacatgatgtccggcgaggaggaccgtgagaatattttgaggtcaagagcatcggggaaggcagttctcactcgaccattccggctcatgtcgaatcacctgggtgtcgtattgacttttcctgtctatcatgcggatcttccttctgatgccaaggaggaggatcgtgttgctgccaccgcaggataccttgggggagcatttgatgtagaatcattagtggaaaatttgttgaggcagctagctggcaatcaggaattggtggtaaatgtttatgatgtcacaaacatttcgaaccctcttgtcatgtatggatcagaagttcctcttggcaacccctcatcatcgcacatctgcatgctagattttggtgatccattcagaaagcatcatat

SEQ ID NO: 514 - DNA, 517 bp, Zea mays
  Clone ID: PAT_MRT4577_101312C.1
gcccagtcgttcgagacggtggactcgctgagcgtcttccgggcgaagaactacgacgccaccatcgagttctactgggcgccgatgctggccgagtccaactccgcctcgtcctaccgtggcggcacgagccgggagatgctgcgcgcaacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgaattggtgcctgcatacatacgcctggaaaccaactgctaggggctagcccaaagaaaatgtgtctagatgaacaaagacatggggttcaaatgttttgttttgatttcggat

SEQ ID NO: 515 - DNA, 1864 bp, Zea mays
  UNSURE (1)..(1864): unsure at all n locations
  Clone ID: PAT_MRT4577_101314C.1
  unsure (1)..(1864): unsure at all n locations
tgggaccctcgaggccggccgggnaaaantactcgtcctgcccacgcgacgcgagagcgggagcggtgggtcgagggacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgctctaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgccgccgccgggtcagggcgaggaggggggcgggccgccgctgccgttcgcgttgggcgcggcgccggcgggctgcgacgtcgcgcagggcgagtgggtgcgcgacgacgacgcccgcccatggtaccaggaatgggagtgcccctacatccagccgcagctgacgtgccaagcgcacggccgccccgacaaggcgtaccagagctggcgctggcagccgcggggctgctcgctgcccagcagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactccagcttctggaagggcgccgacgtcctcgtcttcaactcctacctctggtgggtcgccggggacaagatccagatcctgaggggcgccgacaacgacccgagcaaggacatcgtggagatgaagtcggaggaggcctaccggctggtgctgcaccaggtggtccggtggctggagcgcaacgtggaccccggcaagtcgcgggtgttcttcgtcaccgcttcgccgacgcacacggacggcagagcgtggggcgacgacgacgcggagggcagcagcaactgctacaaccagacgtcgccgatcagcgccgcctcgtcctaccgtggcggcacgagccgggagatgctgcgcgcaacggaggaggtgctggccacgtcgcgggtgcccgtcgggctggtcaatatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaatgagctgctctactggaagctcttcttccccagcaacgatcaggtttagagatggcaatgggtacccgcgacccgatacccgatgggtatttactctattagggtatgtatgtgagctaaatattatacccatgggtctgttattggacaaaaatcttcacccaatgggtaaacgggtattagaacgttccgccttcacccatatccgttaacccgtgggtataaaatacccaatataaacttatctgaagcatgaacttggacttcagtcatccaacttttttactatttaacaacaatttaatgaccatgtaatggaacatgtaatgtgctatgtagtactatcatagtgttactactttattc

SEQ ID NO: 516 - DNA, 1869 bp, Zea mays
  Clone ID: PAT_MRT4577_101317C.1
aggccggtgtcgtcctgcccacgcgacgcgagagcgggagcggtgggtcgagggacgagctggaccccgccgctagtcccctacccctgcctgctcccccccgcctgccccgtgtttatatctgccgcgccgcacagggagagagtcgagtccagctcggcaggtcagtcagtagtggatagctccgctcgcggtcgcgggcggctcgagtcgcaccccagatcccaatgcgccccgccgcgccgctctaggccgcggaacggaagctaggtgcgtcacacgccggggccggtcgcggtcaccggaccggacgcacaggggcgccgtacgtgcagtcatcggccatgaaggtcctcgtcctcgccgtgctggcgctcgtcgccgccgcctccgccgctggtcagggcgaggaggggggcgggccgccgctgccgttcgcgttgggcgcggcgccggcgggctgcgacgtcgcgcagggcgagtgggtgcgcgacgacgacgcccgcccatggtaccaggaatgggagtgcccctacatccagccgcagctgacgtgccaggcgcacggccgccccgacaaggcgtaccagagctggcgctggcagccgcggggctgctcgctgcccagcttcaacgcgacgctgatgctggagatgctgcgggggaagcggatgctgttcgtgggtgactcgctgaaccgggggcagtacgtgtccctcctctgcctcctgcaccgggccatccccgacggcgccaagtcgttcgagacggtggactcgctgagcgtcttccgggcgaagaactacgacgccaccatcgagttctactgggcgccgatgctggccgagtccaactccgacgacgccgtggtgcactccgccgacgaccgcctcatccgcggcgcgcccatggacaggcactccagcttctggaagggcgccgacgtcctcgtcttcaactcctacctctggtgggtcgccggggacaagatccagatcctgaggggcgccgacaacgacccgagcaaggacatcgtggagatgaagtcggaggaggcctaccggctggtgctgcaccaggtggtccggtggctggagcgcaacgtggaccccggcaagtcgcgggtgttcttcgtcaccgcttcgccgacgcacacggacggcagggcgtggggcgacgacgacgcggagggcagcggcaactgctacaaccagacgtcgccgatcagcgccgcctcgtcctaccgtggcggcacgagccaggagatgctgcgcgcgacggaggaggtgctggccacgtcgcgggtgcccgtcgggctggtcaacatcacgcggctgtccgagtaccgccgggacgcgcacacgcagacctacaagaagcagtgggtggagccgacggccgagcagcgcgccgaccccaggagctacgccgactgcacgcactggtgcctccccggcgtgccggacacgtggaacgagctgctctactggaagctcttcttccccagcaacgatcaggtcctctgatggtgcattggtgcctgcatacatacgcctggaaaccaactgctaggggctagcccaaagaaaatgtgtctagatgaacaaagacatggggttcaaatgttttgttttgatttcggatatggacgctgtcgatgctcttgttctctgtggaattcttcttaccaactgtgcctcccatatatacatcactactgatactagaatctatgctgatattttctttcgttaaaaaaagcgacagtgaagcgtagaagcacctacaagagttttcaaaaaaaaaaagagaaaaaaaaaaaatttgaatcgtcagaaagtatcatagaaaaaaatcaacatccttttt

SEQ ID NO: 517 - DNA, 490 bp, Zea mays
  Clone ID: PAT_MRT4577_10137C.1
ctctcaccagcggggacttcggtatgtgaaaacaccaattcttcaactcctacagcgatccaccagtgcaactcgcagaatggcagtgttacctttatgacccttgtgcctgcaacactcatgagccctattacaacagtgacctttggtgcatttattgggacaaaacatcaggttttttcaactacaacaacttgtgctagcaaaccttgctgcctactgtcagtaacagcagattcttccattcaacacaactaggttcattgaactctgcttcttatttgcgacaacaacaactaccattcagccagctacctgctgcctacccacagcaatatattgcattcaaccaactagcagctattgaactgtactgcttatttacaggagcatcaactactaccattcatgcagctagctggtgtgagccatgctaccttgttgcacaaccacagatgatgccgttctaccaccacgttgcgcctaacgc

SEQ ID NO: 518 - DNA, 199 bp, Zea mays
  Clone ID: PAT_MRT4577_101478C.1
gcgctctgatcattaaggttatgtgcattcgattgctcgctggcattgccaggattgtgggtgctggggtatgttcatgatgttgtaagcttaatgaacggctggtaatggtatatgtagtaccaccaccctctgtaatctcagctgctgtggcaactttgactcttttcggaatactcacttgtactgcgtagaacag

SEQ ID NO: 519 - DNA, 141 bp, Zea mays
  Clone ID: PAT_MRT4577_101706C.1
agcgcaaggaaaaggctctcagcgttgatatggagcacaagcaaatggcaagtgatgagtttatgaggggagaacgtgcttatattcaacgtaagttgtaactcaaacgggatgaatgggagatggctatggaccaaaaac

SEQ ID NO: 520 - DNA, 1973 bp, Zea mays
  Clone ID: PAT_MRT4577_101720C.1
ccatcacgtcggcctcttccacggccgccgccgtcgtcgccgccgccgccacctcgccgccgaccaccataccatcagatatttcagagctcgcgcccctcacgcatggttcttggcttcttgcttcttgctcgacgtgcgccgtaactaatcgactataagcgtggtgacacgtctgacgagatgatgccggtggcggcggtggatgactggtcggagcgcggtttctcgctgacctgcgaggaagactgcgccgacctcggcaacggcgtcgtagacgacgacgagttcctcccgctctacaatgccggcgaagaggaggaagaggagtatttggagcagctggtgtttaaggagaccagcctctgctcctcctccgactcagccgcggactgcgacggcgacggcgaaggagacgaagaatacccctcgctcgcctctgaggagtggtttcggcaagctcgcctcgccgccgtcaagtggattcttgaaacccgcgggtgcttcggcttcggccaccggacggcgtacctcgccatcgcctacttcgatagcttcctcctccggcgacgcgtcgatagggaggcgatgccgtgggcggcgcagctgctgtccgtggcgtgcgtgtccgtggccgccaagatggaggagtgccaggtgccggcgctgtcggagttccacgccggcggctacgatttcgactcggcgtccatccggcggatggagctgctggtgctgtccacgctcggatggcgcatgggcgccgtcacgcccttggacttcctcccctgcttctcctcccgggtccacccgcacggcggcgccggcgccggcggccacgtcgcccacaaggccatcggtttcatctttgccacggctgaagctggtagcgtgcttgatcacaggccgtccactgtggctgcagctgcaatcttggctgcaacctatggacctctactgaccaaagaagcactcgattccaagatgagctacctttctccatcttgtcttattgagaaggaacatgtacatgcctgctacagtatgatggttggggacaataacaggagaggtagcaagagatcattgccatgttcaggctccaacgagattgccactagtacatatcattctgttcttgttgatgatgttacggacaccgccgccgcctttgccacggcggtatcggccaggaataagcggatcaggctggagctgacgggcatcagttgagaaagctagcaccaccggggacacagtttttagccagatgtctaggggggcttggtttgatcttccctttcattttcttcccttctttttgaacttatatgtttgcgaaaaagaagatatttttttaggttctttgagccattgccatgggttggcattggctgttgtcagatttgattggtttggtttgtgagaggtggaagagatgaacaaagcagagggctgagctttcctatggagaggagagcttaggttaataagcccaatgccagcgcccaaacagggcacacttcacattcagtgaactttacttcaaaggttgatgcaatgttgcattgcatgtggtgagagatgctgctgcagagaagatgcaaaacaagtggtaacaacactgagaggttgagggttttgccattgtttatagaacgagtgagcgagagagggagatgtttccctttttcacctgtgcaagtggatgtgagagtggtgtttcactctgcacttgcgagggttacatcgatttgtaacaaaccctgtgtacttgtgtaaccccctcttgttcctgaggaatggaatcagattgcgttttgcgtcaaaaaaaaaaaaaagaaaataaaaaagtgtccccacagccctgtagggttcgtgctcagttccgcgggccgccgcgcagctgctgtgccgctctgcccctgccggcggcggctggcccgtgccgttcaaggcaatcaacgatgaag

SEQ ID NO: 521 - DNA, 3389 bp, Zea mays
  Clone ID: PAT_MRT4577_101955C.1
gcaaagtgtttaaataatgcactaagattcgttagtaagtgtttaaaaatgcattccttactgtttagctcaattgttggtaaccagtttgtactatttgtgatttggttatatttattggtccagcttgacgaagttgatgaggcggcaattgaaaaggaagataatggaaagatggaggacatcgattgcaatcatgacatccggattcatgaagatttgggtcatgtatgccgtgtgtgtggtatgattgtgagaagagctgattcaataattgattatcagtggaaaaaggcttcaaggagaagaacgaatggctatggaggacattcaaaagatgctgatgagatagattgtggtactgttaaactgtctgaagatttcatagtcgcagatattgctattcatcctagacatgctcggataatgaaaccacatcagttgggaagggtttcaactttttggttaagaatttgattggagacaagggccggccggcgcttctagctccgcccacaggtacagggaactcccacccccttacagcaaccattcagcttctcctagcagacagcaacatgacttcggcacgaggccaaaaaggtggaggtggaagtggaggtcaccaaggcggcgccggcgaaggagaacgccgccgaagagaaggccgtcatccccgcgaccgagccgccggccgcccaggagaagccgccagcgccggccgacgactccaaggccctggccatcgtcgagattgcagataaatctactcctgagaagcctatcgctgagaagcaagggggctccagtatcagagatctcgctcttgcaagggtggaaacggagaagaggaactctctgattaaagcatgggaagataatgagaaggcaaaagctgataacaaggctactaagaaagtatctgttattctttcatgggagaacacaaagaaagcaaacatagaagctgaaatgaagaagattgaggaacaactggaaaagaagaaagctgaatatgctgagaagatgaaaaacaaggttgcaatgatccacagggaagccgaagagaagcgagcgatggtggaggcaaagcgcggcgaggaggtcctgaaggccgaggagatggctgccaagtatcgggccaccggccacgcccctaagaagcccattgggtgcttcggagcctaagaaatgttccaagtcacaccgagcagaaagtgaaaacctcaaccagtgattgcttggtcacctcacacccaaacagaaagacattatttataagttggaagcacatgatcggttcaaaagaaatgcagtagggagtgcactgtacattcatccatgtctttcagaactttcagaggttaatgctgagcatagggctaacacctttagagatgatttagttgatagtctggtagattctatcactgtgagagatggcgtgaaggccaattttttcatgaatatcctgtcacttgctaattctgcaggagagaaagtgctagctttcagtcaatatatatctcccatgattttctttgaaaggctgctggtgaagaagaaaggctggcatgtggggaaagagatctttatgatctctggtgatactagccaagaagacagagaattggcaacggaccattttaacaactctgctgacgcaaaaattatgtttggttctatcaaggcatgtggggagggtatctccctcgttggtgcgtcgagagttgtcattctggacgtacacctgaacccatctgtcacccgtcaagcgattgggcgtgcattcaggcccggacagcagaagaaggtgtttgtgtacaggcttgtagctgccgattctgacgaggtaaaggtccatgagacagcattcaagaaagaagtcataccgaagctgtggttcgaatggagcgagcactgtactacggaagacttcaaacttggtcaaattgatattgatgactctggtgacgaactgttggatactaaagcaatccgcaaggatatcaaagcgctgtatagaaggtaggtaacaagctttgtggccactggacaccatgtacatattgcagtgctgaccgtcgagctgatccttaaactgaagaaagaggtgacgggtgttgcggtggctacattgcgcggtcattcccagctatatccgtggaatggcggcttcttttgttcgtagtatgtgccaacttggggcagcagtcagctgatccccagacacatttctagactcttttttaggctcaagtttctgagaattaacctgctatggcgtttagccttaagtaaatatttcgttcgcaacaataataacccagtaaacctaatttgttcttgtgcgtttgtggtggtggttcttgaaatttacctggcgccttcttcctgggctagatgctatgcaggtgtcacaggttggtttgttggcatgtagaatcgggaaatgctaatctcgaaagctcgtagtttccttttcccccccgggtgacatgtttattcacctcttactagttaccacgtccatttccaactataagatatgatactttggcttttgaagatacattacttttattacgtatagtgtatatcgccgccgccgccggccgacgactccaaggccctggccatcgtcggagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcttaagaagccttccaagtcagaccgagcagaaagtgaaaaacgtcagccagtgattgcttggtcctctcgctctatcaagtgtgtagtgtgtcttcgaaagtttgtaaagcctactgctgctgctgtatatactgatatcgcatccaaggcaggcgtttggtggtgtacatgttgaatgcttgacgagaaacattcttgtgtgtagttaagaggtcacgctgttgttgttgttgttgttgacattcaagcagacattttgttctaaaaaaaaaaaaaaaggccggccgctcgcgatctagaactagt

SEQ ID NO: 522 - DNA, 633 bp, Zea mays
  Clone ID: PAT_MRT4577_102061C.1
ccggccgggatcgcacatatactcgagaccaactagcaacgtagaaagcacaatacgtcgaccaacaatggcagccaaaaatttcgcctccttacgctcgctggtctctctgcaagagctgctacggcgaccatcttcccgcactgctcggcaagctgctatagcttgccttcttcccccgtacctctcaccagaggtggcttcggtatgtgaaaacccaattcttcaaccctacaggatccaacaggcaatcacaggtggcatgctacctttatcacccttgctccttcaacaatcatcagccctattacatcaggtacctttgatgcattcattggcacaaaacataagggcacgacaactacaacatcttgggctaccacaccttgctgcctactctcagcaacagctgttccttgcattaaaccaactagctgtattgaactctgcttcttatgagcaacaacaacaactaccattcacccagctaactgctgcctacccccagtactttcttccattcaaccaaccgacagcattgaactctcctgcttatttacaggaacaacaactactaccattcagacagctagctggtgtgagccctgctaccttcttgatacaaccacagtt

SEQ ID NO: 523 - DNA, 639 bp, Zea mays
  Clone ID: PAT_MRT4577_102085C.1
ttgcggcacatcgttatggaatcaagagagtaattttacctgaaaggaacctgaaggacttatcagaggttccatcaccgattctctctggcatggagattctgcttgtgaaacacatcgaggacgtactcgaccatgctttcgaaggcggatgtccacttaaatcacgctccaagttatagcatccaactcgcctttgctatggatatttgcttcggaggatcatcgtcaacagtaccacgaatggtcaacagtcagaataagagcctagctctcttgccagcacaggtcttgacacgcccatttttgttaggcttcgcatctgaatgtgtatactggtcagaattcggagagcagtcagaagatctgctcgttcacctgctgggactcattgcatagtttctcgacaccagctgttgatgtttatgcacagatgcaacagaaatcagggaggaattacgctggttggtttctctgtcgtgggtgtatatatgtatgtatgcatgtaatctaatccagggaaatatagctacaacaaggttgtcaaaactaaagacatcgagaaacatcacacgtccattgggcttgggtgactttattataaatgtatgtacatataacccaaaaaaaaaaaaaaag

SEQ ID NO: 524 - DNA, 304 bp, Zea mays
  Clone ID: PAT_MRT4577_102318C.1
ccggccgggagcaaataagcacgacttgattcattgatgttagaagagatcgagccttcttttgaaccacaagggcgaggatgtcttgcaactgcggatcaagctgcggctgcggctcaagctgcacgtgcggcaagaagtaccctgacctggaggcgacgagcaccggcgggcaggccaccgtcaccctcgagggggggcgggagaagaaggccgcgccccgatttcgtccagggcgcggcggcactccgcgaggccccccacggctggagccgccggtggcaactggaagtgcgacccctgc

SEQ ID NO: 525 - DNA, 270 bp, Zea mays
  Clone ID: PAT_MRT4577_102583C.1
tagctacatcgaaagcacaatattgtaccaataatggcagccaaaatcgggcgcctcattatgctccttggtctttctgcaagtgcttcttcgtcgagcatttttccgtaatgttcacaagctcctatagcttcccttctttccccatacctatcaccagcgatgtcttcagtatgtgaaaatccaatttttataccctacaggatccaacaggcaatcttagcaagcaatttttaccttttatcacccctcgctgctataacccctttt

SEQ ID NO: 526 - DNA, 442 bp, Zea mays
  Clone ID: PAT_MRT4577_102590C.1
tttacgcgtccgcggacgcgtgggcgcgaggaagggcaagaaggcgaggaggaagaaggagctgaggccgttggacgtgctggacgacgagaacgacggagacgaggacggaggcggcggcgggtcagactcgacggagtcttccgctggcggctccggcggcggggagaggcagcgggagcaccccttcgtggtcacagagcccggcgaggtggccagggccaagaagaacgggcttgactacctcttccatttgtacgagcagtgccgcgtctttctgctgcaagtgcagtcccttgctaagctgggcggccacaagttccctaccaaggtgaccaaccaggtgtttcggtacgccaagaagtgcggggcgagctacatcaacaagcccaagatgcggcactacgtgcactgctacgcgctgcactgcctggacgaggat

SEQ ID NO: 527 - DNA, 185 bp, Zea mays
  Clone ID: PAT_MRT4577_102632C.1
ccaaaaaaaaacgaatcttatccataaacaaaaggggtcacagatattcctccatacgtacatgctcatggtggaagacgcagttgaccacctaaagctgaatacttacttattaagactgatccagcttgtggcaacatcggaagttcacatgcttacagacgacaaattttaataacaatagc

SEQ ID NO: 528 - DNA, 410 bp, Zea mays
  Clone ID: PAT_MRT4577_102752C.1
aaaagggagggggaaaatgaccaaattaaaaaataaggggacactctggcacgtccactcataatatatccaacgacccgcgccggccgggcggtttactcgctgcccggaccgggaggtagctttcgggaccccggggaaaaaaaccctggggcccaacagttccttgcccacctcggggggaaatgtgtcctaccggaggaaaaactccacaaggaggaacctgcccaccaacaccacaaaatttttcccggggcactgtttgttgtccaccctggggttctcggtctcacggccggtggaccagtacacgtactggaaaagcttgctgccctcctccccgaggaaacggtcgggcacaaaatccccgggggggtcccccaacacccgggggtccttgggggcccacg

SEQ ID NO: 529 - DNA, 1683 bp, Zea mays
  Clone ID: PAT_MRT4577_102819C.1
gcctggccgggaaaaaaaaaaaaaaaaaaaaaaaaaaaaaaaaaaaaaaaaaaaaaaaaaaaaaaaaaaaaaacgggcgggcttttttctctttcctcctgcctcctgcaagccacgcgacgccacacacaggatagcagggacggcggcgcggagctagggttttgatccgccacgccggctaggctgcaccatcccgacgaagccatggagagggagctactggagacgttcgatgcggccaagaaggcggccgacgctacggcaggacagggcgactcgccggaggctggccgctgcctcgacgcgctgcaccggctgcgcgacatacgcgtcaacaccgacatcctcgtctccacgcaggttggcaaacgtcttcgacctcttactaagcaccctcactcgggcattcaggcagtcgcatcagacctttttgggtactggaaaaaggttgtccttgaagagacaggaaagaaaaatgggagctcagagaatgaaaaatcaatggactcttcaggaaaggttgagaaggtgaggcccatgaaggttgaaaagaattctgcatcagcaagcatgaaggttgagaaaagagatgtggatgataggggtcagaagcctgacaatgtcaaagttgagaagaccgctagtaatggttccagaactcaatctgtgaaggtagaaagggtatccaaagaagtcaacagaactgatgcaaagaagccagcatctgtccccaatggccacccaaagcttacatctcttgtcaaatgcaatgatcctacccgagataaaatccgggaactacttgctgaagcctttgtaagggtttccagagagactagtgatgatgacagagacgaagtgaaaaacatcttggatgaagtcgaggcatgcgacccatacagggttgccgtgacagtagagtctgcactattcgagaggcttggaccttccactgggactcacagggcaaaatacaggtcaatcatgttcaacctgagggctgaaaacaacaccgatttccggaggagggtcctcatcggtctagtgaccccggagaggcttccagacatatcccctgatgagatggctagcgatgcaaggaagcaagagaacatgcagatcaaggagaaggctctgttcgactgtgagcgtggagcagcaccaaaggcaacgacggatcagttcaaatgtggcagatgtgggcagcggaagacgacttactatcagctgcagactcggagtgctgatgaaccgatgacgacgttcgtcacatgcgtgaactgcaacaatcactggaagttctgctgagtggcagccttgctaaagtgtttacttagttgtgctgagcacactatcctgctgtgatgtgtgtgctctgttagttgtgactgaaagttcgacagggcaggctgaacaactcagcttttttccccttttttaccccccgtaaactaggagcagttatcctcttcctctgtcaggcacccttctgattcattcagattgtactagtcgaacgcgtgaatgttgttgacttgatcgcatcgtcaccagctgtttaagttttgaatgttcttgggtggagttagaatagaatggtgccaagtcagaatgatgatggaataaaaaaaaaaaaaaaaaaaactcgagactagttctctctctctctctccctcgtgc

SEQ ID NO: 530 - DNA, 1760 bp, Zea mays
  Clone ID: PAT_MRT4577_102820C.1
cctccacaccaggccacgccacacacaggatagcgagcgggagcgacggcggcggcggaggagctagggttttgatccggcctcgccggctaggctgcgccgccccgacgccgaagccatggacagggagcttctagagacgtttgacgcggccaagaaggcggccgacgaggcggcaggggacggcaactcgccggaggctggccgctgcctcgacgcgctgcggcggctgcgcgacattcgcgtcaacaccgacatcctcgtctcgacgcagatatgcctcgtcgaatcgacggcctgtttcccctccctctcctctaagacgacgccgggtagacgcgcgcaagaaacagggccttcgtttggaactagatctattgagttcctgtctctattttgggtggatactggataggttggcaaacgccttcgaccccttactaagcatcctcactcaggcattcaagcagttgctgcagacctttttgggtactggaaaaaggttgtccttgaagagtcaggaaagaaaaatggcggctcagagaatgaaagatcaagtgactcttcaggaaaggttgagaaggtgaggcccgtgaagattgaaaagaactctgcatcagcaagcatgaagcttgagaaaagagatgtggatgttaggggtcagaagcctaacaatgtcaaagttgagaagactactagtaatggttccaaagctcaatctgtgaaggtggaaagggtatccaaagaagtcataaggactcctgactcgaagaggccagcatccgtccccaatggccacccaaagcttacatctcttgtcaaatgcaatgatcctacccgagataaaatccgggaactacttgctgaagcctttgtaagtgtttccagagagactagtgatgatgacagagacgaagtgaaaaacatcttggatgaagtcgaggcatgcgacccatacagggttgccgtgacagtagagtctgcactattcgagaggcttggaccttccactgggactcacagggcgaaatacaggtcaatcatgttcaacctgagggctgaaaacaataccgatttccggaggagggtcctcatcggtctagtggcgccggagaggcttccagacataccccctgatgagatggctagcgacgcaaggaagcaagagaacatgcagatcaaggagaaggctctgttcgactgcgagcgtggagcggcaccaaaggcgacgacggaccagttcaagtgtgccagatgtgggcagcggaagacgacttactaccagctgcagactcggagtgctgatgaaccgatgacgacgttcgtcacatgcgtgaactgcaacaatcactggaagttctgctgagtgttcagccttgctaaagtgtttacttagttgtgctgagcacactatcctgctgtgatgtgtgtgctctgttagttgtgactggaagttcgacagggcaggctgaacaactcaacttttttccccttttttaccccccgtaaactaggagcagttatcctcttcctctgtcaggcagcctcctgattcattcagattgtactagtcgaacgcgtgaatgttgttgacttgatcgcatcgtcaccagatgtgaatgttcttgggtggagttagaatagaatggtgccaagtcagacgatgctgatggattagtggtgctgtgctccatttctgtttccattgtctggatgaagatcgagatctatatcagatgatgcgctgtcccatttcggac

SEQ ID NO: 531 - DNA, 333 bp, Zea mays
  UNSURE (1)..(333): unsure at all n locations
  Clone ID: PAT_MRT4577_102894C.1
  unsure (1)..(333): unsure at all n locations
gcgtcggacnctacctccctccctctcccctctctccggcacaggcaatttagccctcgattcgaccccgagtcttgcgcccactaccgggattgcctgcgccaagcgcggatctgaacgctgcgatccaagtagtcgctcgaatccgccatgaaagaggccaaatccaatggcgccgacaaggccgatgccaagctggcggcgaagagcaaggtggcagacaagcccgccaagggcaagaaggggaaggacggcaaggaccccaacaagcctaatagggctcccagcgctttcttcgagttcattgatgaatttcacaaggagttcaaggag

SEQ ID NO: 532 - DNA, 396 bp, Zea mays
  Clone ID: PAT_MRT4577_102912C.1
gcccatcatcgctgttagcagtctcaccattataccgttctgccgtccctagagggcagaaagacccgttcaaatgcggcggccaaaggttgcatgcggaccaggcggtgagggtctgggcaagggtggagccaagcgccaccggaaggtgctccgcgacaacatccagggcatcaccaagccggcgatccggaggctggctcggaggggcggggtggagcgcatctaggggctcatctacgaggagacccgcggtgtgctcaagatcttcctcgagaacgtcatccgcgacgactgtaactacaccgagcacgcgcgccgtaagaccgtcaccggcatggatgtcgtttacccgctcaagcgccaaggccggagtgtgtacggctttggaagcta

SEQ ID NO: 533 - DNA, 303 bp, Zea mays
  Clone ID: PAT_MRT4577_102920C.1
gctaggcagctatacatacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccagcactgtgcggcaaggagaggagctcttgctgcgcctacggcatgaggggctattccgagaccatggatctgaagctgaagctggagccagcggccgctgtggaggcgtatgacgatgaagaggaccacggcgtgggtg

SEQ ID NO: 534 - DNA, 1694 bp, Zea mays
  Clone ID: PAT_MRT4577_102951C.1
actgtgtgcgcctttgcctctttgcgctctcacctgcccgcccgtcccgcctgcctcgccgcaagccgcaagcgcacgcgctcggctcgccgcgtcgggtcgccgcagggcgaacgaaaccctaggatcagggaggctccgggcatcgctgctcgacccccatgacgtcctgcgggtgtctgatgctcgagaaggtggagggcgacgcgtcggcgaagacgagggtgaaggccgcgccgggcgccggtgccggcgcctggtgcggctcgtgcgctggggactggcggggccggtcagaggccatcttccccatctacgtgatggggagctcgcgggagagcaccgtggcggcggcgcgcggcatagtcgactcccccgaggaccccatatgggttgccgtcaaggcggaggccaagtctgaggcagaaaaggaacctattttgagtagcttcttgtatgccagtgtgctgtctcatgattgcctagagcgtgcattgagcttcgtccttgcaaataggcttgaagatccaacattgcttgctactcagctaatcgatatttttaacgatgtcatgctgaataacaaagatatatgccgctccattcgccttgatgctcaggctttcaaagatagagatccagcttgtgcccaatatagttgggcactgttatacttaaagggctaccaatcgttgcaatcatacaggatagccaatatattatggaaccagggacgcaaagttttggcattggcactgcaaagccgtattagtgaggtctttgctgtggatatacatccagctgccaaaattggcgagggaatattgttggatcatggaacaggtctagtcattggtgaaactgctgtagttggaaactgggtttcattaatgcagggtgttacacttggaggtacaggcaaggaacatggagataggcaccccaagattggtcagggagctctaattggagccagtgctactatcctcggcaatattaatgtaggcgaaggtgccatgattgctgctggctcccttgttttaaaggacgtacctccccacagtatggctgtaggtaatcctgcaaaggtagttggttatacagagaaagaagatccttctttaactatgaaacatgatgcaaggagagattattttgagcatgctgccatcagattgagatgattgatacacctaatgacgagtcttctttctattcgtctgtggaatactgtggagtaaaaaaagttccaaatcgccttattggcaagaagttttgtggagttaaaaaaaggtttcgtcgtcttactcgcaggaaaccttgtgaagttaaaaaaaaaatgtttgacgaaacgcatacggatgccattccggacatttcgtcacaggcacaaggctggatagtcgatgagctctgtgtttccctttctgcccagacaaccaaatgaagatggaaaagggtcacccagggctccaaaatctagagtgtagacaagcatgtccttaatgcgccttaaattggtctggatggcacttttttgtgataaactatctatctaaaccattgactaatgtctactctactctcaacaagatcaattaattgtatatttgatattaaagttggaatgtttagtatgacaaatttaatattttaaaatagatatgcatgaaatttgatcttgatctttttct

SEQ ID NO: 535 - DNA, 381 bp, Zea mays
  Clone ID: PAT_MRT4577_102973C.1
acgaaagccaaagaacattttacttcatatatatttgcacatttcattgacagactttcagttgtgtttctttacatcgcggcgtgcggcaaatgtttcttccacactatattgataagaagaaaaagaggaggaacagcattagtaatcccatattttttgctgaaccaattctatcatcaaattcttttgttggtacataggaatacatttcacctgatattattacccgagctggccatactagttctgtatattgttttgcgctaggaattcttttatatgagattttatattgttatacactcttcattgggaaaacaattcataagacatttactaatattttttacaaagatattatattttctgttagcattc

SEQ ID NO: 536 - DNA, 1617 bp, Zea mays
  Clone ID: PAT_MRT4577_103013C.1
cccacgcgtccggcaagcacactgctcctccctccccagccgcagcacagcagagcagagccgagtttgctgctgctgacctgacaccatcgtgtgcccctctctcggtccagaaggacgcgaaccgcgctcgtagagtgtggcagcaatggcggtcgtcgccggagacagcgagtcgctgatgcagcggtgcaagccgtacgtggcgatgatctcgctgcagttcgggtacgccggcatgaacgtcatcaccaaggtgtcgctcaaccacggcatgagccactacgtgctcgtcgtctaccgccacgccttcgccacgctctccatcgcgcccttcgcgctcgtgctcgagcgcaaggtccgccccaggatgacgctctgggccttcctccagatcttcgtcctcgcgctgctcgggccggtgatcgaccagaacttctactacgcggggctcaagttcacctcgccgaccttctcctgcgccatgagcaacatgctccccgccatgaccttcgtcctggccgtgctcttcaggatggagaaggtgaacctgaagaaggcgaggtgcgtggccaaggtggtaggaacgctcgtgacggtggccggcgccatgctcatgacgctctacaagggccgcgtcgtcgagttggtctggaccaagcacatacacctccacggcccgcacccggacgccgccgctgctgccgccgccgccgacaaggactggttcaccggctccattttcctcatcatcgctaccctcgcctgggcgtccctcttcatcctccaggccgccacgctgaagaggtacgacgcgccgctgtcgctgaccaccctcatctgcttcgtgggcaccctgcaggccatcgtcgtcaccttcgtcatggagcgcgagccctccgtgtggaggatcggcttcgacatgaacctcctagccgccgcctacgctggcatagtgacgtccagcattgcctactacgtgcaagggctggtgatccagagccggggccctgtcttcgcctccgccttcagccccctcatgatgatcatcgtcgccatcatgggctccttcatcctcgcagagaacatctacctcggcgggatcatcgggtccgtgctgattgtcgccggcctgtactcggtgctgtggggtaagcacaaagagaacgaggagaaggagggagaggcggccatggagatccccgtggcgatcaaggccgtcgacggcaatggcaggatcatggagatcgtggagctggacgaggtgcagctggagaaagcccaggccaacaccaacgccaacgccaacgcggccgtcgccgtcacggcggtccccgcggcggaggcccggatgcagggcaaggacgaccaggcttaagctacaggagatgcgccgatcgacgggtcgatcgcgcgcgtgcgtcatcttagccctcctgtgctgtgcttttgtgcgtcctcttctcccccggccggcccatgatagatgtgttgtagtgtggggcgacctgatgctttaagctagcgacgggcagtagtagtgctagctgtagtagtgaagtggtgccaagatggaagctgaggaggatgcaatataatgatgatggggagttttgt

SEQ ID NO: 537 - DNA, 539 bp, Zea mays
  UNSURE (1)..(539): unsure at all n locations
  Clone ID: PAT_MRT4577_103148C.1
  unsure (1)..(539): unsure at all n locations
gggggaaacgtaaacaactaaacatgtaagtaaatcagagttgcatacattttttcgggcctcggcccacgatcatacacaagcccatgcatacccacacgtttacatacgatggattacgtagccccccttattcgggcattacacgagcgcatacatacgtacccccccacaaaacggggggcgctcgatttcactttacacacccacccgtagcacacggggagggacgacgatacgggaggatcaatcagccgaaaaaggggggcttttttttgccgccggcctcctgggcctccttgggggccttttttttttcggggggctcggggaaggcgaaacccccggagccgacggccgccgccgccggaaccttcttcttgatcttgggggggggcgcgtgctccgggtcctttttcgcctcgggcttttcgtaaagtgcgaaggccccggcggcgatggcgccggcctcgccgaggggctgcttgggcttgngctccttctcctccttcttgtactcgncgaactcgttctcgccc

SEQ ID NO: 538 - DNA, 226 bp, Zea mays
  UNSURE (1)..(226): unsure at all n locations
  Clone ID: PAT_MRT4577_103156C.1
  unsure (1)..(226): unsure at all n locations
tttgccattggttcagctgctcttgtgtctctggcgctttttggttcctttgtcatcatagcgggagggaatattttcgatgtgctctcccccaaccttttcattaatttnattgtttgagcccttcttccctattgattctctgccattaccatgaatagtgttggaagttcctccctaaacatggtggattatgtccacacacaattcaacaccattccttttt

SEQ ID NO: 539 - DNA, 979 bp, Zea mays
  Clone ID: PAT_MRT4577_103177C.1
actcgactccgcccagtttttccaccaggcgctgtacctggggggcgtcaccgccgcccccgctcggcccacgctccgcctcatgaagcagaacctcgcgttcctctccagcgtcctcaccgagcaggcccagctgccggccgtgctcgaggtgatgagggcctccgtggaggccttcctgacggtcgtcctcgctggcggcagcgggcgggccttcgcccgcggggaccacgccgccgtggccgcggacttcgcgagcttgaagcgcctgttctgcagtttcggggtcggggaggaggcggtcgagagggagacggtgcgggcggaaggggtgctggcgctcatggccgttccgacggaacagctcatccatgagttgctcggccactatgcttccactccgatgagagcggcgggtgacgagttaccgcagctgccgatgatgccgatgacgcccacggcgagacgctggagccggtccgacgccaacaccgtgctccgcgtgctgtgctaccgagacgatgagcctgccaacagattcttgaagaaaacctttaatctgcccaagaggaggtagccgattacgcagttctatcgccggcccataggatcggattggatctatcattcgcgacccaaagggcctgttcgtttctgttgggtttcacaaaaattatttcggctaatcaaaccttatataaattagacaagcaatctacgtaggaattgttccgagtgttcaattctctggaaccgaacaaggcctaatactttttttgaaagcacgttcttattatacacatgtaacaggaaacaggaaagcacgtagacggtggtgtaggtttggtgaggtgagaaacgggaggtcttgcattcctattgatttttcatcgatctgtgttgtttttatttacgccattggccgacattatttaatgatgtcatgagccatgtggtatacatgaaaaagctctccccc

SEQ ID NO: 540 - DNA, 861 bp, Zea mays
  UNSURE (1)..(861): unsure at all n locations
  Clone ID: PAT_MRT4577_103195C.1
  unsure (1)..(861): unsure at all n locations
cgttctcgactcatggagtctgatctccaccattttataaaggctaatgatgacttgacaaaggagcattaccaattctttctttaccaattactccgggctctgaagtacattcacactgctaatgtttatcaccgggacctaaagccaaagaatatattggcaaattccaactgcaaactgaagatttgtgattttggattggcacgagttgcattcaacgatacccctacaacaatcttttggacggattatgttgcgacaagatggtatagagctccagagctctgtggttccttcttttcaaagtatacacccgccattgatgtctggagcatcgggtgcatctttgctgaggtcttgacaggaaaacctttgtttcctggtaaaaatgttgtacatcagttagatttgatgactgatcttttgggcacaccatctatggatacaatctctcgggtccggaatgagaaagcaaggaggtatctgagcagcatgagaaagaaagagctgatttcattttcgcataaatttcccaatgcagatcctttggccttagacctgttgcaaaggcttttagcgtttgatccaaaggaccgcccaactgctgaagaggcattgtctcatccgtactttaaagggcttgccaaggttgagagagaaccatcctgccaaccaatcacaaaaatggagtttgagtttgagcgtagaagagtgacaanagaagacataagggagcttatatttcgtgagatattggaataccatcccacattgctcaaagactacaccaatggcactgaaaggacnacctttctatacccaagtgctgttgatcattttaggagcagtttgctcatc

SEQ ID NO: 541 - DNA, 642 bp, Zea mays
  UNSURE (1)..(642): unsure at all n locations
  Clone ID: PAT_MRT4577_103258C.1
  unsure (1)..(642): unsure at all n locations
cggtgccggattcccgggcccgctgaccccggagcaggtcgcggaccctaagagctacgcggactgcacgcactggtgcctgccggggctccaggacacgtggaacgagctgctctactccaagctctttttcccctgagttaaagggtttgagttgcgaggtgcacggtgaagttggggtctctctctggcattattggcacgctgcacaatactagttagcttggcataggcccagcagtctgaagatggatgctctgcctctgctgcggtagtttctcgggggcaaaccttccacgcggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacgcagtgcatgtataattgtatgggttaatgacgcagtgcatgccttgcggagtgggccggtagacaaacatttcggcggctggtcacttggtcagtgacccgttgatattattattattattggatctaatgcaacaaccagttctggtgttgaagtccaaaaaggacagnnnnnnnnnnnnnnnnnnnna

SEQ ID NO: 542 - DNA, 756 bp, Zea mays
  Clone ID: PAT_MRT4577_10326C.1
aattcggcacgagggatccactggccgccggttttctccagctggagagccattcgtgggcgtaggacgagagagaggatcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacagggcgtctaaaagaacaaaaaatatcctcactgaagacgggcagtcgtctgaatctgtaatgactgcattgcattcaggaagctcgctcgactgtgatgatggttccgatatttcctttgaagttgtcgttgccttgaaaggaagaccatcgcatcgcatg

SEQ ID NO: 543 - DNA, 1146 bp, Zea mays
  Clone ID: PAT_MRT4577_10330C.1
aaggatgctgcccctccacgcgccggccagctggagtgccatccgtgcccgcctcgcctgatggtggatccactggccgccggttttctccagctggagagccattcgtgggcgtaggacgagagagaggatcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacaggcgtctaaaagaacaaatgcctcaggtgctaacggctggcacaatggtggttgctgctgctgcagaaaatatccttactgaagacgggcagtcgtctgaatctgtaatgactgcattgcattcaggaagctcgctcgactgtgatgatggttcagatatatccttgaagttgtcgttgccttgaaaggaaggaccatcgcatcgcatgttatctgcatgagtggggctgacatcagtgcttctaagaagataaagactgggatagtcccattcgcggcattatattggtttaaccagatgtgctatccttgtgcatgtctgtacttcaaagtggctaacgcgaaatttgtatatataatagtgtatgcgctgcgttatcttcgttctaaaaatctgtattgtttcgttgctggcgctatattgttggtgtattatatatatgcacttagttgttatctctattctattaagaacataatatagacacatgatgctacc

SEQ ID NO: 544 - DNA, 1051 bp, Zea mays
  UNSURE (1)..(1051): unsure at all n locations
  Clone ID: PAT_MRT4577_103363C.1
  unsure (1)..(1051): unsure at all n locations
aaacggacgaccgagaccgcctgggcggatccgagttcggacggcccatcagagcatcagacgaccaccttcctgcccccattcgtttccgcatcggcgtatctcccggcggccggcaaaggcgctctcgacctccctgcggtgccggtacgacagtcgacaggatggcaatggccacatcagcatcgtaccctccacctcctccattttaccgattgtacaaaaaatttgagcaagatccctcatctgcaccagaacctccaccaccaattgatgaaccattcaaagccttgggtgttgattacacaggagatgttgtgattccaagcttggagagtcataatgtccgtcagctttatccaaagggtcccaatattgacttcaagaaggagcttaggaccctcaacagagagcttcaattgcatattttggagctggcagatatattagttgagagaccatctcaatatgctcgtagggtagaagatattacgctcatattcaagaacttacatcatcttctcaattccttacgacctcatcaggcaagggccacattgattcacatgcttgagagccaaattcggcaccgcaaggaagcaattgaagatataaagcagaggagggaggaagcgcaaaagatgcttggggaatcactgcttatcttggatggaagtcaaactaactaggctgacgccgtcaaggtagttggttcaagaccgattcttctatgagttagtgtgttagtagaatagaagacaagatgtgtctggattgttgtggtatcatctgttgtggcttgtggtatttccagctttgataactgaattttcttacttctatggtctatgttagcaaagttggattactttcttacttccattggtactcaactgcatcatgggttactttcttgtggaagtgtatattgtgagattgatgcctcgtggccagcttaattgaaaggttgttatatgctaaaaaaaaaaaaaaagcggccctcgagccntgggtcgatgctantttcccatggnaagatttctcgtcttaa

SEQ ID NO: 545 - DNA, 1752 bp, Zea mays
  Clone ID: PAT_MRT4577_103367C.1
tgggtacctcgaagccggcctggaaattcctacgagcacggcatttggaagtcatcctcgcccagtcgccccaccaccgcctccgtcgacggcgtcctcgcctccgccgcgctcgcctcaccgccaccgccaccacggccttcctcgtctcatctccgccgctggcctcgccctcgatacgctactgacggggtgcccctcgccgtcgacacgtgacctccgtcatttgcatctcagctccaagatctactccagatcgggtgcatgcatgcagctgctggcctgtagctggcagtggtgactggcaggctgatccggttggacacggagaatgggctgctcttggcaccaggattggcaccatcaccggcacgcttgtctccaatctccattgatataattgactccattcggcttggttgtttcagtgaagacaagaagtgacccagcaatttccattttcttgttcaggatggcaatggccacatcatcatcttaccctccaccacctcccttttaccgactgtacaaaaattttgagcaggatccttcatctgcaccagaacctccaccaccaattgatggaccattcaaagctttgggtgttgattacacaggagatgttgtgattccaagcttggagagtcataatgtccgtcagctttatccaaagggccccaatattgacttcaaaaaggagctaaggaccctcaacagagagcttcaattgcatattttggagctggcagatattttagttgagagaccatctcaatatgctcgtagggtggaagatatcacactcatattcaagaacttgcatcatcttctcaattccctacgacctcatcaggcaagagccacattgattcacatgcttgagagccaaattcagcgccgcaaggaagcaattgaagatataaagcagaggagagtggaagcgcagaagctgcttggggaatcactgcatatcttggatgcaagccaagctaactaggctgacgccgagttggctggttcaagactggttcttcttagttaagacttaagagagtgttagcagcttcgagcctgccttcagctacatgttgggttactttgttgtggaagtatagattgtgagattgatgcctcgtggctaaacttaatcgaaaggttctcatatgctactcccttcattctaaattattagttttattttttttttaaatgtattattatgcctatacataataatagctaagtattcagcaaattattagtttttttttttataaagcagtgagtgactagggtttttttttccagcctgtctgcataagttttgattatcatgtaatttagtttataaaaagtaagggtgaacttctgagctaaaacgatattcatcagtattaaataaatcgcgcaaaagcacaacactccagcatatgctgaagctgttatatatgtttcatcaatatttacatatgcttacctatagttgtgaaaatgggttgtgtctggacatgcttccttattgttcacaactgttgcaaaaaaataaaacagtgcattacgatttacgactttggcatagtaacgtggactatagccatttgtcacagtttacgactgcttgctacccatgttcggttcgctcttaactcatgtggattgagttggcttaaaccctaagggctagtttaggaaccttatttttctatgggatttccattttttaaaggaaattagtttattttcccttggaaa

SEQ ID NO: 546 - DNA, 497 bp, Zea mays
  Clone ID: PAT_MRT4577_10366C.1
tatctcgagaacgaggccttagcttatttctgggaagcgccccacatcagccaaaaaacatcattattgaacatataactcataagcaatctaaaagagggcaccaccaatgatggtttgtcggtagaacgctgctgtgttagacaaagcatgttggctgaatggcagtaatcgttgcagttgtaagagggtgccaacgctaggcgcatagcgcgagtaaaacaacaacaactgttgctgtgtcaagaacgcagcatggactcacatcacttaactggctgaatggtggtagctgctgttgctgtaaataagcagcatagttcaatgctgtcagttggctgaatggaagtaattgctgggggtaggcagcagctagctggctgaatggtagttgttgttgcaaataagcagcagagttcaatgcagccagttggttgaatggaagaaactgctgttgctgagagtatgcatgaatgctttctagcacaagatgttgt

SEQ ID NO: 547 - DNA, 940 bp, Zea mays
  Clone ID: PAT_MRT4577_10397C.1
gtgtggtgtgtgtttatttttttgtttttttttttttttttttttttttttttttttttttttttttttttttttactacagctggtttgtttttatttattcactcgcacaacacaacatactgagccaggaagctcaccgaacagcgcaaagtacatacgatacgaggaccacgaaacactgaacagcacacgtacacacacaccaaacataccaaagcagagcaaccacacagcacacacacacgagtcgcgtcgctgaaacccaagatccgacgccgcgacgcgaacgcgacgcgaccattcacctcccgtccatgtcttcttcagccggagatctggatgctcttcacctcgggctttttgacctcggccttgggcacggtgaccgtgagcacgccgttctccagcgcggccctcacctcctccgtcttggcgttctccggcaggcggaagcgccgcacgaactggccgctgctgcgctccacgcggtgccacttgtcgcccttgtcctcctcctccctgctgcgctgcccgctgatgagcagcacgttgccgtcctccacctccaccttcacctcctccttcttcacgccggggaggtcggccttgaacacgtgcgcctcgggcgtctccttccagtcgatgcgggcgctggcgaaggcggcggtctcggaggccgccgccgacgacgacgacggcacgatggagcggaacatgctgtcgaacgggtcgaagaggtccacggagaatgggtcgaacacgctgctgcgcctcaccagcgacatttctgcttcgttgctagcggcttggtgcgtgcgagtgcgaactgcggaagtagagctgtgtcctgtggattggaggatttcagtgcgcgtagcttgctgtgatggcgattcttcgctctggattggatcccggccggcctcgaggtacccaa

SEQ ID NO: 548 - DNA, 372 bp, Zea mays
  UNSURE (1)..(372): unsure at all n locations
  Clone ID: PAT_MRT4577_104004C.1
  unsure (1)..(372): unsure at all n locations
actaagaaaacataaaaaaaagggggggntttttgggggcaccaagaggcaccattttttccttaggattaacttaaaacaaatcctgccgggggtaacagtatccaccgatccacatgccatgctggttgacgcaagggtctgctggagccggggatgaacacagcattaacaactgacacagagcgaccttgcaatcaaaaacccagaggggccacaccaaacgagacgaacgaagataaaccctctggactagggaaaacaccaggggggggaacaggataacttggccgggcgggccccaccgttaagttcctccaattcccgtcggagttgccctaaccccccccacggttgtcacggacgaatccg

SEQ ID NO: 549 - DNA, 1873 bp, Zea mays
  Clone ID: PAT_MRT4577_10400C.1
cacctttccctttttccccttccacctcccctcccctcctcgcggccggccggggttcccattaatatctagccgcctctccccccgtctcttctcctccaaaactgtgagcgagaagcagggagtgcgctcgacggccgccgccattagtgatttagtgttgaagagggagagaatctaaagtgaccggacgctgtccttccttgctgatcggcgacacggtccatccctccctcgctcgctagggttccttttcgtccatggatcagagcttcgggaatctcggggccggagctgggagcagcagcgggggctccaactccaaggcggcggcagccgccgtgtcctcctcgtctttcctgcagctgccgctgtcgacggcgtcccccgcgtactacggcgcgccgctcgcgcttctgcaccacgccgccgcggccccgtcgtcgtcgcagcagcagcagcagcaccaccaccaccagtacgccaggcacggcgccgagatgtcggcggcggaggccgaggccatcaaggccaagatcgtggcgcacccgcagtactcggcgctcctcgccgcctacctcgactgccagaaagtgggcgcgccgccggacgtgctggagaggctgacggccatggcggcaaagctggacgcgcgcccgccgggccgccacgagccgcgcgacccggagctggaccagttcatggaggcgtactgtaacatgctcgtcaagtaccgggaggagctcacccggccgatcgacgaggccatggagttcctcaagcgggtggaggcgcagctcgactgcatctccggcggcggcggctcctcctcagcgcgcctctcgctcgccgatggtaaatcagaaggggttggctcttctgaagatgacatggacccgaatggtcgcgagaacgatccgccggagattgacccacgagcggaggacaaggagctcaagtaccagctgctgaagaagtacagtggctacctgagcagcctcaggcaggagttttccaagaagaagaagaaagggaagctcccaaaggaggccaggcagaaactcctccactggtgggagctgcactacaagtggccgtacccttcagagacggagaagattgcgctcgcagaatcaacgggcctagaccagaagcagatcaacaactggttcatcaaccagaggaaacggcactggaagccgtcggaggacatgcctttcgtgatgatggaaggcttccacccgcagaacgccgctgctctgtacatggacgggccgttcatggccgacggcatgtatcgcctcggttcatgaactacacttccatggacgactgtgggggcctatccaatcgtcggaccgtgggagtatatttcagtgttgcggtgcaaggacattggataggcccccgcagaacgccgctgctctgtacatggacgggccgttcatggccgacggcatgtatcgcctcggttcatgaactacacacttccatggacgactgtgggggcctatccaatcgtcggaccgtgggagtatatttcagtgttgcggtgcaaggacattgttgtggaatttttgttgctgattgccaaggggtgggtcggtcgatgtagcgtctatgcatggcttgtagttctcctgtaatgttgttgttaatttccgcttggcggcttgtaatctaggtgtatctctggaacttgaatcctgggtgattaatccggcaagcagctgcctgtttgtatgattgtatggttcgggttggtggaacatgatgcatgctaaggcgtggcctgtctggatcaaaaaaaaagaagatgtcttttgtaccagtggaatgattggaacttcagattgctgaacatttccgatct

SEQ ID NO: 550 - DNA, 1438 bp, Zea mays
  Clone ID: PAT_MRT4577_104121C.1
gtcacgcgtggcgggagccctcaagtccgacgcgctccgttcccctttccctttccgaagcttctcgaccccccatcccctccctgacatggccgacaacgcgaaggccgcggcggcgcatgcgaggccggagtcgtcgcaggaggaggaggaggactggaaggaggccgagggggacgtcgccgaagtcgaccgcgccgccaccaatggcgccggcgaggggggcgtgcccacagacaggccgatccgggtctacgccgacggcatctacgacctcttccacttcggccacgccaagtcgctggagcaggccaagaagtcgtttccaaacacatatcttcttgttggatgctgcaatgatgagttgacacataaattcaaaggaagaactgttatgactgaggatgagcgatatgagtcacttcgtcattgcaagtgggttgatgaagtcattccagatgctccatgggtggtgacagaagagttcttggataagcataacattgattttgttgctcatgattctctgccgtatgctgatgctagtggagctggtaacgatgtttatgaacatgtaaaaaagcttggtaagtttaaggagactcagcgcactgatgggatatcaacatcggacattataatgcggattgttaaagattataatgagtatgttatgcggaatctggccaggggctacactagaaaggatcttggtgttagttatgtcaaggaaaaacgactgcgagtgaacatgggacttaaaaacctgcgtgacagagtgaaacagcaccaagaaaaagtaggggagaagtggagcacggttgcaaaactccaggaagagtgggtggaaaatgcagaccgctgggtggctggtttcttagagaagtttgaggaagggtgccactcaatggggacagccatcaaggagaggatccaggagaggctcatcaaggcacaatccagcgactttggcagcctcctacagtacgacagctacgattctgatgaagccaaagaaaacgacgaggacgaagacgaagatgaactctttgaagacgtcaaggaatagcacctccgtacatatacaatggttttgtagctgcaaattgtgttgtgagtcagttgcctctctctggttggtgatctttatatatggtctcaaaggtaggtcaggttgcaatgtttgtagctgctcttggtgtttgttcaggcaacgcatggttgtaaaagctgtggaaagactcttgtgcagtcaaggatacagattccgatggttacctttgggttagaacatatacggctgtaaaattggaagtcgaggtggttaaaactctgaaatcttgtctgttttccttcccctgtgcgtgctcagaaacacagcggaactcctgggcggcaaaaaagaaaatccagtgcttttggaccgggtaattaatag

SEQ ID NO: 551 - DNA, 214 bp, Zea mays
  Clone ID: PAT_MRT4577_104216C.1
tgttgtagctgtcacgtctgctatgggggaggagcagatctgcgcgctgaaggatgttggccccaagaacttccctgccttggaatgctgtgtctgaaaacctaaatcgaaaaaagaaggggatgaaggattgctacagagacatgcatctggcttgagctggcttgtgctatgggaaacacaagggcagggatcgctgggtggtgcaccgtgg

SEQ ID NO: 552 - DNA, 1591 bp, Zea mays
  Clone ID: PAT_MRT4577_104403C.1
ccggccgggacacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggaggagggcacgtctgcctgggcgtaacgcatcccggtttcgcgataccccctcctcgagccggccgggcctcccctccggtgaagtcggggcaacgcgcatcactcgctttaaatccggacctcccggcgtctccctcctcccggccggtccccttatcacctcaccttctcctctgagtcctctctctccgccgccgcagctagctgtgacgttatgctctcgccggcgccatagcgccagcgcctaccgtctacaactatccagccttaggcttacctatcccgtcaatcaagcctctcgtaaggaacaaggaaggtagctagctagttcgtcatcggcggcggcggcgcctgttcttagaggataaggttgtcgtagcggagagggagctagccaggattttggttgagatcaggagggggagcaggcggcggcggcggcgatggggcgcggtaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagtagaatctgaaactcagggcaattggtgccacgagtatagaaaactaaaggcgaaggtcgagacaatacaaaaatgcctgcaggcacctcatgggagaggatcttgaaactgtgaatctcaaagagcttcagcaactagagcagcagctggagagttcactgaaacatatcagaaccaggaagagccagcttatgctcgagtcaatttcggagctccaacggaaggagaagtcgctgcaggaggagaacaaggttctgcagaaggagctcgcggagaagcagaaagcccagcggaagcaagtgcaatggggccaaacccaacagcagaccagttcgtcttcctcgtgcttcatgataagggaagctgccccaacaacaaatatcagcatttttcctgtggcagcaggcgggaggttggtggaaggtgcagcagcgcagccacaggctcgcgttggactaccaccatggatgcttagccacctgagcagctgaaggtttccttgcccaaaattcagcaactcttccccgtttatccgcctggtgcagtatagtatcatcgtgatcgcgagtcagcagcagtgggtttgccgtatctttttttttaccactgtatgtctatatgtaagtatcaaatctgcaatgtgttaatcaccatttccgctggggcggacgcacgagtatcaaatctgcaatgtgcagcatcaaatattccattttcatgagcataaaaaaaaaaaaaaaaaaaaaaaaagcggcc

SEQ ID NO: 553 - DNA, 1974 bp, Zea mays
  Clone ID: PAT_MRT4577_104555C.1
aataactgatttttgaaaggggattggtgaataatgaccatcctcctcagcaagcataaagaagatcgtccttcgcagtcgcagcaagcattccggctctgcatctggcccagctctgggttgcgcgaacagtcggaaccctaattccctccccggcgccggcgccggcgccccctagctgcgcccccacgaccagcagaatccagatcgaagttttgctcttgccgcggccccgcctaaactccaaaagtgcgaaccccctaactcatcgatcccagcctgcctccgcctacgcgcctcgtgacggcgtggacccctcccctatctgcgtgctgcgcgcatccgcctgcggcctgtcccgtgcagccgtgcctcctccgcgcacatctccagggtctagccgagagcagaccgccgtgacgccaccactcgcgctcgcgctcctgacatcgttgtctgccttctctgtctaagatcagagcagagctccatcgaaagcgtcgcccgcctgcttggatgatcaatcaccacgaaatagtgcagtttgggaagctgtacaatagagacatggaatcagctcctgctcatacccctcttatacatggtcttcctgatgaggtagctctcatttgcttggcaagagttcctcggcggtatcataatattctcaggcgtgtctcaaggagatggagagctctgttatgcagtgaagaatggcacttgtgccgcaagaggaataacttggacgagccgtggatctacgtaatctgtagggaagcaggcatcaaatgctatgtgttggctccagatcctccaagccggtgctttcgaatcatgcatgtcattgaacccccatgctcagggaggaaaggtgttaccattgaagctttagacaaaaagctatttcttctgggtggctgcagttccgtgtatgatgctacggatgaagtatattgttatgacgcatcctcaaatcgctggagctcagctgctccaatgcctacagcaaggtgctattttgtgtctgcatcccttaaggagaagttgtacataactgatggatacggcttgacggacaagtcaccaaattcatgggacatctatgacccggccacggactcgtggtgcacccacaagaacccgttgctcacccctgacatagtgaaattcgtcgcattgggcgaggagctggtgaccattcaccgagcggcgtggcacaggatgtactttgccggcgtatacgacccgctggaacgcacctggaggggcagagggaacgagatcgctctctgctactcgagcccgacggtggtcgtggacgggacgctgtacatgctggagcagtccatgggcacgaagctgatggtgtggcgggaggacgccaaggagtgggccatgctcggcaggctctccgacaaggtcactagacccccctgcgcgctcgtggccatcggcaggaagattcatgtggtcggaagagggctgagcatggtcaccgtggatgtggacacggcggcaagggtggacgggttcctggttaccacctctgtaggcccgttggtggaggaagacctgaccccggagaggtgcgtggtgatcaccatctgaaggggtgggcgtgtccaagcttccttgacgccgggtgtattgtggtaactgtgactgactatcgtcgctggcgccgaacatttggctagctagcgtggatgatatatactgcgatgtgagtgaattcaataagaggcttggctctccatacagccaataactatagttagcatttgtatctcgtgttgtttgggctgcttttgtcgactgctggctgtaagaacaatatttgagcttcgtttgttgagtactgtgcgtcccagatggatgggattaatacaagctaatgtgatcctaaaaaaaaaaaaaaaaaaaaaaaaaaaaaaaaaaaaaaaaaaaagaaaaaaaaaaaaaaaaaggccccta

SEQ ID NO: 554 - DNA, 291 bp, Zea mays
  Clone ID: PAT_MRT4577_104608C.1
cgcgcttcttcaaaccaaactgaaccgtgttggagcactagtgcacgacgggggcagcacgagatggtggggacggcggaaggcggcgcggatagggcggtgcggcggtgggtggacgccgtcggcaaacgcctggtactggactgcaggctggccacggagctctagatcaactgcgccgacctaaacgacacagtatggagcgccaagtgccttatctcctcctcggacctcatacgcaaggtccatatggactacctagaaaccggggcgaacattataattacagca

SEQ ID NO: 555 - DNA, 282 bp, Zea mays
  Clone ID: PAT_MRT4577_10482C.1
ttgagaccaactatcaacatagaataaacaataccgtaccaacaatggcaggcagaatattttgcaaacttatgctccttggtctttctgcaagtgttgctaccgcaaccattttcccacaatgctcacaagctcctatagcttcccttcttcccccatacctctcaccagcggtgtctgcaatgtgtgaaaccccaatagttcaaccctacaagatccatacatgcaatcgcaacaagcattttaccattatcacccttgaacctataacaactcattgcc

SEQ ID NO: 556 - DNA, 149 bp, Zea mays
  Clone ID: PAT_MRT4577_10491C.1
ctacaccctatagagagtcgtattaaagagtttgaggcaggccgcgtgcgctttcagtgggtgagctgaagcagtcagctggagaggaggaatccgcaggacttcaataagggaagtcgggaggtctgggtgaggtggccgtttcgtca

SEQ ID NO: 557 - DNA, 282 bp, Zea mays
  Clone ID: PAT_MRT4577_104966C.1
cgcgccggcgctccgacggctgccgactaaaccagaccatcaaacaagtgccagcgccctggggcaggcgccgcaatggagagcaccttcatcatgatcaagcctgacggcgtccagaggggcctcattggtgtgatcatcagccggtttgagaagaagggctgctacctcaaggccttgaagcttgatcacgcgcagaggtcggtagctgagaaacactacgcagatctggcctgcaagccgttctttcagggactggctgactacatgatctctgtccct

SEQ ID NO: 558 - DNA, 240 bp, Zea mays
  Clone ID: PAT_MRT4577_105105C.1
tcttcccttaatcctcacaagctactatctctactataataacctcgtacctctcaccatcaatgtcttctctataaaaaaacccaattcttcaaccctacaacatacaacatgcaatcacatctcgcatcttacctttatcacccttcttcctgcaacaatcatcacccctattacatcagttacatttgatgcatttattctcacaaaacataagagcacaacaactacaacaacttc

SEQ ID NO: 559 - DNA, 176 bp, Zea mays
  Clone ID: PAT_MRT4577_105235C.1
attctgaaggtcactctgtgtcagttgttaaagctgtgtacaccctcggctccagcagacccatgcatcaaccagcatggactgtggatccaggggtgctgttaccaccgtcaggctttattctaagttaaatcccaatgaaaaaaattgtgcttcttggtgctgcaaatcaaaac

SEQ ID NO: 560 - DNA, 215 bp, Zea mays
  Clone ID: PAT_MRT4577_105517C.1
gttggcttctcctcccccttcggttcgggtacgggttcatgaggttctccggtgttcgatttggggggtgagcagatcgagatggcggcgcacgatgttgagtaccgttactatgtcggccgactcatctgggccacggacgaccactaaattcacaacgcctttagcacctactgtgaggtgctagatgtccaagatcattcgggtatgggaga

SEQ ID NO: 561 - DNA, 858 bp, Zea mays
  Clone ID: PAT_MRT4577_105598C.1
aaaaaaaaaaaaaaaaaaaaaaaaaaaaaaaaaaaattaaaaaaaaaaaaaaaaaaaaaattcaaaaaatcggtttgttagcgtgacgtgcgtgaggagtctggagtcggacggaatcgaaaaggcgaaaactcagtgtctcgagtttcctcggagcggaggcgatggctgggaagggagggaaaggcttgctcgccgcgaagactacggcggccaagtccgccgagaaggacaaggggaagaaggccccaatctcacgctcctcccgcgccggcctccagttccctgttggacgtatccaccgtcagctgaagcagaggactcaggcaaatggtcgtgttggtgccaccgcagccgtctactccgctgccatcctggagtacttgactgccgaggttctggagctggctgggaatgctagcaaggatctgaaggtgaagcgtatcacccctcgccatttgcagctagccattcgtggagacgaggagctggacaccctcatcaagggcaccatcgcaggcggaggtgtcatcccgcacattcacaagtccctgatcaacaagtcctccaaggagtgaagactaggggatgtgcatctttagtttaaactggacttctttgcgctcctcgggtggtctggtatggtgttacagctactgtaaccaaggagcgatgctgcgccatatatatcacgtcttttgaaatcaaattacagtattccagcaccccccgaccaaacaaacagggttcaccacagaaggctggaccaagcaaacaaggttcaccacagaaggctgttcgctacgtgaattaaagtcagttgttcgaactactgtggagtaaaaaccggtactgatt

SEQ ID NO: 562 - DNA, 884 bp, Zea mays
  Clone ID: PAT_MRT4577_105599C.1
aaacattgggaaactcgaaaccggccggggaggggaaaaaaaactctgtttgttagcgtgacgtgcgtgaggagtctggagtcggacggaatcgaaaaggcgaaaactcagtgtctcgagtttcctcggagcggaggcgatggctgggaagggagggaaaggcttgctcgccgcgaagactacggcggccaagtccgccgagaaggacaaggggaagaaggccccaatctcacgctcctcccgcgccggcctccagttccctgttgggcgtatccaccgtcagctgaagcaaaggactcaggcaaatggtcgcgttggtgccaccgcagccgtctactccgctgccatcctggagtacttgactgccgaggttctggagctggctgggaatgctagcaaggatctgaaggtgaagcgtatcacccctcgccatttgcagctagccattcgtggagacgaggagctggacaccctcatcaagggcaccatcgcaggcggaggtgtcatcccgcacattcacaagtccctgatcaacaagtcctccaaggagtgaagactaggggatgtgcatctttagtttaaactagacttctgtgcgctcctcggcgagtccttgtcatcctgtaggttttagttgagctgtcaggttggagctcctctgtgtaacgcttgcctggtactgcttcatcagttatttggttattgtgtttgtgttgagttgttaacttcaggggtgcaaacctggatgcttatttagttatgtgactactgctattcggtttatgttgtggtttgtttttatttttacaattttttctagctgcaattacacttataatatgatgttggtagccctgtggagtgctggggggctcagatttatc

SEQ ID NO: 563 - DNA, 965 bp, Zea mays
  Clone ID: PAT_MRT4577_105638C.1
ctcgaggccggccgggccgggttcacagagccgctgccgttgccgctgccgctgccggctgccgctacctatgctcaagtgctcagtgctcaccgctctgcccctgcctcatcacacgcgcgcacggcgcacagataccttttctctcctctcccgtcccactctcctgggcaatcccggcccggcatggcgagcccgtcctcgtccccctcgcggaaggctctgagcaagatcgcctgcagccgcctgcagaaggagctcgcggagtggcaggtcaacccgcccgcgggcttcaagcacagggtcaccgacgacctccagaggtgggtcatcgatgtagcgggggcagcaggcacgctctacactggcgaaacctacaagttgcaggtggatttccccgagcattatccgatggaggcacctcaggttatatttctgcatccagcaccgatgcatccacacatttacagcaatggacacatctgtttagatatactgtatgactcgtggtccccagcgatgactgtcagttctatctgtatcagcatattatctatgctgtccagctcgccagaaaagcaacgcccagctgataatgatcgctatgtcaagaactgtcgcaatgggaggtctccgaaagagaccaggtggtggttccatgatgacaccgtgtgatcggtgttccgattattgttgtcctgtatgcatttagttgccagactatgggagatggacttatttcgaacgacccatttgaccagaaattaacatgctcttgtggtttgtagatgaatgtgcatcagcgtcaggcctgtactttctgattcttacaccgtcgatgatatatagaataatgtttgtatcttgtcaatttacggaacagacatgaaattcaatgcaggtcactggtttctgaatcaaaaaaaaaaaaataaattaaaaaaaaattaaaaaaatattaattt

SEQ ID NO: 564 - DNA, 760 bp, Zea mays
  Clone ID: PAT_MRT4577_105744C.1
cctcgaggccggccgggatcgagcttccattatccgcgactccactcatcgctgactccatcaacgaccgcaagaggaaggagaggcttgattccgtctctgaggagaccaccacgatcgtcctcgaggctctaccatatgtatgagagcggagtcctcctcttccctgccattaacgtctacgattcccccactgacagcaagattgacaacctgtatggttgccgacactcactccctgatggcctgatgagggccacagacgctatagatcgccgtgaaggttaccgtggtctgcggatacatcgatgtcgataatgactgcgccgctgtactcaagcaggatgtcgtccgcgccattgtagacgagatcgaccccatctgcggcctccaggatctgatggagggtcttcagaaccttctcttgtaggatgctcgctctgaagactgacatcttctgtgaccaccaatggtaacaaggatatcatcatgcctgaccacatgaagaagataaagaacaatgccgttgtctgcaacattggtcactttgacaatgaaaatgatatgctcctccttgaatactaccctgaagactagcgcatcaacatcaagccacatactgaccgctgtgtgttccccgataacaacactgccatcattgtccttgatgaggtcgcctgatgaaccttgggtgtgctactgaccatcctaactctgacatgctctggtcattcactaaccatgtcatagcccaacttga

SEQ ID NO: 565 - DNA, 347 bp, Zea mays
  Clone ID: PAT_MRT4577_105790C.1
ctacttgctacattgttagcacatttgtgttcctactttggctgccattattttgagcctccttatgctccttggtctttctgcaagtgctgctacagcgaccattttcccgtaatgctcgcaagctcctatatgcttcctttttcccccgttcctctcaccagcggtgtcttcggtatgtgtaaacccaattcttctacccttcaagatccaacatgcattcacagctggcatcttacctttatcacccttgttcctccaacattcatcagccctattacatcagtttcctttggtgcatctattggcacattacatcatggcacaacatcttctacaacttgtgc

SEQ ID NO: 566 - DNA, 2179 bp, Zea mays
  Clone ID: PAT_MRT4577_105922C.1
acccgccgggccggggacgtcgccgagaaaactcaaatcgaatccccaaatccttcgccggcgattccactccaagtctcgatcggaaaagcgcagaagagcaacggaatcccaattcccaaagggacaaggcaaagctaacttctccttcttcccatccttcctcatcccgtcggatcaatgccagcgggagcaaattcgaagccgctgccgaaattgtggccggttgaccggtgtttccagcccatccccccgttgcacgcggcgaggtagaggagtttccgccgtcaactccatccgatcggcgtagggtcgcggggtgccgacaactttggtccccgctccccacttgggcgccacggtcgctgcgcatgccgcgggctcccgcgcccactggaccccggtaacaccgcacggcgcctcgctccgcgtgcccgcccgctgccagctccatgccaaccgccgcggctacataggtagctgcgcgctggctgaaggctcctgcagtgcgcgttgaaggctttcgctgcgtgttgtgcgttctgcttgaatttcggtctgagtttggatgggccagatgatttcgggtgataaatccgacgaacagacagcacgcgacgatggaatcatcaagaatggaagggaaatcctatttcaggcttttaactgggaatccaataagcacaactggtggagtattttggaggaaaaagtaaccgatcttgcggaatctgggtttacgtcagtgtggcttcctcctccaacacagtcattatctcgagaaggctatctaccacagaatctgtactgccttgactcatgttatggttccctccatgagctaaaattgttgcttcataaaatgagcgaacataatgtaagggctatggcagatgttgttatcaaccatcgaattggaactactcaaggatccaatggcatgtataatcgttatgatggcatcccagtatcatgggatgaacatgctgttacatcttgttctggcgggaagggaaacaagagcactggggataactttgatggggttcccaatatagatcatacacaaccatttgtacgcaaagatattatcgaatggttgatctggcttcgaaaatcagttggttttcaagattttcgctttgatttcacgaaaggttatgcagccaagtttgtaaaagaatacattgaggaatcaaaacctctttttgcagttggggaatactgggatagctgtgaatatagcccccctgactaccgactgaactataatcaagatatccataggcagaggattattaattggatagataacactggaggactttgtgccgcatttgatttcacgacaaagggcattcttcaggaagctgtcaaaggagagttgtggcgtttgcgagattcagaaggaaaaccacctggtgtgatgggatggtggccttcaagatcagttacatttattgaaaatcatgacactgggtccactcagggtcattggccttttccgtcagatcatattatggagggatatgcttatatactcacccaccctggcatccccacggtgttctatgatcacttctatgaccagggtgtgcctctccatgacgaaattgctaaactgatgcaaatcagaaaatgccaagatatacatagccgttcatcaatcaaaattctggaggttgggtcagatctgtactcagcaatcatcgacgataagttgtgcatgaagatcggggacggctcgtggtgcccaagtgatccagagtggaggctggcagtctctggtgacagatatgctgtgtggcacaagtgaagcatataagtgccctcgatacagtttatttctgctctcaggaacaggagtaattagcatgttagctgaataacagcacggtaaaacatgccaaaaatgaccctcttcgaggtttacctgtacaagaggagtgcctaaatgcaatgcttaattagaaatacgtgagatcgtgcggctggtcccgaggtgagacatacattttgctaatcgcaacaactatggattacctgcaaaagaaatatatatagggcatgtgatgtctctgtggaatattttatcctggaaccagaaatttgaattatttttataaaaaaatgcatctgtgcaatttacattccgaaaaaaaaaaaaaaaaaagcggcc

SEQ ID NO: 567 - DNA, 1451 bp, Zea mays
  Clone ID: PAT_MRT4577_106002C.1
ttgacgcgtgggcgcggaggttacctctcgccccccctctcctccgtccctcggagtctcctcctgtcttgatttcgggtcgctgctgtttcgatcccctttcctccctgacgatttgcttatttttgcgttggatttgtaacctaaacatctcgtttccgcaccgttttggggccgcgtctactggtggttgggtccctttagatcgagtaggcgcgaggatggggacacatccccgattgatctgacgtgatacgcatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatctaaaaaaaaaaaaaaaaaaaaaaaaaaaaaaaaaaaaaaaaaaaaaaaaaaaaaaaaaaactcgaggagggg

SEQ ID NO: 568 - DNA, 1569 bp, Zea mays
  Clone ID: PAT_MRT4577_106003C.1
ggcaccgcgcgggactagggctgccatcgtggcgccgacacgcgtcatcatctcattgggccgcgggactcggcgacaggccttttgtagaccgcagccggcaccatctcttcccgcaccccccattcgaacgccggagctcgacgaggacgaccgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagatacctcgctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgggttgggaagccctttaaactgttgtcacttgcattttaccttttccatcgctgtttattgtgagtggtcctatatcaatggctggtctcagtggtctatacgtatgctttttggttctctcttgattcctcacagggtgagtggggcatgagcatttctgtctcatctcaatgatgtgacttcagaatccgtaaatctctgaagtctaaacgctctatctaaacctttggattcgattacaattgtagatatagaaatctgtagaagggtgcaattcagaatattttgccatgatatgaatattcttcttgtgagactctgtattaagactaaaacagctcaaattgatagagattctgtg

SEQ ID NO: 569 - DNA, 374 bp, Zea mays
  Clone ID: PAT_MRT4577_106005C.1
accgacgacgcacgcggagatccggcctactgcgaattttgaaaactgaactggtagatggcataaccagagctttcccgtgaggaaaatgtgtacatggcgaatctcgctgagcaggcggacaggtacgaggagatcgttgagttcatggagaaggtacccaagactgttgactcggacgagctcactgtggaggagcgaaacctcttgtctgttgcatacaacaacgtcattggaccccgtcgcgcctgatggcgcatcatctgctccatcgagcataacgaggagggccgaggcaatgaggaccgactaacactcatcaaggattatcgtggcaagattgagactgaactgaccaagatctgtgatggcat

SEQ ID NO: 570 - DNA, 1301 bp, Zea mays
  UNSURE (1)..(1301): unsure at all n locations
  Clone ID: PAT_MRT4577_106010C.1
  unsure (1)..(1301): unsure at all n locations
gtctgaatttgactagctagtacctattcgtgccacagatcaataaagtgttgtcccatatattgatgtatatttgcagatccggcgtactgcaaattttgaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgcgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtcggtaaaatttnnnngctccccgtatgagatgctgccgggcaaggcctcggtgtcccacctcgtttcaggcgtgggacgctggagcctggtctggttgggttgggaagccctttaaactgttgtcacttgcattttaccttttccatcgctgtttattgtgagtggtcctaaatctatggctcgtctcagtggtctagtatatgttttcttggtttctcttgattcctcacacggtgagtgggaccgttcgcatttgtctgtcccatcccatcttaa

SEQ ID NO: 571 - DNA, 545 bp, Zea mays
  Clone ID: PAT_MRT4577_106098C.1
tcggtgctcggctataaggtcgacaccgtggacacgaccggggccggggacaccttggtgggctgcctcctcttcaacgttggcacggacgactgcatgttgcacaacgaggagaagctacgtgaggctatcaagttctgcaacgcctgcggagccatctgcaccaccaagaagggcgccatcccggtgctgtccacggtcgacaccgcccaggacctgatcgccaaggccaactagatggccgaacgcccggccgctacaccacgtgactgtcccccggcgccccgcccctagtcgtcgacgtcctcggtttcagttcattaggtagatcgagacttagcgtccgtttatgcgcctctactctgagacgggttgtttgggttaattaagttagctgtcgtggagatttcgaccgagagcatcaataaaatgttggcatgcgtggtgggatgctatccttaaaaaatatgttattttattggatttctagcttggatcagcttgggttttgaacattgctagtagcgcgtgattgggagggctat

SEQ ID NO: 572 - DNA, 1827 bp, Zea mays
  Clone ID: PAT_MRT4577_106131C.1
gattgggtacctcgaggccggccaaaaaaaaaaaaaaaaaaaaaaaaagagcacccggcggcagcgatcgaggctttgctcctgcttcggcttcagccccccccaattctttataaaaatccctcgccagcgcttccctcttttgacaaatcggccgcgggggagagagatatatagagccaatttttgcccgatttgcctgtctgctcgggactgagccggtattcctcttcctcgtcgacgagaataaataagctaagccagggccccggggaagaagaagatgagctccgccggaggcatggacgggtctccgccggtcgccgaattccagccgacggtgacgcacggcggccggttcctccggtacaatatcttcggcaacctgttcgagatcacgcgcaagtaccagcctcccgtcatgcccatcggccgcggcgcctacgggatcgtctgctcggtgatgaacttcgagacgagggagatggtggccatcaagaagatcgccaacgccttcgacaaccacatggacgccaagcgcacgctccgggagatcaagctgatgcggcacctcgaccacgagaacatcatcggcatcagggacgtgatcccgccgccgatcccgcgggcgttcaacgacgtgtacatcggcatggagttcatggagacggacctccaccagatcatccgctccgggcaggagctgtcggaggagcactgccagtacttcctgtaccagatcctgcgcgggctcaagtacatccactccgccggcgtgatccaccgcgacctcaagcccagcaacctgctgctgagcgccaactgcgacctcaagatctgcgacttcgggctggcgcgcccgtcctccgacagcgacatgatgacggagtacgtggtcacgcgctggtaccgcgcgcccgagctgctgctcaactccaccgactactcggcggccatcgacgtctggtccgtcggctgcatcttcatggagctcatcaaccgccagccgctcttccccggacgcgaccacatgcaccagatgcgcctcataacagaggcacgagtgacgcacgcaacgcaccccacatccccttcctataattcaattccttcttcttcttctgctcataacatcgcggcacggcaggtgatcgggacgcccacggacgatgagctcgggttcatccggaacgaggacgcgcggaagtacatgcgccacctcccgcagttcccgcgccggccgttcgtcagcctgttcccgcggatgcagcccgtcgcgctggacctcatcgagcggatgctcaccttcaacccgctgcagaggatcacagtggaagaggcgctggagcacccgtacctggaacggctacacgacgtcgccgacgagcccatctgcacggacccgttctcgttcgacttcgagcagcaggctctgacggaagaccaaatgaagcagctgatattcaacgaggccatcgaactcaaccccaacttccgatactagctagctagttcggacacacatcttaattatacgtatacgtatgattcctcgtacgtggtttgtaaatagaagatcgagccggccgccggtgttattagactgaacgttgcatttgtttgttcgttgacgttcgcgcgctcgccatatatatcctgcctgtgaggctgtgtagtgtgctgccgtgctgcaggtttcaggtgttcgtgtaatgagctgtaccaagaataaaaggctttggacttaaccaggctgaacttgctcaaaaggtggggactacccagccacatgtttctcggccatacagaatcacagttttgtctgcc

SEQ ID NO: 573 - DNA, 1628 bp, Zea mays
  Clone ID: PAT_MRT4577_10627C.1
cggacgcgtccgcccacgcgtccgtcaccgcaagcgtgcgcgcaacccagctcccaccgacgactgcaccggccgtcgctgccgcgctacttcggccccttttccggcgacgagcaccaccaggtccatgcagagtaggaaggcaccttttcgtcactcgaacctgttgcttgacctgcaagtgtcgggcggtgcacctgtgcccttgttgccgcgatgcagattatgtgggttttgagttggacagctgatggagtgcaaatctctggcctgccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactggaaatgttgaccacccatccatccttgcagaactgaaagctaagctcaatgaaatggcaccactaaaccagcttgaaggcagccaaaaggagctcaatgttgctctgagcaaatatctcaaactccttgagaagtctttcaatccagatatatctaaggcatacagaaatgtggattttgaggtccatacagtaaacaatatcatagcgaatcatttctaccgccaaggcctctttgatcttggtgacatgtttgtccatgagtgtggggaactaggcggagcttccttgaagctaccgtttcaggagatgtatgctatccttgaagccatgaaagcgagaaacctcgagcctgctctcagttgggctgccaaaaaccatgatcagctgttgcagaatgggtctatgctggagttcaagctttatcagcttcagtttgttgaaatattgtccaaaggcagtaggggtgaggccaaagatgaggctcttttatatgctaggactcacttggtcccctttgcagccgtgcacaaggaagaattccagaagctaatggcttgccttctatgggttggccggctcgatcaatccccatattctgagttaatgtcatccgcgcattgggagaagctagctgaggagctcacccatcaattctgtagccttctgggccagtcgagggagagcccgctgagtgttgcagtgtcagctggttttcaaggactaccaactctgctgaagctgacgcaagtcatggctgcgaagaagcaggagtggcaagttatgaagcagcttcctgtccccatagacatcgggccagaattccagtatcattctgtctttgtgtgcccggtgctcagggagcagtccagtgacgagaatcccccaatgcggatgccttgtggacatgttgtctccaagcagtccatcatgaagctgtcgaaaagcagctcgagggccttcaagtgcccctactgcccctcggaggctatggcgtcgcattgcaagcagctgcatttctagatgtgttaatcttttctggctgcgcaaaactgcaaacctgttggtacatgtttcccctcctgttccatgttgcaccagtccaataactgtctctctgtaatataaacatctacgtccggataaacatgtagtttcgtctgtattactgatatgtacagttgcatcttt

SEQ ID NO: 574 - DNA, 1225 bp, Zea mays
  Clone ID: PAT_MRT4577_106286C.1
cattgggtacctcgaggccggccgggcccttctctctctgctccgggttcagagcagagctcagcgccctgtctccctccctccctccattcctcctcctccgctctctctctctgcaggcctgcactgtgaggagactgtgacccggggacggagagctcctttcttctctctcatcgctccaccccttatttaccggtcggttgttcctgggccgtcccgtcccgtcccgtcgtctcgcctgggttctcgcttgcttctcaccatcactaccaccgtccacaccatcgcgagggcctggagggaagaggatgggacagggaggagaagtgaaggcggcgccggccgtgagggtgctggtggtggacgactcccccgtcgaccgcaaggtcgtggagctgctgctccggaaccacaaccaccagggcggcgccgcgccattccacgttaccgccgtcgacagcggcaagaaggcaatggagcatctccggctgatggagcaaggcggccagctggattcatgtgccgctgatgctaatcggataaccattgacatcgtgctcacggactactgcatgccggagatgactggctacgacctgctcaaggccatcaaggcgctgagctcccctaacccgatcccggtggtggtgatgtcgtcggagaacgagccccagaggatcagcagatgcctaaccgccggtgccgaggatttcatcctcaagccactcaagaccaaggacgtgcagcgcctgcgcaactgctccagcgccgctagacccacggacggcgcggcccaccagtgcgagagcttgaggagcagcagcagaaagctgcggtcggatcaggtcgccgcgcctgcccacagatcgcaaccgacgacgggattaaccatggtgctgcatgcctccagcattgagctctcgcactacttccagttcctcctcaagttcgtgctgctcgcgtacgcggtgctgtgcctgaccgagctcctccacagatggtccaatggctccgtcctctccctgtggtctgcatgaggtcgactggaaccgccatgcggtattattagtgtaaccactaaggctccaggctttcagttcaattccccccctgtaatccagtcctggcatgaggagccaccagttcttgctcgccgctccctatatttccatttcacttttcaccagcttttttgtggttattattatttatttttttggct

SEQ ID NO: 575 - DNA, 1926 bp, Zea mays
  UNSURE (1)..(1926): unsure at all n locations
  Clone ID: PAT_MRT4577_106290C.1
  unsure (1)..(1926): unsure at all n locations
aagaaggcaatggagcatctccggctgatggagcaaggcggccagctggagccttctctctctgctcccacgcgtccgcagagctcagcgccctgtctccctccctccctccattcctcctcctccgctctctctctctgcaggcctgcactgtgaggagactgtgacccggggacggagagctcctttcttctctctcatcgctccaccccttatttaccggtcggttgttcctgggccgtcccgtcccgtcccgtcgtctcgcctgggttctcgcttgcttctcaccatcactaccaccgtccacaccatcgcgagggcctggagggaagaggatgggacagggaggagaagtgaaggcggcgccggccgtgagggtgctggtggtggacgactcccccgtcgaccgcaaggtcgtggagctgctgctccggaaccacaaccaccagggcggcgccgcgccattccacggtcagcggctcctgctcctcagctcctcgcttgctcccctctcgtccggtcccttccgttccgtctggccactccattcctcccctctgctggtctcgacgacccttctcggcggcccgtgtactctgatccgggattatggctatgcataggaattgcatggcatgatcaagcttcatccattcgtcgtctgtcagttgcttatcagtactgttgaagaaaaaacgaaattaaatttccgcagcatgaactaattaaggcccgggtttcgttcctttcctcgtttggttcagttaccgccgtcgacagcggcaagaaggcaatggagcatctccggctgatggagcaaggcggccagctggattcatgtgccgctgatgctaatcggataaccattgacatcgtgctcacggactactgcatgccggagatgactggctacgacctgctcaaggccatcaaggcgctgagctcccctaacccgatcccggtggtggtgatgtcgtcggagaacgagccccagaggatcagcagatgcctaaccgccggtgccgaggatttcatcctcaagccactcaagaccaaggacgtgcagcgcctgcgcaactgctccagcgccgctagacccagggacgacgcggcccaccagtgcgagagcttgaggaggagcagcagaaagctgcggtcggatcaggtcgccgcgcctggccacagatcgcaaccgacgacgggattaaccatggtgctgcatgcctccagcattgagctctcgcactacttccagttcctcctcaagttcgtgctgctcgcgtacgcggtgctgtgcctgaccgagctcctccacagatggtccaatggctccgtcctctccctgtggtctgcatgaggtcgactggaaccgcgatgcggtattattagtgtaaccactaaggctccaggctttcagttcaattcccccctgtaatccagtcctggcatgaggagccaccagttcttgctcgccgctccctatatttccatttcacttttcaccagcttttttgtggttattattatttatttttttggctagataaaaattcttgcatttgggggcgtcgtatcgtttgcttggttgatggaagcgacaagaagtgggcgcgataaggtgatggtgattatatatagtgtaaatgcacggtatgagtgggtcagggtatctaatggccctgttaatcaagataccggcttgatctgccgatgcaactgccagacccgcccgtccgcccgccggccggggtggacgcagacgcccacctgctctgctgttaacatcagtacccgcggtcacgctgtgcgtcagtgacacaaacaaaactgcataagttgaccgccatatgacgccacattgatcttaggggaaagcaaaaatattgtgnnnnnnnnnnnnnnnnnnnnnnnnnnaaaaaaaaaaaa

SEQ ID NO: 576 - DNA, 1644 bp, Zea mays
  Clone ID: PAT_MRT4577_10629C.1
ggaccctcgaggccggccggggaaatcttcacccccgcccccccgccctggcgttgcgcccggccggggtcctgtcttcatcaatcctagcctcgccgccggccgggatcaatcatcaccgcaagcgtgcgcgcaacccagctcccaccgacgactgcaccggccgtcgctgccgcgctacttcggccccttttccggcgacgagcaccaccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactggaaatgttgaccacccatccatccttgcagaactgaaagctaagctcaatgaaatggcaccactaaaccagcttgaaggcagccaaaaggagctcaatgttgctctgagcaaatatctcaaactccttgagaagtctttcaatccagatatatctaaggcatacagaaatgtggattttgaggtccatacagtaaacaatatcatagcgaatcatttctaccgccaaggcctctttgatcttggtgacatgtttgtccatgagtgtggggaactaggcggagcttccttgaagctaccgtttcaggagatgtatgctatccttgaagccatgaaagcgagaaacctcgagcctgctctcagttgggctgccaaaaaccatgatcagctgttgcagaatgggtctatgctggagttcaagctttatcagcttcagtttgttgaaatattgtccaaaggcagtaggggtgaggccaaagatgaggctcttttatatgctaggactcacttggtcccctttgcagccgtgcacaaggaagaattccagaagctaatggcttgccttctatgggttggccggctcgatcaatccccatattctgagttaatgtcatccgcgcattgggagaagctagctgaggagctcacccatcaattctgtagccttctgggccagtcgagggagagcccgctgagtgttgcagtgtcagctggttttcaaggactaccaactctgctgaagctgacgcaagtcatggctgcgaagaagcaggagtggcaagttatgaagcagcttcctgtccccatagacatcgggccagaattccagtatcattctgtctttgtgtgcccggtgctcagggagcagtccagtgacgagaatcccccaatgcggatgccttgtggacatgttgtctccaagcagtccatcatgaagctgtcgaaaagcagctcgagggccttcaagtgcccctactgcccctcggaggctatggcgtcgcattgcaagcagctgcatttctagatgtgttaatcttttctggctgcgcaaaactgcaaacctgttggtacatgtttcccctcctgttccatgttgcaccagtccaataactgtctctctgtaatataaacatctacgtccggataaacatgtagtttcgtctgtattactgatatgtacagttgcatctttgatctttcagtgtgttgcttaagtctcttctggagattaaaggaaaaaaaaaatattagaagactcagtgtgttgctta

SEQ ID NO: 577 - DNA, 1497 bp, Zea mays
  UNSURE (1)..(1497): unsure at all n locations
  Clone ID: PAT_MRT4577_106327C.1
  unsure (1)..(1497): unsure at all n locations
atccacctaattcggcaggttcctaacccccacccacctcgcccaaattgcaaccttccccgagtgctccaggtcccgtggccggcccccagatcctctccaatcccaatccaagtatcgaacggatcccatcggtggcgctcgagcgagcgagtgcggccggaaccgagcgaagatgggcatctcgagcatgccggcgcccgaggacagcctgctggggttcgtgctgtacaacacggcggcgtcggtggcgatcctggcggggctggtgcgcgccgcgctgctgttcctgggcctggcggcggcggaggacgaggagccgcggcagcaggcggaggccgtgacggtcacggccgtggggcccagcctcgcggaccggttccggagcaggttccggccgtcgcgctacgggcggcgccggggcggggactgccgcgtgtgcctggtgcggttcgagacggagtcggtggtgcagcggctcccctgcggccacctcttccaccgcgcctgcctcgagacctggatcgactacgaccacgccacctgcccgctgtgccgccaccgcctcctgccccccgccgctgccgccgacgaggtgccccggattgcctgattagcgccctaggaattgagagtaggcgtagcactctgcacctcgcagcagcagtgtctctgtacaggtttttttttcttttcctttttgttcgggggagagagaggacagaacggagattgaaggaagaaaatggtggcaacaaagctgttccccctttcgtttctccgaagctctctgttgtctttattcattccaaaagtataatctactcgtatgaaccaagtactcaaaattgtctttgggcttgtgctggggtggacgcaaaaaccactatcttgctgtgaataagggattctataatagtggcacgactagattaccctttcgtatgtggttgctttatttgtgattgtacacgcattgatgtttttaaaagaatttttgggggggaaagtaagaaaagataatcaaaggggtcactttaataagctcttttgtttggctttgattaaaaaacatcanaaaagtctggtggacagcggcgttgggtcttttttagtgccggaaattttctttatccactccaaaccgaaggagagtggatttttggaaaccaagtttattaaaatttttattgttatgaccatttttttttataggtccccacgggatttgtttaatatggggcggtgcgtggtttttaattatacaaanaagggggtgcacgcccaaaaactggtagttctccacaaatttctcgaaacctcaagtatgtgtccgaacctccttctttttattggaatccattctgggtcacaattttgggggtggcgtgggttttatggaaacgtctttctgactggaaatattttgaccgtgttaaaggacagacctttctggtttgtaaaacccaatctccttaataaaaaaacttggtattt

SEQ ID NO: 578 - DNA, 850 bp, Zea mays
  UNSURE (1)..(850): unsure at all n locations
  Clone ID: PAT_MRT4577_106424C.1
  unsure (1)..(850): unsure at all n locations
gctcccgtccctctccgagcattcgccgcttcctccccgaccctctcgatccgcccaccttccccttccccacgcctgtggtagtcgcgtgctccggccatggcgttcttccggggcctcgccgcggtctcgaggctgcgatcccgtatggggcaggatgccaccacgcttggtggtgtgagatggctgcagatgcagagcgcttccgatctcgatcttaggtcccagctgcaggaaatgattccggagcaacaggaccgcttgaagaaactaaagtcagagcatggaaaggtccagcttggaaacataactgtggacatggtccttggtgggatgagagggatgactggaatgctttgggaaacatctttacttgacccggaggagggtattcgatttagaggtctctctattccagagtgccagaaagtactgccggctgcagttaaagatggagaacctttacctgagggcctcctttggcttcttttgaccggaaaggtgccaaccaaggagcaagttgatgctctatcaaaggagttgcttagccgttcgactgttccaggttatgtctacaaggcgatagatgctctccctgttactgctcatccaatgacacagtttaccacaggagtgatggcactccaagttgagagtgaatttcanaaggcttacgacaagggaatgcccaaaacaaagttctgggagcctacatacgaagattgcttanatttgattgctcggcttcacaagtggcttctatggttaccggaggatttcaaggatgggaagctatgcagctgatatacactggactacgcagcgaattttccacatgctttggtttgat

SEQ ID NO: 579 - DNA, 748 bp, Zea mays
  Clone ID: PAT_MRT4577_106455C.1
gtcaggaagtcccgggtcgacccacaacgtccgcggacgcgtgggctatcatgaatctgcactctgaccagggaagtaactcccttggctgctcagacttgggttgggagaatgatactaagacaccagacatcacatccattgctcccattcccactattgctgaaggcgatgagtctgtatttgtcaactccaattcaaacagctcgatggtgcctcctgtccttgagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgaggaatttgaagcttggccataggactatgtacatagggactagggaataaagactgggagattgggaagcacctgcttggcaccttggggtagcatatgctcgtgtctagctcagatgcagaagtcgcattctgaaactctttggttatcgacctgttccctattttaactatctctgtatgagagccatttatgagactgaaccattttaccattttgttttcccccttctttcgttgttacagtatatggtttaacattatgatttatggatatgtggccaaacatgccttttatatgcgctttgtgcttggttgaaattgagttaactagtt

SEQ ID NO: 580 - DNA, 1961 bp, Zea mays
  UNSURE (1)..(1961): unsure at all n locations
  Clone ID: PAT_MRT4577_106460C.1
  unsure (1)..(1961): unsure at all n locations
cattgggggtccccccgcttcggccgggatagggcccacgccccctccccgccgggaaaagtttcgtccaccatttcgctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgattcggatttggagctcggggaaggggctgacgacgacgtcatcgagatcaagcccttcgccgccaagagtactttctccagagatggcttaagcaccatgactactgctggttatgatgcccctgcagcaaggttggccaaaaggaagaggaagaatcaatacaggggtatccgccagcgcccttggggtaagtgggctgctgagatcagagatccccagaagggcgttcgtgtttggcttggtactttcaatagtccggaggaagctgcaagagcttatgatgctgaagcgcgcaggattcgtggcaagaaggccaaggttaactttcctgatgcaccagcagttggtcagaagtgccgttctagttcagcttctgctaaagcactcaagtcatgtgttgaacagaagccaattgtcaaaacagatatgaacatccttgccaacacaaatgcacccttctaccaatctgttaactacgcatccaacaatccatttgttccagcaatgaactctactgtttcttttgaggatcctatcatgaatctgcactctgaccagggaagtaactcccttggctgctcagacttgggctgggagaatgatactaagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgaggaatttgaagcttggccataggactatgtacatagggactagggaataaagactgggagattgggaagcacctgcttggcaccttggggtagcatatgctcgtgtctagctcagatgcagaagtcgcattctgaaactctttggttatcgacctgttccctattttaactatctctgtatgagagccatttatgagactgaaccattttaccattttgttttcccccttctttcgttgttacagtatatggtttaacattatgatttatggatatgtggccaaacatgccttttataaaaaaaaaaaaaaaaaaaagaaaaaaaaaaaaaaaaaaacggccaagtttctcgtattgttgtgtaccttgtgatatttcattcgttgaaattgagttaaactagttatccgggtgggcctatcgagatggattgtggacctgatgacttgcgtgggtccatacttttcttcggttgcgggggggggcctgtggngagatgtcaccctgccttggtgtctcggtccgctctctggtgcgcgtcttgtctgctcttgcgtgggcctctttttgtggttctgggtgtttgtgtctgcagcgtttgcctctgctatgtctggcacgggcgttttgtggccctattgtgatggggctttatttgttgttgttgtttggctgcctatttgaggctgaaaatcnttttggtgnggttttgtgttgcccctgttcgctgcct

SEQ ID NO: 581 - DNA, 576 bp, Zea mays
  UNSURE (1)..(576): unsure at all n locations
  Clone ID: PAT_MRT4577_106556C.1
  unsure (1)..(576): unsure at all n locations
aactcgaaaaaaaatattattcttaaataaaatgcttggacagacatttctccatacatatatgctcattgtggtagacgcagctgaccacctagagctgtattaatacttattcaaattgattcagcatgtggcaacataggaaaacatgcttacagacgacatttttcatactctaatagcctggcttggctgcttcacagaataaccaaacgacgacaacgaaattgcaaagataaaaaaaacaactcagaagcaaatcgacaccagaagcccatcttactcatcaagcactccatccttctccatggcatccacttcctcccagcagagaagattagccagtttgcggtccttcacaggaggagcattctccatgttcacaccttcgaagcagtgaagaacagatttgggcgaggtagcaacagcgtcttcagcagcacagaagctctggtagatgaggagtccgccaccaggcagctcctgctccaccatgttgttacagtcataaacctctgcaccaagttgctttccccacgtcccagcttggccacgcccgccngagatggtcacagc

SEQ ID NO: 582 - DNA, 309 bp, Zea mays
  Clone ID: PAT_MRT4577_106579C.1
cccgaaaagatgcagttttgtttttggcccaagctgcctcaagtttttccatgtacagcctttcactttaagttaaaagacattatagtttttttaggtctatatatacccatgggccctgccacgatgggggcaaccactgcacatatacattcatttcagccctagagtccctcctaacacacaggtgggggcagtatgtatttttggcgaataaacaactgggtaagacatccttttaaatgcaggacgggttgttattgacggggaccacggtaaattggttgtccagggacgttgccgaccccg

SEQ ID NO: 583 - DNA, 713 bp, Zea mays
  Clone ID: PAT_MRT4577_106585C.1
gatctccatctctcatccgctagctagctagctaggcaagacagtcgagagtcgacaccatggccatggcgacgcaggggcaggccgaccagcagcagcagcacgggcggtctgagcccaccaccagcgtcgccgccaaccgctgggggccctactccggcgccggcgacttcgccagcaacatggccgtcatcctggccgccctgctggccgcgctcgcgctcggcctggcgctcaacgccgccgtgcgctacctgctccgccgcagccgccgcgccggctctgttggtggacagggcaacggcagcggcgtgctgatgccgtcggacgacccggctgagaagccctctgtggaggtggagctgcaggcgccgccgcccgccctgctggtgtactccgccgccgggacgacgctggcgggcgccgcggcggagtgcgccatctgcctcgccgagttcgcagacggggacgccgtgcgcgtcatgccggcctgcggccacggcttccacgcgcgctgcatcgagcgctggctcgcggagggccgccgctcctcctgcccgacctgccgcgcgccggccgtgcagcgcagcctgcacgcaagtgaattactctaaataaataattgccgttttagtgttgctatttaccattgcttgtactgcctctgtaaatcaagaagaagaaataaaattataactcttaggtttgggctc

SEQ ID NO: 584 - DNA, 879 bp, Zea mays
  Clone ID: PAT_MRT4577_106587C.1
gatctccatctccatccgctagctagctagctaggcaagacagtcgagagtcgacaccatggccatggcgacgcaggggcaggccgaccagcagcagcagcacgggcggtctgagcccaccaccagcgtcgccgccaaccgctgggggccctactccggcgccggcgacttcgccagcaacatggccgtcatcctggccgccctgctggccgcgctcgcgctcggcctggcgctcaacgccgccgtgcgctacctgctccgccgcagccgccgcgccggctctgttggtggccagggcaacggcagcggcgtgctgatgccgtcggacgacccggctgagaagccctctgtggaggtggagctgcaggcgccgccgcccgccctgctggtgtactccgccgccgggacgacgctggcgggcgccgcggcggagtgcgccatctggaccaagctggcgggcgccgcggcggagtgtgccatctgcctggccgagttcgcagacggggacgccgtgcgcgtcatgccggtctgcggccacggcttccacgcgcgctgcatcgagcgctggctcgcggagggccgccgctcctcctgcccgacctgccgcgcgccggcgggacgccgcagcctgcacgcaagtgaattactctaaataaataattgccgcggccacgcctgtcgtcgtgaataatggctcggtttggccatggccagtggcggacgcagaacaaaattctaggtggggccgacagcgcaagagataaatcatcagactagaccataaatgtagattaatgataagtgttttagtgttgctatttaccattgcttgtactgcctctgtaaatcaagaagaaaaaaaaaaaaaaaaaagcggcc

SEQ ID NO: 585 - DNA, 174 bp, Zea mays
  Clone ID: PAT_MRT4577_106632C.1
caggcaggtacgtcgcgtcgataccaggtcttcgagaggagcggaggaggatggcggcgagtacggaggagaggcgagtacagctgtagcgtttcgcttcttgcccgtagcggcggcggtgccacctcgaacgctgctccctgttctggggcttacagcggatcctgatctgag

SEQ ID NO: 586 - DNA, 997 bp, Zea mays
  Clone ID: PAT_MRT4577_106650C.1
cctccggcgactgcgaggatcattgaccaaatgtgcgtcgctcggggccgggcgggaattgacatccttacattttcttgctgatcacagctagtagggagcgagagttaccttgaaatcaaggcagtacgtacgagtacgatcgacaatgtcgacggtcacttcttgcacctttctgagcctcgggtccccagtgcggccggcagtctcctccgcgagaccggcggcggcggcggtggcttcccgacggaggccccggtccctttctgtgtgctgcgaggccggccggaaaggggatcacaacccaaagacggatctgcatccatttaacatccctgccttcgttctggtgcacccggtggcaccacgtgaggaacgatggcagctggaggaggacgccgacaaggtgaacctgtggttcgaggtgcctgggcagtccaaggatgacctcaccgtggagatcgacgaagacgtgctcgtcatcaagaagaggaaggagctggtgggccagcggagccctgctggcggtggcgtcgcagagtacggctcgcagtcccagcagcagagcaggaggggcaccgcagatggcaaggagctgccggcggcacagcagggccaggccggcgaggtggtctatgcccggatgctcctcccggcggggtacagcagggatggcgtgcaggccgagctcaagtccggcgtgctcagggtcactgtcgtcaaggtcacggagcgagcgcgcaggaagatcgacgtccccattcaagtcaagtagatatgcgtgtatgtgtatgcacattcgtcctgcgcacgtgtcagcaggggtgctttatttacatctgtctcatgtccaacatgcagactacagcggtcgatctcaccacgtactcgatcgcgtcgactacacatgttcatgggctttgtgttcccatgtactcatcaatcaataaaatgagcatatgtgttctccgccgaaaaaaaaaaaaaaaaagcggcc

SEQ ID NO: 587 - DNA, 2425 bp, Zea mays
  Clone ID: PAT_MRT4577_106832C.1
ccggggaaaaggttccaccgtctaccttgccccgaccggaactggaacccctaaaaatttccctttcgtacctttccccttcctcctcccgtccaccacaccccggctccaccccgtgcaaatccgctggccgcagcaagagaggtcgaggagggaaacagatcgggtggcggcaaccggtagccggttccgctggcacgatgggcggcgaggccgagggcggggagcggcggctggggcgggtcctgagctttgggatcccggacacggcgctggggctagtgatggggtacgtggaggacccttgggaccgcgacgccatctcgctggtgtgccgccactggtgccgcgtcgacgcgctcagccgcaagcacgtcacggtggccatggcctactccacaacacccgagcgcctgttcggccgcttcccgtgcctcgagtcactcaagctcaaagcaaagccccgcgcggccatgttcaacctcatctccgacgactggggcgggtctgcgtcgccgtggatccgacagctctcggccactttccactccctcaagaagctccacctgcgcaggatgatagtatccaatgacgacatcaacacgctcgtccgcgccaaagcccatatgctcgtgtcgctgaagctcgaccgctgctcaggcttctccacgccctccatcgcactcatcgcccgctcttgcaggaaactggaaacacttttcctggaagaaagcatgattgatgagaaagaaaatgatgaatggatccgtgagcttgctacgagcaattctgttcttgagacactgaatttctttcagacagatctcagggcatccccagagtatcttacccttcttgtgcgcaactgtcaaaggctgaaaaccttgaagattagtgagtgtttcatgcctgatctggttagtttgttccgaactgcacaaacactacaagaattcgctggtggttcctttgaagatcagggtcaacctgtggcaggtagaaattatgagaactactattttcctcctttactgcaccgcttgagtttgctctacatgggaacaaatgagatgcagatactgtttccatatgctgctgcacttaagaagttagaccttcagtttacattcctttccacagaggatcactgtcagatagttcagcgctgccccaatctggaaaccttagaggtgagggatgtcataggggatcgtgggctacaagttgttgcagagacctgcaagaaattgcagaggctcagagtagagagaggagatgatgatcaaggaggtcttgaggatgaacaaggtaggatttcacaggttgggatgatggctatagcccaaggctgccctgagttgacatactgggcaatatatgtatcggacattacaaatgcagctctagaggcggttggtacatgcagcagaaatcttaatgatttccgccttgtccttcttgatagagaagcacatataactgagttgccactggacaatggggttcgtgctttgcttagaggttgcaccaaactcaggaggtttgcattttatgtgagacctggggccctatctgatgttggtcttggctatgttggagaatttagcaagagcattcgatatatgttgcttggcaatgttggtgaatctgataatggaattatacaattatcaaaaggctgcccaagcttgcaaaaactggagctgaggggttgtttgtttagtgagcatgctttagctatggctgcactagagctcaagtcactgaggtatctgtgggtgcaaggattcaggtcatctccaaccggaactgatcttatggcaatggtacgccccttctggaacattgagtatattcttccagaccaagatgaaccttgcccagagtataagaaacagattctggcatactactcccttgctggaaggaggacagattgccctccatcggtaactccactttacccggcagtttgagcgtagatacttgctttttgccagactgaatctcatggtactaagctccattgctcccacaatctgtgaaatcgatggttcctgttgatggggacatgcagacgttccattgcacataaccccagagctaagctttaagcaggacgacagctcggaactgaggctagctgagaacaatcgtgaatacctgaaggcagcactttgtggatcagattggcctacctgtccagtatggaaatgtaaacttcaccattttgaatagttttggagaaacaattttgtaataatttacccttgtttagtgtacattatcgattttcgattatatgatgttgtattgctttatttaacatttaagtcaactagttaatctacagtctgacttgctgtgattcgatgaattaatggattttccttgctgccaaaaaaaaaaaaaaaaaaggccccta

SEQ ID NO: 588 - DNA, 2385 bp, Zea mays
  Clone ID: PAT_MRT4577_106833C.1
gctgtccagtatgggcacgcacgcgtcccctaaatttcccaaccttccctttccccttcctcctccagtccaccgcatcaccacaccccgtctccaccccgtacaaatccaaaagagggcgaggagggaaacagatcggctggcggcaatcggtagccggcttggctggcacgatgggcggcgaggccgagggcggggagcggcggctggggcgggtgctgagctttgggatcccggacacggcgctggggctagtgatggggtacgtggaggatccctgggaccgcgacgccatctcgctggtgtgccgacactggtgccgcgtcgacgcgctcagccgcaagcacgtcacggtcgccatggcctactccacaacacccgagcgcctgttccggcgcttcccgtgcctcgagtcactcaagctcaaagcgaagccccgcgcgtccatgttcaacctcatctccgacgactggggcgggtctgcgtcgccttggatccgacagctctcggccaccttccacttcctcaagaagctccacctgcgcaggatgatagtatccaacgaagatatcaacatccttgtgcgtgccaaggcgcacatgctcgtcgcgctgaagctcgaccgctgctccggcttctccactccctccatcgcactcgtcgcccgttcctgcaggaaactggaaacacttttcctggaagaaagcacaattgatgagaaagaaaatgatgagtggatccgtgagcttgctacgagcaattctgttcttgagacactgaatttctttctaacagatctcagggcatccccagagtatcttaccctccttgtgcgcaactgtcaacgattgaaaactctgaagattagtgaatgtttcatgcccgatctggtcagtttgttccgaactgcacaaacactacaagagttcgctggtggttcctttgaagagcagggtcaacctgtggcaagtagaaattatgagaactactattttcctccttcactgcaccacttgagtttgctctacatgggaacaaatgatatgcaaatactgtttccatatgctactgcacttaagaagttagaccttcagtttacattcctttccacagaggatcattgtcagatagttcaacgctgctccaatctggaaaccttagaggtgagggatgtcataggggatcgtggactacaagttgttgcacagacctgcaagaaattgcataggctcagagtagagagaggagatgatgatcaaggaggtcttgaggatgaacaaggtaggatttcacaggtggggttgatggctatagcccaaggctgccctgagttgacatactgggcgatacatgtatcagacattacaaatgcagctttagaggcagttggtacatgcagcaaaaatcttaatgacttccgccttgtcctccttgatagagaagcacatataaccgaattgccactggacaatggggttcgtgctttgcttagaggttgcaccaaactacggaggtttgcattttatgtgagacctggggccctatctgatgttggtcttggctatgttggagaatttagtaagagtattcgttatatgttgcttggtaatgttggtgaatctgataatggaatcatacaattatcaaaaggctgcccaagcttgcaaaaactggaggtgaggggttgtctctttagtgagcatgctttagctttggctgcactacagcttaagtcactgaggtatctgtgggtacaaggattcaggtcatctccaactggaactgatattatggcaatggtacgccccttctggaacattgagtatattgttccagatcaagatgaaccttgcccagagcataagagacagattctggcatactactcccttgctggcaggaggacagattgtcctccatcagtaactctgctttacccggcattttgagtgtagatacttgctttttgccagactgaatctcatggtactaagttccattggtcccactatctgtgaagtaaatggtccctgttcttccaattgatgaggacatgcagacgttccagtgcaaagaaccccaaaggtaagctttaagcaggacggccagctctgaactgaggctagctgagaacaatcatgaatacctgaaggcagcacttatgtcagcttggcctagctgtccagtatgggcatgtaagctttaccatcttttgtagttttggagaaacaattttgcaataactacccttgtttagtgtatattatcgattttcgttcatatgctgttgtattgttgtattgaacaattatgtcaattaattagtctacactctacagtctaacttgctgtgattcgatgaaaaaaaaaaaaaaaacagccgcc

SEQ ID NO: 589 - DNA, 289 bp, Zea mays
  Clone ID: PAT_MRT4577_106856C.1
cgcaacctcccgggccgccttctcttctccagcgtccgatctcccactcgcctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagcacgagagcgggagcccaggggaggcggagcggtggcacgtcagggacaggacaggttctgccatcgcaacatcatcggtcatgaag

SEQ ID NO: 590 - DNA, 2052 bp, Zea mays
  Clone ID: PAT_MRT4577_107184C.1
ccctgctgccgtccctgtccacaaagatcccgtaggagtcggccgggacgaaggagtcggagtcgaaccgtaacctccgtgtgtagtcttgccaggcggcggaggagaggggtaagaggggagcaaatcagtggctcgagtttcctggcgtgcgggaggagtcggagggaaccgaagaaacgcagggtctcgaatttcctaggagcggaggcgatggctgggaagggaggaaaaggattgctcgccgcgaagacgacgcgccggccaagtcggcggagcaaggacacgggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttctggagctggctgggaacgctagcaaggatctgaaggtgaagcgtatcacccctcgccacctacagttggccattcgcggagacgaggagctggacaccctcatcaagggcaccatcgcaggtggaggtgtcatcccgcacatccacaagtccctgatcaacaagtcctccaaggagtgaagactagggaatgcacattgttagtttaaactggacatttctgtgtgctcctctgcgagtccttgtcgtcgtgctaggttttagttgagctgtcaggttggagtgaccctttctcctgtgtaacgcttgcctggtactgctctcagtgatttgtagaatacgctttgtatggagttgataacttcttatgtgacaaacttgcataattagttagtaataaaatgaaaaaatggtattcggtttaaaaaataaaaaaaaatcgataaaagaaaggtttagatctcaactgacccatctcaaacggagaggaatttcgaattgtggcaggtgctgcctccacctggtaacggtgggctgaaatactatggttgtgagcagtaaattcgaccaaatcatctgctccacagaagccatcagcgcctcgaccggacagtgacataggtgatccacagatacttcatgtacacagcaaaagatttggaagagtggtcagaaaatcatgattcctttcgccacgagcagaatttggttcagtggactgagaaaaaacggccatatgttgaagcccttttcatcgtggttgtaaccaatggtgtcggtaaggattttgtcatcaacaatgagtcgtactggaagacgggatctcgctgacggaggtaggagggctgctgcaggagtgggatggcagggaagagccagctggacagcatgccctggaggacagcctcgcatccgaggatctggggagcatgctggagtccatcaaagtggagagggccaaatattcactgatgtgctttcagttccctgttggacgtatccaccgtcagctgaagcaaaggactcaggcaaatggtcgtgttggtgccaccgcagccgtctactcagctgccatcctagagtacttgactaccgaggttctggagctggctgggaatgctagcaaggatctgaaggtgaagcgtatcacccctcgccatttgcagctagctattcatggagacgaggagctggacactctcaccaagggcaccatcgcaggcggaggtgtcataccgcacattcacaagtccctgatcaacaagtcatccaaggagtgaagattaggggatgtgcatctttagtttaaactggacttctgtgcgctcctgagcgagtccttgttgtaccgtaggttttagttgagctgttaggttggagctcctttgtgtaacgcttgcctggtagtgcttcattagttatttggttattgtgtttgtgttgagttgttaacttcaggggtgcaaacctggttgcttatttagttatgtgactactgctattcagtttatttttaaattttttgtagctgcaattatacttataatatgttgttgatagccctgtggggtgctgggggctcagatttatcatctccaaac

SEQ ID NO: 591 - DNA, 852 bp, Zea mays
  Clone ID: PAT_MRT4577_107185C.1
ctccatagggcgattgggtctctcgaggccggccggggcgctctgtttgtggcgtgcggaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactccgccgccatcctggagtacttgactgccgaggttctggagctggctgggaacgctagcaaggatctgaaggtgaagcgtatcacccctcgccacctacagttggccattcgcggagacgaggagctggacaccctcatcaagggcaccatcgcaggtggaggcgtcatcccgcacatccacaagtccctgatcaacaagtcctccaaggagtgaagactagggaatgcacattgttagtttaaactggacatttctgtgtgctcctctgcgagtccttgtcgtcgtgtaggttttagttgagctgtcaggttggagtgacccttctcctgtgtaacgcttgcctggtactgcttcagttatttggacactgtgtttgtgttgagttgttaacttcaagggtgcaaacctggataattatttagttattatatgactatctggtatccggtttatgctgaaaaaaaaaaaaaaaaaggcccctagggaggtgacttgtcatttgtgctcgttggtttgcatgacctgcatattcttgc

SEQ ID NO: 592 - DNA, 985 bp, Zea mays
  Clone ID: PAT_MRT4577_107186C.1
gccggccgggtcggggtggcgtgcggaaggagtcggagggaaccgaaaactcaggtgagggcttcttccgccgcacccgccgtcttatccgaactcctcgacccgattggcgcgattcgccgtttgttttcccgaatcggcgacgggatccgcccgattcggccgtcgatctgcgctgattcggcccgcgcgccgtcggggttcgctttcttctgcgcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttctggagctggctgggaacgctagcaaggatctgaaggtgaagcgtatcacccctcgccacctacagttggccattcgcggagacgaggagctggacaccctcatcaagggcaccatcgcaggtggaggcgtcatcccgcacatccacaagtccctgatcaacaagtcctccaaggagtgaagactagggaatgcacattgttagtttaaactggacatttctgtgtgctcctctgcgagtccttgtcgtcgtgtaggttttagttgagctgtcaggttggagtgacccttctcctgtgtaacgcttgcctggtactgcttcagttatttggacactgtgtttgtgttgagttgttaacttcaagggtgcaaacctggataattatttagttattatatgactatctggtattcggtttatgctgttgggcagtggccagttggggctcgggtttgtaatttgtcatttgtgctggttggttgtcatgacctgctatttcttgc

SEQ ID NO: 593 - DNA, 309 bp, Zea mays
  Clone ID: PAT_MRT4577_107313C.1
tggcgacgccagggcggagagcacacaccgaagcgggccgctgcggcggcgcaggcgcaggcgcaggcgcttacatgggagtagtagaaccgggcgggtgcacggcggaggcggtcgtgaacgggtctacgcttggggttggaagttcttcacggccctcctgttcttttgggcggcggcggccgcggcagactcttactagctagctagcaaccttcttcctcctcctccttgtaggtagtagtagtagtaggctacacaacaacgaccacatatatatatacatactaggtactactagcaggcgag

SEQ ID NO: 594 - DNA, 258 bp, Zea mays
  Clone ID: PAT_MRT4577_107364C.1
ctccactccccccttcacagatccgttcctccagctagggttagcgttcctcttctgctatggcgatcaagcggaccaaggcggagaagaacatcgcgtacgacaacaagctgtgcagcctcctcgatggttccaccaagtggctcatcgcccgcgcggccacgtcggttccaagcagctccaggacatccgccggggcctcaggggcgactcggtggtgctcatggggaagaacacgctcatccagcgctgcatcaa

SEQ ID NO: 595 - DNA, 484 bp, Zea mays
  Clone ID: PAT_MRT4577_107366C.1
ttttttttttttttttgttcactcggtccattttaatattataaagtaatattcagaactcagctccaactaacagaaacactttgttcgatcgacaaacttaaacaaaaatgcatgttgcacgactacggtagcataaatgccatagacaaatactgatcgccgataagatagcactacttctatgggaccaaactttactcgtcatcctcatcgtcgtcatctgcgccgcccgaggagttgagttggttgagcctttcaatgagactggccttcctctgctcgtatgtcagtttcttggggttgtacctcttgtgctcctttggtggctgcttggttgacttgaccacagaaggatcagcacggatggcagcatggaccttcttgtacagagcttccatgtcatcagcctcaattcccttcttaatgtacttactgaagtgagactggtacttctctggctcctcttcagcgaggtttctca

SEQ ID NO: 596 - DNA, 482 bp, Zea mays
  Clone ID: PAT_MRT4577_107370C.1
gtttgggttttttttttttttttttttttttttttttttttttttggtcgactcgggccaattttaatattataaaagtaaatattcagaactccagctccaaactaacagaaacaactttgttcgcatcgacaaacttaaacaaaaagggtgtggggacgactacaggtagcgataaatgccatagcacaaattctggtcgccgcataagatagcactacttcgatgggaccaaactttactcgtcatcctcatcgtcgtcatttgcgccgcccgaggagttgagttggttgagcctttcaatgagactggccttcctttgctcgtacgtaagtttcttggggttgtaccttttgtgctcctttggtggctgcttggttgacttgaccacagaaggatcagcacggatggcagcatggaccttcttgtacagagcttccatgtcatcagcctcaattcccttcttaatgtactcactgaag

SEQ ID NO: 597 - DNA, 554 bp, Zea mays
  Clone ID: PAT_MRT4577_107373C.1
tttttttttttttttttgttaactcggtccatttaatatataaaagtaatattagaactccgctccaactaacagaaacaactttgttcgatcgacaaacttaaacaaaaatgcatgttgacgactacggtgcgataatgcctagcacaaatctgatcgccgataagatagcactactttatgggacaaactttactcgtatcctcatcgtcgtcatctgcgccgccgaggagtgagttggtgagcctttaatgagactggccttcctctgctcgatgtagtttcttggggttgacctcttgtgctcctttggtggctgcttggttgacttgaccacagaaggatcagcacggatggcagcatggaccttcttgtacagagcttccatgtatagcctcaattcccttcttaatgtactcactgaagtgagactggtacttctctggctcctcttcagcgaggttcctcatgtagtcagcaacatggccaccatagatgtacttgcgatggatatcagcatccagctgcttgtcatccttcttgaaaccagcaaa

SEQ ID NO: 598 - DNA, 254 bp, Zea mays
  Clone ID: PAT_MRT4577_107426C.1
agcgcgtccacctcccaaacccctactcccccaggaagcaatggcttcccccacccagggccaggtcatcacctccaaagcggcggtggcgtacgacaacaacaagccgctcgtgatcgaggacgtgcaggtggcgccgccgcagccggcgaggtccgcgtcaagatcctcttcaccgcgctctgccacaccgaccacttgtcctggagcggtaaggatcctgagggtctttttccttgcattcttggccacga

SEQ ID NO: 599 - DNA, 368 bp, Zea mays
  Clone ID: PAT_MRT4577_107482C.1
tcgagcggccgcccgggcaggtacaagctttttttttttttttttttttatcttttactttctttttttatttctgggaagcctcaaacatcagcacaaaaacttattattgacctattactgataagaaatctaaaagagggcaccacctatgatgggacgttggcggaacgctgctggatttgtgaaagcaagccgattgaatggcagcaaaagacgcacttgtaagagggtgccagcgttgggcgcagggcggtggtagaacgacaacaactggggttgcgtgaataatgcaccagggctcacaccagctacccggctgaatggtggtagttgatgctgctgtgaataagcctgatagttcaatg

SEQ ID NO: 600 - DNA, 522 bp, Zea mays
  Clone ID: PAT_MRT4577_107781C.1
agtgtatatatatatatatagtatcaaatcatatcatcggggaccaattaatatatggttacagcagacgcaatcgggtcaaccaacatgcatgtagacacacgtacatgagcacaaagactgaccccaaacatgcagagagagagatagcaaactgaagaactctgtttctttctctctctcacacaccacacaatacctatgtatggcagccagctcggcctcgcttattattgttcaaccaccaccacaagctagatagataataatcatatccatggtcgtcgatcgatgtgaacagcagttgcaggggtcgaacttgcagctgttacccgaaccgtaggcgtgggcggactcaacggacttcgccgcgggctctacgaactcgggcgcgggcttcttatccggggccacccctaggactactgcggcctgcgcgggggtgcttgtcttctccaggtaaaggtacttcttgccgcacttgcagcttgagccgcagccgcagcttgatccgcagttgca

SEQ ID NO: 601 - DNA, 547 bp, Zea mays
  UNSURE (1)..(547): unsure at all n locations
  Clone ID: PAT_MRT4577_107783C.1
  unsure (1)..(547): unsure at all n locations
agtatcaaatcatatcatcgtggaccaattaatatatggttacagcagatgcaatcggatcaaccaacatgcaggtagacacacgtacgtacatgagcacaaagactgacgccaaacatgcagagagagatagcaaactgaagaactctgtttcttttttttttacacacaccacacaatacctatgtatgggagccagcttggccttgcttattattggtcaaccaccaccacaagcttgatagataataatcatattcatgggcgtcgatcgatgtgatcagcaattgcaggggtcgcacttgcagttgccaccgcaactgcagccgtgggcgggctctccggacttcgccgcgggcttgacgaacttgggcgcgggcttcttcttcggggccacgccgaggacaaccgtggcctgcgcgngcggtgctcttctcctccaggtcagggtacttcttgtcgcacttgcagcttgagccgcagccgcagcttgatccgcagttgcaagacatactctacctctgtggtgcaaaaaaaactcgatctc

SEQ ID NO: 602 - DNA, 1046 bp, Zea mays
  Clone ID: PAT_MRT4577_107935C.1
cattgggtacctcgaggccggccgggagactattaaggccttcagaccgggagggctccctgtcctgtcccccgcgccgccgcggatggccggagccaccacgccggcatcaggcgccctcgtcaggctctgcctgccttcgctcctcctctttctgtaccggtgctgcagatgtgaggctgttgagatggagagaacccttgcgatgatcaagcccgatggtttgtcaggtaagtacacagaagcaatcaaggaggtcatcttggattctggatttcatatcgtcaaagaaaccgaggtccagcttgatgctgagagggcatctgtcttctatgcggagcattcccagagaagcttctttgacagcctagtcaagtacataacaagtggtccagttcttgctatggttctggaaagaccggacgccgttgcgcaatggcgcactttgattggaccaactgatgcaaaaaaggccaaaacctctcatccaaacagcattagagcaatgtgtgggctggactctgagaaaaattgcgtgcatggttcggattcaccagaatctgcagacagagagatctcatttttcttcggagaagctgaatccgtaactgtggaacatgatgagctatagacgccacactggtatcagtggcaatattggccggctcattggacaacgtgggagagtatcgactctgctgcttctagtgttcgtcatgcttcttttatgaactaaacccgaagacgctgcaatttgaggaggggatgtcagttgtcacagaggagagagtcatttttagggctagtttggaaatctcatttttttcaagagatttttattttcctaaaggaaattagtttatttttctttgagaaaatagaattcccttgggaaattagagtttctaaacgagcccttaatttcgtaaaattatgtccggagtccatatttcctatcggagcaccatggtccttgaacttgcaaaactatatggtgcaaaccaaatattgttttttcatccgtgttgacgtcttgtgtggcataa

SEQ ID NO: 603 - DNA, 1937 bp, Zea mays
  Clone ID: PAT_MRT4577_107936C.1
cattgggtacctcgaggccggccgggagatattttcgaatcagaccgggagggctccctgtcctgtcccccgcgccgccgcggatggccggagccaccacgccggcatcaggcgccctcgtcaggctctgcctgccttcgctcctcctctttctgtaccggtgctgcagatgtgaggctgttgagatggagagaacccttgcgatgatcaagcccgatggtttgtcaggtaagtacacagaagcaatcaaggaggtcatcttggattctggatttcatatcgtcaaagaaaccgaggtccagcttgatgctgagagggcatctgtcttctatgcggagcattcccagagaagcttctttgacagcctagtcaagtacataacaagtggtccagttcttgctatggttctggaaagacctgacgccgttgcgcaatggcgcactttgattggaccaactgatgcaaaaaaggccaaaacctctcatccaaacagtactctttgtcatttcagcattagagcaatgtgtgggctggactctgagaaaaattgcgtgcatggttcggattcaccagaatctgcagacagagggatctcatttttcttcggagaagctgaatccgtaactgtggaacatgatgagctatagacgccacactggtatcaggcaagtcagcaaactgaattttgatgtgtctttgaactcttaggctatctcctgtagcttcttactcgtacccgtttcttattattttaaaagttattatgtaaacagtataatttatagtgcaaaacagtgtcttgcatggccatatgcttgtggcttcatatgcagagtttactgatctgctgtgcacattgtgattgctaagactaggatggctgagcagctgaggcctattggccattcatatgcttctgcttgctcaagtgtttactctcgaagtaattatgggcatgtttggttcggattattattctcttttccacggagaaacaccagaatcgacggatagtccgccaaatgtcatgctttttccgcttttcctcaccgcggcttcggtagcaagcgtggggttgaacaaaaaggccagaatcgtaagacgccaatagaatcatgattctccccaccgtcgattgtttcggacgcgctcccgtgaaaagcgagtacaaacatgccctatgtgtaaagaaacttatatactactcccttcattcttttttatttgtcgcggattcgaaaacagaggtagtatttgattgcactggcactgcacacaaatagatctttgcaactgtcacttggcagtccttcaaataatgcaaattaggatacagtagaatagaatccatgaaacgggaagagaagtgctggtttgtccaagagccggatgcttaggatcaggaatttattttcaaataatgcaaattatgctggcagattggtttcttttttttatttttattttcgcaaggatatagatttgcttgtggtctgtttattcatcatgtagtttcgtttgctttggtgagtagtggcaatattggccggctcattggacaacgtgggagagtatcgactctgctgcttctagtgttcgtcatgcttcttttatgaactaaacccgaagacgctgcaatttgaggaggggatgtcagttgtcacagaggagagagtcatttttagggctagtttggaaatctcatttttttcaagagatttttattttcctaaaggaaattagtttatttttctttgagaaaatagaattcccttgggaaattagagtttctaaacgagcccttaatttcgtaaaattatgtccggagtccatatttcctatcggagcaccatggtccttgaacttgcaaaactatatggtgcaaaccaaatattgttttttcatccgtgttgacgtcttgtgtggcatactttgac

SEQ ID NO: 604 - DNA, 247 bp, Zea mays
  Clone ID: PAT_MRT4577_107976C.1
ctctaaccaagacctcttcggggtaggggttcttatggttttgtggagggcctatggcagcggctgatgtgtagtaccgttgctacgtcggctggcttgcctgggccaccagcaacgagtcgcttgagaatgccttctcctcctactgcgagatcctcgactccaaggtcatcaccgaccgggagacggggaggtctcgcggcttcagctttcttaccttctcctccgaaaacttcattctctactc

SEQ ID NO: 605 - DNA, 244 bp, Zea mays
  Clone ID: PAT_MRT4577_108267C.1
cagacggatgaactggcgaacggcatggagaaggtcgcggtgtccgaacccgaaaagcacggacacaatgaggaggagcacgaagtcgtcggcgaggagaaggagggccttctcgccaagctgcaccgcaccagttccaggtccaggtcgtcaggcgacgaggaagaggaggcggtcggtggggacagcgaggttatcgggaggaagaagaaggagatgggcctcgaggagaggctcgaggaga

SEQ ID NO: 606 - DNA, 418 bp, Zea mays
  Clone ID: PAT_MRT4577_108332C.1
tcttgcggattggtccgtgaacagccctgaggggctccacctttcccaggaggaccttatttagaagtttgccactggagttttcatgggttccttcctgtcactggctatctcataccccacccttgcttctttgccccacatgttcatcaatgggtacaacaatgtgcttgcttttgctgtcgagacaaactactcatacccacatgctgacaagatcaaggagtaccttaaggacccaaacaagtttgctgttccggcccggttgctgctggtgactctggcgcttcaactgcttccaaagaagaagagaaagcttcggagcctgaaaaggagtcggacgaggaaatgggcttcaaccttttcgacgactagagcttctgttttcgtcaaacttgtgcaaggtttggctttttta

SEQ ID NO: 607 - DNA, 336 bp, Zea mays
  UNSURE (1)..(336): unsure at all n locations
  Clone ID: PAT_MRT4577_108376C.1
  unsure (1)..(336): unsure at all n locations
atttctctctctcctctatctacacctctgcgccggctgggcgttacgcctgccgcggcgaagcttctgccctccccgccgtctcgctctgatccgcgtcggccgggaagatggcatgcggcttagggtcttatctgctcagccctttctggctttcttgtcagaggtgcaaagcgcggataggaagataccgttcagagaaaaagttatctacactgngatatctctcttgattcttctggtgtgcacacagctcccactctataggattcattcgacgactggagctgatcctttctactggatgcgtgntatcctcgcataaaccgtggcact

SEQ ID NO: 608 - DNA, 231 bp, Zea mays
  Clone ID: PAT_MRT4577_108660C.1
accactcttccgacattggccactttgacaatgaaattgttttgctcgtgctggagacctaccctggcgttaagcgcatcaccatcaaatccgagactgtccgatgagtgttctctgagaccaacactggcataattgttcttgatgagggtagcctgatataccttggttgtgcttttgctcatcctaacttgtcatgttcttggtcattcactaaccaaattattgtcc

SEQ ID NO: 609 - DNA, 415 bp, Zea mays
  Clone ID: PAT_MRT4577_108691C.1
acgcatctagcagacatcagtaaagcacaatattgtaccaacaatggcagccaaaatattatgcctgcttatgctccttggtctatctgcaagtgctgctaccgcgaccattttgccgcaatgctcgcaagctcctatagcttatcttcttacaacgtacatttgatcagcggtgtattatgactgtgaaaacccaattattcaaccctacaggatccaacaagcaatctcagctggcatattagctatatcacgcatttgcctccaacaattatcagccctattacatcaagtacctacggcgcatctattggcacataacattacggcacatcaactacaacaacttgtgctagcaaaacttgctgtgtactatcatcaacagcagaatcttgcattctaccaactaactgca

SEQ ID NO: 610 - DNA, 834 bp, Zea mays
  UNSURE (1)..(834): unsure at all n locations
  Clone ID: PAT_MRT4577_108742C.1
  unsure (1)..(834): unsure at all n locations
ngaaaccacccaccaccagcagctttcctctcagctcgagcgatcgatcgaatccttccgtcgcgttcgcgtttccgtttcgtgtgtttagaccaagtttccaatggctcctctcggtgacgctgttgcccccgcggccgccgccgccgccccaggcctcgtcgtctctttcggcgagatgttgatcgacttcgtgcctgacgttgccggcgtctccctcgccgagtccggcggcttcgtcaaggcgcccggaggcgcgcccgccaacgtcgcctgcgccatctccaagctcggcggctcctccgccttcatcggaaagtttggcgacgacgagttcggccacatgctggtggagatcctgaagcagaacggcgtgaacgccgagggctgcctgttcgaccagcacgcgcgcacggccctggccttcgtcacgctcaagtccaacggcgagcgcgagttcatgttctaccgcaacccgtcggccgacatgctcctcaccgaggccgagctcaacctggacctgatccgccgcgcccgcatctttcactacggctccatctcgctcatcaccgagccctgccgctcggcgcacgtcgccgccatgcgtgccgccaagtcggccggcatcctctgctcgtacgaccccaacgtccgcctgccgctctggccctctgcgcaggccgcccgcgacggcatcatgagcatctggaaggaggccgacttcatcaaggtgagcgacgatgaggtggccttcctcacccagggcgacgccaccgacgagaagacgtgctctccctctggttcgagggactcaagctgctcatcgtcaccgac

SEQ ID NO: 611 - DNA, 1416 bp, Zea mays
  Clone ID: PAT_MRT4577_108770C.1
acatgcaaagcgaagcgcgcgcacagagatctagctgaggctgagctactagctagcagctgctgcaggtctcctgacatggcgaaggacatcgaagcatcggggcccgaggccggcgagttctcggccaaggactacaccgaccctccgccggcgccgctcgtcgacgcggatgagctcaccaagtggtccctctaccgcgcggtcatcgccgagttcatcgccacgctgctcttcctctacatcaccgtggccaccgtcatcgggtacaagcaccagacggacgcggcggcgtcgggccccgacgcggcgtgcggtggcgtgggcatcctcggcatcgcgtgggccttcggcggcatgatcttcatcctcgtctactgcaccgccggcatctcaggtgggcacatcaacccggccgtgaccttcggcctgttcctggcgaggaaggtgtccctcgtccgcgcgctgctctacatcatcgcgcagtgcctgggcgccatctgcggcgtgggcctcgtcaagggcttccagagcgcctactacgtgcgctacggcggcggcgccaacgagctcagcgacggctactccaagggcaccggcctcgcccccgagatcatcggcaccttcgtgctcgtctacaccgttttttccgccaccgaccccaagcgcagtgcccgtgactcccacgtcccggtgttggcccctcttccgattgggttcgccgtgttcatggtgcacctggccaccatccccatcaccggcaccggcatcaacccggcgaggagcttgggagccgcggtcatctacaacaaggacaaggcctgggacgaccaatggattttttgggtgggcccactgatcggcgccgccatcgccgccgcctaccaccagtacgtgctgagagccagcgccaccaagctcgggtcctaccggagcaacgcctaagtccggcgccgccggacgcgtgtgggcgccaccgatcgatccaagtgtagatacgtacgccccgactccgtccagtatatgacgccctgtcttcttccttgggggaaaaaagtgtgatatatctttgctttctgtatatgtgagaatgcattctgtaagccagtcatgtgagtttcacagtctacttttagaacgatttaaacggccctgaatcttactttacttgcaactttagaggaaagtacgggaaaagaacctcacaacaagtcaccaagggacttgacagttggttggtatgtgttaggcctgcggcccaaataagcaagcccatcggcgggctccgtttttcctctgttgtactgccctaagtgcctgaaggccgaaccccctgaaccttgcgctgccaatgaggtaacgctccacaatttttctccctctgttttgtatcacgcgatttagattgagagttcg

SEQ ID NO: 612 - DNA, 441 bp, Zea mays
  Clone ID: PAT_MRT4577_108771C.1
gccggagctcagccggtccttggtgtaccgcgcggtcatcgccaagttcatcgccacgctgctcttcctctacatcaccgtggccaccgtgatcgggtacaagcaccagacggacgcgtcggcgtcgggccccgacgcggcgtgcggcggcgtcggcatcctcggcatcgcgtgggccttcggcggcatgatcttcatcctcgtctactgcaccgccggcatctcatgtgggcacatcaacccggccgtgaccttcggcctgttcctggccaggaaggtgtccctcgtccgcgcgctgctctacatcgtggcgcagtgcctgggcgccatctgcggcgtgggcctcgtcaagggcttccagagcgcctactacgtgcgctacggcggcggcgccaacgagctcagcgacggctactccaagggcaccggcctcgccgccga

SEQ ID NO: 613 - DNA, 1714 bp, Zea mays
  Clone ID: PAT_MRT4577_108772C.1
gccggccggttcggagaacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcgtcacgccaatcaattaagcgaggcgatgagctcgtcctctctcttgcacgagccgtcctcccacgccccacgcatatatacctcggcctctcgagtctccggcctcacagcacacaacaagcaaagcgaagcgcgcgcacagagatctagctgagctactagctatagcagcagctgctgcaggtctcctgacatggcgaagcaggacatcgaagcatcggggcccgaggccggcgagttctcggccaaggactacacggaccctccgccggcgccgctcatcgacgcggatgagctcaccaagtggtccctctaccgcgcggtcatcgccgagttcatcgccacgctgctcttcctctacatcaccgtggccaccgtcatcgggtacaagcaccagacggacgcggcggcgtcgggccccgacgcggcgtgcggcggcgtgggcatcctcggcatcgcgtgggccttcggcggcatgatcttcatcctcgtctactgcaccgccggcatctcaggtgggcacatcaacccggccgtgaccttcggcctgttcctggcgaggaaggtgtccctcgtccgcgccctgctctacatcatcgcgcagtgcctgggcgccatctgcggcgtcggcctcgtcaagggcttccagagcgcctactacgtgcgctacggcggcggcgccaacgagctcagcgacggctactccaagggcaccggcctcgccgccgagatcatcggcaccttcgtgctcgtctacaccgtcttctccgccaccgaccccaagcgcagtgcccgtgactcccacgtcccggtgttggcccctcttccgattgggttcgccgtgttcatggtgcacctggccaccatccccatcaccggcaccggcatcaacccggcgaggagcttgggagccgcggtcatctacaacaaggacaaggcctgggacgaccaatggatcttctgggtgggcccactgatcggcgccgccatcgccgccgcctaccaccagtacgtgctgagagccagcgccaccaagctcgggtcctaccggagcaacgcctaataagtccggcggcgggagctgtgggcgccaccgatcgatccaagtgtagatacgtacgctcccccgactccgtccagtatatgacgccctgtggtcgtccacatctgccaccacagtcccgtccgcttggtgctgttttctttctttccttgacggggaaaaaaagtgtgatatatctttgctttctgtatatgtgacaaaatgcattctgtaagccagtcatgtgagtttttatttaaccacagtctacttttagaacgatttaaacggccctgaatcttacttgcaactttagaggaaagtacgggaaaagaacctcacaagtcaccaagggacttgacagttggttggtatgtgttaggcctgcggcccaaataagcaagcccatcggcgggctccgtttctcctctgttgtactgccctagtgcctgaaggccgaaccccctgaaccttgcgctgccaatgaggtaacgctccac

SEQ ID NO: 614 - DNA, 2608 bp, Zea mays
  UNSURE (1)..(2608): unsure at all n locations
  Clone ID: PAT_MRT4577_108774C.1
  unsure (1)..(2608): unsure at all n locations
cggccgggacaacacacaacaagcaaagcgaagcgcgcgcacagagatctagctgaggctgagagctactagctagcagctgctgctgcaggtctcctgacatggcgaagcaggacatcgaagcatcggggcccgaggccggcgagttctcggccaaggactacaccgaccctccgccggcgccgctcgtcgacgcggatgagctcaccaagtggtccctctaccgcgcggtcatcgccgagttcatcgccacgctgctcttcctctacatcaccgtggccaccgtcatcgggtacaagcaccagacggacgcggcggcgtcgggccccgacgcggcgtgcggcggcgtgggcatcctcggcatcgcgtgggccttcggcggcatgatcttcatcctcgtctactgcaccgccggcatctcaggtgggcacatcaacccggccgtgaccttcggcctgttcctggcgaggaaggtgtccctcgtccgcgcccttctctacatcatcgcgcagtgcctgggcgccatctgcggcgtcggcctcgtcaagggcttccagagcgcctactacgtgcgctacggcggcggcgccaacgagctcagcgacggctactccaagggcaccggcctcgccgccgagatcatcggcaccttcgtgctcgtctacaccgtcttctccgccaccgaccccaagcgcagtgcccgtgactccacacgtcccggtgttggcccctccttccatttttgggttcggcccgtgttcatggtgcaccttggccaccatccccatcaccggcaccggcatcaacccggcgaggagcttgggagccgcggtcatctacaacaaggacaaggcctgggacgaccaatggatcttttgggtgggcccactgatcggcgccgccatcgccgccgcctaccaccagtacgtgctgagagccagcgccaccaagctcgggtcctaccggagcaacgcctaataagtccggcggcgggagctgtgggcgccaccgatcgatccaagtgtagatacgtacgcccccgactccgtccagtatatgacgccctgtgttcgtccacatctgccaccacagtcccctccgcttggtgctgttttcttctttccttggcggggaaaaaaagtgtgatatatctttgctttctgtatatgtgagaaaatgcattctgtaagccagtcatgtgagtttttatttaaccacagtctacttttagaacgatttaaacggccctgaatcttacttgcaactttagaggaaagtacgggaaaagaacctcacaagtcaccaagggacttgacagttggatcttatctctctttgcagccagtaggtcaccactcaaaagcttgtgaagcaggtgagatgggcaaggaggtggatgtgtccactctggaggccggcggcgtccgtgaccgtgactacgcggaccctccgccggcaccgctgatcgacatcgacgagctcggcatgtggtccctgtaccgcgccgtgatcgccgagttcgtggccacgctgctgttcctgtacatcacggtggccacggtgatcgggtacaagcaccagacggacgcgtcggcgtcggggcccgnnnnnnnnnnnnnnnnnnnnnnnntcctgggcatnnnnnnnnnnnnnnnnnnnnnnnnnnnnnnnnnnnnnnnnnnnnnnnnnnnnnnnnnnnnnnnnnncatcaacccggccgtcacgttcggcctcttcctggcgcgcaaggtctccctggtgcgcgctctgctgtacatggccgcgcagagcctcggcgccatctgcggcgtcgcgcacgagtattgcgttccagagcgcctacttcgaccggtacggcggcggcgccaactcgctcgcgtccggatnnnnnnnnnnnnnnnnnnnnnnnnnnnngatcgtcggcaccttcgtgctcgtgtacaccgtcttctccgccaccgaccccaagcgcaacgcccgcgactcccacgtcccggttctggctcccctccccatcggcttcgccgtgttcatggtccacctggccaccatccccgtcaccggcaccggcatcaacccggccaggagcctgggcgccgccgtcgtctacaacaaggacaagccatgggatgaccactggattttctgggtgggcccgctcctgggcgctgccatcgcggccttctaccaccagtacatcctccgggcgggcgccatcaaggctctcggctccttcaggagcaacgcgtgatgagcagagctaaagaaaggccttcgctggactgcgtgctggagcaacggcgatcgatcgatctagcgtggggagaggcggataggcgggcgcgcgagggaggagaataagtttgtgccggtggcccggtctcgtcggtcgcttttgttccagcatgcagctgcgtcgcgttcgtgtgcgtgcgtgggggtctccttaatttccccggcccctgtaatcatcaatcaccatgtgtgcgtataatatctgctgccaagggatcgattattccccccccccctctctctctatctgctcttgtagctccttctgttttatcgttattatgtagcgacaccaacgacgacgaccaccatc

SEQ ID NO: 615 - DNA, 219 bp, Zea mays
  Clone ID: PAT_MRT4577_108925C.1
gattagccagggaggcgagggcgacaccagactgattttctgttccatgaaaaccagcatacgcacacgaggttacgaggagtgcagaccaccactctggacaatctccagagaatgaaaaaaaagggttcttttctgcttttggcgctgacacaacagaaatcacctgagtagctttggagcagacaccaccatacatttattgcaaccgtacaaaca

SEQ ID NO: 616 - DNA, 927 bp, Zea mays
  Clone ID: PAT_MRT4577_10894C.1
agatgtctgcgctgtacctccaagtcagtattgtgagccaggctctgatcttcgtcacccgttcccgtagctggtccttcgtggagcgccctggtctgctcctggtcaccgcgttcctgctcgctcaacttgttgcgaccttcctcgctgtgtacgccaactggggcttcgccaggatcaagggtatcggctggggctgggctggtgtcgtctggctctacagcatcgtgttctacttccctctggacctgatcaagttcttcatccgctttgtgctcagcggcagggcatgggacaaccttctcgagaacaagaccgccttcaccaccaagaaggattacggacgggaagagagggaggcgcaatgggccaccgcgcagaggacgctgcacggtctccagccgccggaggctgccaccaacactctgttcaacgacaagagcagctaccgcgagctgtcggagatcgctgagcaggccaagagacgagctgagatcgcgaggctgagggagctcaacaccctcaagggccacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctctataccaccagatactgccatatgatggtatggttgggtacccgtctttctagggagtttcttttctctctctcttttcttattgttatgtttttcaatagtggagtgtgcgcgtgttgtaatcgtttttacctgcgttttcctctaactagccggtgatctcgcgggaagcgaggtgaagaaataatgcaactaaaattctctgccaaaagcattgttccttctcacttgggt

SEQ ID NO: 617 - DNA, 402 bp, Zea mays
  Clone ID: PAT_MRT4577_108964C.1
atcaccctcgagaagccacgctggctcatcgccgccgccaacatcttcgtcgtcgtgcacgtcatcggcagctaccagatctacgccatgcccgtgttcgacatgctcgagacgttcctggtgaagaaactccggttcaagccaggcatgcctctccgtttgatagcgcgctcgctctatgttgtgctgacagctctggttggcatcgccgtgccgttcttcggggggctgctagggttctttggtggcttcgcatttgcgccgacaacctactaccttccgtgcattctgtggttgaagattaagaagccaaagaagttcagcctctcttggttcatcaactggttctgcatcatagtcggcgtgctcctgacggtgcttgcgcccattggaggcctccgg

SEQ ID NO: 618 - DNA, 2182 bp, Zea mays
  Clone ID: PAT_MRT4577_10896C.1
ctggccgcgagggcatcgaggaccgagaaccaggacgccatcgacgccgccatggttggcatgcttgctgaccctaaggaggccagggctggtatcagggagatccacttcttgcccttcaaccctgtcgacaagaggactgctctgacgtacattgatgccgatggccactggcaccgtgtcagcaagggtgcccctgaacagattcttgacctgtgccactgcaaggaggatctgaggcgtaaggtgcacggtatcatcgacaagtatgccgagcgtggtcttcgttcgcttgctgttgccagacaggaagtgcctgagaggaacaaggagtcccctggtggaccatggcagttcgttggtctgttgcctttgtttgatccgcccaggcatgacagtgctgagacgattcgcaaggctcttgttcttggtgtcaacgtcaagatgattacgggtgatcagcttgctatcggtaaggagaccggaaggaggctcgggatgggtaccaacatgtatccttcctcagcattgctcggccaaaacaaggatgctacgctcgaggcacttcctgtagacgagctcatcgagaaggccgacggttttgccggagtcttccctgaacacaagtacgagatcgtgaagagactgcaagagaagaagcacatcgttggtatgactggagacggtgtcaacgacgccccggctcttaagaaggccgacatcggtatcgctgtcgcggacgctaccgacgcggccaggagcgcttccgacattgtccttactgagccaggtctcagtgtcatcatcagcgctgtcctcaccagcagatgcatcttccagaggatgaagaactacaccatctatgcagtctccatcacaatccgtatagtgcttggatttatgctcattgcattgatctggcaatacgatttctcccccttcatggtccttatcatcgccattctcaacgacggcactatcatgaccatctctaaggacagagttaagccgtctccgttgccggacagctggaagctgaaggagatctttgccacgggcatcgtgcttggaagctacctcgctctgatgactgtcattttcttctgggctatgcacaagaccgacttcttctcggacaaattcggtgtgaggtcgatcagggacagtgagcatgagatgatgtccgcgctgtacctccaagtgagtatcgtgagccaggctctgatcttcgtcacccggtcccggagctggtccttcgtggagcgccctggcctgctcctggtcaccgcgttcctgctcgcccagcttgtcgcgaccttcctcgctgtctacgccaactggggcttcgccaggatcaagggtatcggctggggctgggccggtgtggtctggctctacagcatcgtgttctacttccctctggacctgatcaagttcttcatccgtttcgtgctcagcggcagggcatgggacaacctcctggagaacaagaccgccttcaccaccaagaaggactacgggcgggaggagagggaggcgcagtgggccaccgcgcagaggacgctgcacgggctccagccgccggaggccgccaccagcacgctgttccacgacaagaacagctaccgcgagctgtccgagatcgcggagcaggccaagaggcgcgccgagatcgcgaggctgcgggagctcaacaccctcaagggccacgtggagtcggtggtcaagctcaagggcctggacatcgacaccatccagcagaactacacggtgtgagatgtgtgctgtgatgtcgacgaaaacacctttgccatgccacccttgttgttcttgcgacgacggagtcatgtgattgttacagaaaaaaagaagaaaattttccggtgatgtgattggagacaatagaagcgtgtacgtacgtacgtgtggctgatcctgaccccgagcatgcagagcagccctaggtgaggtgaccattgccaccagatatatacccgtctttctagcttagctagggagcttcttcttcttttttttccctcttgttattgtcaagtgtgtgcgcgtgttgtaatggttttactcgcctaactagccggtggtctcgcgaggcgaagaaataatgcaaccgaaagcattattgctctcttctgacttgattgatgctggcagcagaatgtgt

SEQ ID NO: 619 - DNA, 3515 bp, Zea mays
  Clone ID: PAT_MRT4577_10899C.1
aattcggcacgaggcccgttccactcgacgcccagcaagcgctactactccaccaccaccactactttgcttgcttgcccctttcccttcccttctcacacgagaagagaagcgagtcggcgttcgcgtggcatatgcccgtgtctgccgccgggcttggcttctagggtccgctccagcgccggccgaccgccatgggtgggctcgaggagatcaagaatgaagccgtcgatctggagaacatccccatcgaggaggtgttcgagcagctgaaatgcacccgcgaggggctgagctccagcgagggccagcagcgcctcgagatcttcggccccaacaggctcgaggagaagaaggaaagcaagatcctcaagttcctcgggttcatgtggaacccgctgtcgtgggtcatggagatggccgccgtcatggccatcgccctcgccaacggcggcggcaagccccccgactgggaggacttcgtcggcatcatcgtgctcctggtcatcaactccaccatctccttcatcgaggagaacaatgccggcaacgccgcggccgcgctcatggccaaccttgctcccaagaccaaggttctgagagatggccgatggggcgagcaagaggctgcgatcttggttcctggtgacatcgtcagcatcaagctcggtgacatcgtccctgccgacgcgcgtctcctcgagggcgatcctctcaaggttgaccagtccgcgcttaccggagagtcgctcccggttaccaagggtcccggggacgaggtgttctcggggtccacctgcaagcagggcgagatcgaggccgtggtgatcgccaccggagtgcacaccttcttcggcaaggccgctcacctcgtggacagcaccaaccaggtggggcacttccagcaggtcctgacggcgatcgggaacttctgcatctgctcgatcgcggtgggcatcgtcgtcgagatcatcgtcatgttcccgatccagcaccgcaggtaccgcagcgggatcgagaacctgctggtgctcctgatcggcggcatcccgatcgccatgcccaccgtgctctcggtcaccatggccatcggctcgcacaagctgtcgcagcagggcgccatcaccaagaggatgaccgccatcgaggagatggccgggatggacgtgctctgcagcgacaagaccggcacgctcaccctcaacaagctcagcgtcgacaagaacctcgtcgaggtgttctgcaagggcgtcgacaaggaccacgtgctgctgctggccgcgagggcgtcgaggaccgagaaccaggacgccatcgacgccgccatggttggcatgcttgctgaccctaaggaggccagggctggtatcagggagatccacttcttgcccttcaaccctgtcgacaagaggactgctctgacgtacattgatgccgatggccactggcaccgtgtcagcaagggtgcccctgaacagatccttgacctgtgccactgcaaggaggatctgaggcggaaggtgcacggtatcatcgacaagtatgccgagcgtggtcttcgttcgcttgctgttgccagacaggaagtgcctgagaggaacaaggagtcccctggtggaccatggcagttcgttggtctgttgcctttgtttgatccgcccaggcatgacagtgctgagacgattcgcaaggctcttgttcttggtgtcaacgtcaagatgattacgggtgatcagcttgctatcggtaaggagaccggaaggaggctcgggatgggtaccaacatgtatccttcctcagcattgctcggccaaaacaaggatgctacgctcgaggcacttcctgtagacgagctcatcgagaaggccgacggttttgccggagtcttccctgaacacaagtacgagatcgtgaagagactgcaagagaagaagcacatcgttggtatgactggagacggtgtcaacgacgccccggctcttaagaaggccgacatcggtatcgctgtcgcggacgctaccgacgcggccaggagcgcttccgacattgtccttaccgagcctggtctcagtgtcatcatcagcgctgtcctcaccagcagatgcatcttccagaggatgaagaactacaccatctatgcagtctccatcacaatccgtatagtgcttggatttatgctcattgcattgatctggcaatacgatttctcccccttcatggtccttatcatcgccattctcaacgacggcactatcatgaccatctctaaggacagagttaagccgtctccgttgcccgacagctggaagctgaaggagatctttgccacgggtatcgtgcttggaagctacctcgctctgatgactgtcattttcttctgggctatgcacaagaccgacttcttctcggacaaattcggtgtgaggtcgatcagggacagcgagcatgagatgatgtccgcgctgtacctccaagtgagtatcgtgagccaggctctgatcttcgtcacccggtcccggagctggtccttcgtggagcgccctggcctgctcctggtcaccgcgttcctgctcgcccagcttgtcgcgaccttcctcgctgtctacgccaactggggcttcgccaggatcaagggtatcggctggggctgggccggtgtggtctggctctacagcatcgtgttctacttccctctggacctgatcaagttcttcatccgcttcgtgctcagcggcagggcatgggacaacctcctggagaacaagaccgccttcaccaccaagaaggactacgggcgggaggagagggaggcgcagtgggccaccgcgcagaggacgctgcacgggctgcagccgccggaggccgccaccagcacgctgttccacgacaagaacagctaccgcgagctgtccgagatcgcggagcaggccaagaggcgcgccgagatcgcgaggctgcgggagctcaacaccctcaagggccacgtggagtcggtggtcaagctcaagggcctggacatcgacaccatccagcagaactacacggtgtgagatgtgatcgagagagcctgctgtgatgtcgacgaaaacacctttgccatgccatgccatgccacccttgttgttcttgcgacgacggagtcatgtgattgttacagaaaaaaagaagaaaattttccggtgatgtgattggagacaatcagacaatagaagcgtgtacgtacgtacgtgtggctgatccctgaccccgagcagagcagccctaggtgaggtgaccattgccaccagatatatacccgtctttctagcttagctagggagcttcttcttcttttttttccctcttgttattgtcaagtgtgtgcgcgtgttgtaatggttttactcgcctaactagccggtggtctcgcgaggcgaagaaataatgcaaccgaaagcattattgctaaaaaaaaaaaaaaaaaaaaaaaaaaaaaaaaaaaaaaaaactcgaggggggagcccgggtaccccaat

SEQ ID NO: 620 - DNA, 3380 bp, Zea mays
  Clone ID: PAT_MRT4577_10901C.1
gaattcggggcggtggaacagaggaggagcccgactgaggctaggcggcggaggcctgggcggacggatccatgagaagaagcggacccttcctttctcgcacgggaagagtagcgaggaggcgcgggccccgtgcgggtatgcccgtgcctgccgtcgcgtccgcctctaggactagggtccgctccagcgccagccgtccgccatgggtgggctcgaggagatcaagaacgaagccgtcgatctggagaacatccccatcgaggaggtgttcgagcagctgaaatgcacccgcgaggggctgagctccagcgagggccagcagcgtctcgagatctttggccccaacaggctcgaggagaagaaggagagcaaggtcctcaagttccttgggttcatgtggaacccgctgtcatgggtcatggagatggctgccatcatggctattgcactcgccaacagtggtggcaagcccccggactggcaggacttcgtcggtatcatcgtgctcttggttatcaactccaccatctccttcattgaggagaacaatgccggcaacgcggccgccgcactcatggccaaccttgctccaaaaaccaaggttctgagagatggccgatggggcgagcaagaggctgcaatcttggttcctggtgacatcatcagcatcaagcttggcgatatcatccctgccgacgctcgtcttctcgagggtgatccactcaaggttgaccagtctgcgcttactggagaatccctcccggttaccaagggcccaggggacgaagtcttctcgggttccacttgtaagcagggtgagatcgaggccgtggtcattgccaccggagtgcacaccttcttcggcaaggccgctcatcttgtggacagcaccaaccaggtcggacacttccagcaggtgctgacagcaatcggtaacttctgcatctgctccattggggtcggcatcctcgttgagatcatcgtcatgttcccaatccagcaccggaggtaccgcagcggaatcgagaacctgttggtcctcttgatcggtggtatcccaatcgccatgcctaccgtgctttcagttaccatgccgattggttcgcacaagctgtcacagcagggtgccatcactaagaggatgactgccattgaggagatggctggtatggacgtgctttgcagtgacaaaaccggcacactcaccctcaacaagcttagcgtcgataagaacctcgtcgaggtgttctgcaaaggcgtcgacaaagaccatgtgttgctgttggctgcaagggcttcaagaactgagaacctggacgctatcgatgccgccatggttggcatgcttgctgatcctaaggaggccagggctggtataagggaaatccacttcttgcccttcaaccctgttgataagaggactgctctgacgtacattgatgccgatggcaactggcaccgtgtcagcaagggtgctcctgaacagattcttgacctgtgccactgcaaggaggatctgaggcggaaggtgcactctattatcgacaagtatgccgagcgtggtcttcgttcgcttgctgttgccagacaggaagtacctgagaaaaacaaggagagtccgggggggccatggcagttcgttggtctgttgcgggtgtttgatccgcctaggcatgacagcgctgagacaattcgcaaggctcttgttcttggtgttaacgtcaagatgatcacgggtgatcagcttgctattggtaaggagactggaaggaggcttggcatgggtaccaacatgtatccatcctctgcgctgctcggccaaaacaaggatcgtacgcttagcgctcttcctgtagatgagctcattgagaaggccgatggttttgccggagtcttccctgaacacaagtacgagatcgtgaagagactgcaggagaagaagcacatcgttggtatgactggagatggtgtcaacgatgccccggctcttaagaaggctgacatcggtattgctgttgcggatgctactgacgctgcgaggagtgcttccgacattgtccttactgagccaggtcttagcgtaattatcagcgccgtcctcaccagcagagcaatcttccagaggatgaagaactacaccatctatgcagtttccatcacaatccgtatagtgctcggatttatgctcattgcgttgatctggcaatacgatttctctcccttcatggttcttatcattgccattctcaatgacggtactatcatgaccatctctaaggacagagttaagccatctccgttgcccgacagttggaagctgaaggagatctttgctacgggcatcgtgcttggaagctaccttgctctgatgactgtcattttcttctgggctatgcacaagaccgacttcttctcggacaaattcggtgtgaggtcgatcagggacagcgagcatgagatgatgtccgccctgtacctccaagtcagtatcgtgagccaggctctgatcttcgtcacccgttcccgtagctggtccttcgtggagcgccctggtctgctcctggtcaccgcgttcctgctcgctcaacttgttgccaccttcctcgctgtctacgccaactggggcttcgccaggatcaagggtatcggctggggctgggcaggtgtcgtctggctctacagcatcgtcttctacttccccctggacctgctcaagttcttcatccgcttcgtgctcagcggcagggcatgggacaacctcctcgacacgcgaattgccttcacgcggcaccaagaccttcggaaaggagagagggaggcgcagtgggccaccgcgcagaggacgctgcacgggctccagccgccggaggcttcctccaacacgctgttcaacgacaagagcagctaccgcgagctgtccgagatcgccgagcaggccaagagacgagctgagatcgcgaggctgagggagctcaacaccctcaagggccacgtggagtcggtggtcaagctcaagggcctggacatcgaccccatccagcagaactacccggtgtgagagcccctctgctgcgatgtcgacgacaacacctttgctgcccgacgggagccatctgattacagataaaaattttcctagctgtaaagctctctataccaccagatactgccatatgatggtatggttgggtacccgtctttctagggagtttcttttctctctctctctctttttctattgttatgtttttcaatagtggagtgtgcgcgtgttgtaatcgtttttacctgcgttttcctctaactagccggtgatctcgcgggaagcgaggtgaagaaataatgcaactaaaattctctgccaaaaaaaaaaaaaa

SEQ ID NO: 621 - DNA, 6615 bp, Zea mays
  Clone ID: PAT_MRT4577_10903C.1
ggcagagaattttagttgcattatttcttcacctcgcttcccgcgagatcaccggctagttagaggaaaacgcaggtaaaaacgattacaacacgcgcacactccactattgaaaaacataacaataagaaaagagagagagaaaagaaactccctagaaagacgggtacccaaccataccatcatatggcagtatctggtggtatagagagctttacagctaggaaaatttttatctgtaatcagatggctcccgtcgggcagcaaaggtgttgtcgtcgacatcgcagcagaggggctctcacaccgtgtagttctgctggatggtgtcgatgtccaggcccttgagcttgaccaccgactccacgtggcccttgagggtgttgagctccctcagcctcgcgatctcagctcgtctcttggcctgctcggcgatctcggacagctcgcggtagctgctcttgtcgttgaacagcgtgttggaggaagcctccggcggctggagcccgtgcagcgtcctctgcgcggtggcccactgcgcctccctctcttcccgcccgtagtccttcttggtggtgaaggcggtcttgttctcgaggaggttgtcccatgccctgccgctgagcacgaagcggatgaagaacttgagcaggtccagggggaagtagaagacgatgctgtagagccagaccacacctgcccagccccagccgatacccttgatcctggcgaagccccagttggcgtagacagcgaggaaggtggcaacaagttgagcgagcaggaacgcggtgaccaggagcagaccagggcgctccacgaaggaccagctacgggaacgggtgacgaagatcagagcctggctcacgatactgacttggaggtacagggcggacatcatctcatgctcgctgtccctgatcgacctcacaccgaatttgtcctgcgcaatgacatggtgctgagaacaaccagacaggaaaaaaaccctaccgatcgaggagatcgatgcaaagggctagtgggtatttttttaccgagaagaagtcggtcttgtgcatagcccagaagaaaatgacagtcatcagagcaaggtagcttccaagcacgatgcccgtagcaaagatctccttcagcttccaactgtcgggcaacggagatggcttaactctgtccttagagatggtcatgatagtaccgtcattgagaatggcaatgataagaaccatgaagggagagaaatcgtattgccagatcaacgcaatgagcataaatccgagcactatacggattgtgatggaaactgcatagatggtgtagttcttcatcctctggaagatgcatctgctggtgaggacggcgctgataatgacgctaagacctggctcagtaaggacaatatcggaagcactcctcgcagcgtcagtagcatccgcaacagcaataccgatgtcagccttcttaagagccggggcatcgttgacaccatctccagtcataccaacgatgtgcttcttctcctgcagtctcttcacgatctcgtacttgtgttcagggaagactccggcaaaaccatcggccttctcaatgagctcatctacaggaagcgcttcaagcgtagcatccttgttttggccgagcagcgcagaggatggatacatgttggtacccatgccaagcctccttccagtctccttaccaatagcaagctgatcacccgtgatcatcttgacgttaacaccaagaacaagagccttgcgaattgtctcagcgctgtcatgcctaggcggatcaaacaggggcaacagaccaacgaactgccatggtccaccaggggactccttgtttttctcaggtacttcctgtctggcaacagcaagcgaacgaagaccacgctcggcatacttgtcgataatagagtgcaccttccgcctcagatcctccttgcagtggcacaggtcaagaatctgttcaggagcacccttgctgacacggtgccagttgccatcggcatcaatgtacgtcagagccagtcctcttatcaacagggttgaagggcaagaagtggatttcccttataccagccctggcctccttaggatcagcaagcatgccaaccatggcggcatcgatagcgtcctggttctcagtccttgaagcccttgcagccaacagcaacacatggtctttgtcgacgcctttgcagaacacctcgacgaggttcttatcgacgctaagcttgttgagggtgagtgtgccggttttgtcactgcaaagcacgtccataccagccatctcctcaatggcagtcatcctcttagtgatggcaccctgctgtgacagcttgtgcgaaccaatggccatggtaactgaaagcacggtaggcatggcgattgggataccaccgatcaagaggaccaacaggttctcgattccgctgcggtacttccggtgctggattgggaacatgacgatgatctcgacgaggatgccgaccccaatggagcagatgcagaagttaccgattgctgtcagcacctgctggaagtgtccgacctggttggtgctgtccacaagatgagcggccttgccgaagaaggtgtgcactccggtggcaatgaccacggcctcgatctcaccctgcttacaagtggaacccgagaagacttcgtcccctgggcccttggtaaccgggagggattctccagtaagcgcagactggtcaaccttgagtgcatcaccctcgaggagacgagcgtcggcagggacgatatcgccaagcttgatgctgatgatgtcaccaggaaccaagattgcagcctcttgctcgccccatcggccatctctcagaaccttggttttgggagcaaggttggccatgagtgcggcggcggcgtttccggcattgttctcctcaatgaaggagatggtggagttgataaccaagagcacgatgataccgacgaagtcctgccagtccgggggcttgccaccaccgttggcgagtgcaatagccatgatggcagccatctccatgacccacgacagcgggttccacatgaacccaaggaacttgaggatcttgctctccttcttctcctcgagcctgttggggccaaagatctcgagacgctgctggccctcgctggagctcagcccctcgcgggtgcatttcagctgctcgaacaccaccactctctagtctcaccgccccccgtcccgctcattggacgagacgacggacccttcctttctcgcacgggaagagtagcgaggaggcgcggcgcccgtgcggcgtatgcccgtgcctgccgtcgggttccgcctctaggactagggtccgctccagcgccagctagccgtccgccatgggtgggctcgaggagatcaagaacgaagccgtcgatctggagaacatccccatcgaggaggtgttcgagcagctgaaatgcacccgcgaggggctgagctccagcgagggccagcagcgtctcgagatctttggccccaacaggctcgaggagaagaaggagagcaagatcctcaagttccttgggttcatgtggaacccgctgtcatgggtcatggagatggctgccatcatggctattgcactcgccaacggtggtggcaagcccccggactggcaggacttcgtcggtatcatcgtgctcttggttatcaactccaccatctccttcattgaggagaacaatgccggcaacgccgccgccgcactcatggccaaccttgctcccaaaaccaaggttctgagagatggccgatggggcgagcaagaggctgcaatcttggttcctggtgacatcatcagcatcaagcttggcgatatcgtccctgccgacgctcgtctcctcgagggtgatgctctcaaggttgaccagtctgcgcttactggagaatccctcccggttaccaagggcccaggggacgaagtcttctcgggttccacttgtaagcagggtgagatcgaggccgtggtcattgccaccggagtgcacaccttcttcggcaaggccgctcatcttgtggacagcaccaaccaggtcggacacttccagcaggtgctgacagcaatcggtaacttctgcatctgctcgattggggtcggcatcctcgtcgagatcatcgtcatgttcccaatccagcaccgcaagtaccgcagcggaatcgagaacctgttggtcctcttgatcggtggtatcccaatcgccatgcctaccgtgctttcagttaccatggccattggttcgcacaagctgtcacagcagggtgccatcactaagaggatgactgccattgaggagatggctggtatggacgtgctttgcagtgacaaaaccggcacactcaccctcaacaagcttagcgtcgataagaacctcgtcgaggtgttctgcaaaggcgtcgacaaagaccatgtgttgctgttggctgcaagggcttcaaggactgagaaccaggacgccatcgatgctgccatggttggcatgcttgctgatcctaaggaggccagggctggtatcagggaaatccacttcttgcccttcaaccctgttgataagaggactgctctgacgtacattgatgccgatggcaactggcaccgtgtcagcaagggtgctcctgaacagattcttgacctgtgccactgcaaggaggatctgaggcggaaggtgcactctattatcgacaagtatgccgagcgtggtctccgttcgcttgctgttgccagacaggaagtacctgagaaaaacaaggagtcccctggtggaccatggcagttcgttggtctgttgcccctgtttgatccgcctaggcatgacagcgctgagacaattcgcaaggctcttgttcttggtgttaacgtcaagatgatcacgggtgatcagcttgctattggtaaggagactggaaggaggcttggcatgggtaccaacatgtatccttcctctgcgctgctcggccaaaacaaggatgctacgcttgaagcgcttcctgtagatgagctcattgagaaggccgatggttttgccggagtcttccctgaacacaagtacgagatcgtgaagagactgcaggagaagaagcacatcgttggtatgactggagatggtgtcaacgatgccccggctcttaagaaggctgacatcggtattgctgttgcggatgctactgacgctgcgaggagtgcttccgatattgtccttactgagccaggtcttagcgtcattatcagcgccgtcctcaccagcagatgcatcttccagaggatgaagaactacaccatctatgcagtttccatcacaatccgtatagtgcttggatttatgctcattgcgttgatctggcaatacgatttctctcccttcatggttcttatcattgccattctcaatgacggtactatcatgaccatctctaaggacagagttaagccatctccgttgcccgacagttggaagctgaaggagatctttgctacgggcatcgtgcttggaagctaccttgctctgatgactgtcattttcttctgggctatgcacaagaccgacttcttctcggacaaattcggtgtgaggtcgatcagggacagcgagcatgagatgatgtccgccctgtacctccaagtgagtatcgtgagccaggctctgatcttcgtcacccgttcccgtagctggtccttcgtggagcgccctggtctgctcctggtcaccgcgttcctgctcgctcaacttgttgccaccttcctcgctgtctacgccaactggggcttcgccaggatcaagggtatcggctggggctgggcaggtgtggtctggctctacagcatcgtcttctacttccccctggacctgctcaagttcttcatccgcttcgtgctcagcggcagggcatgggacaacctcctcgagaacaagaccgccttcaccaccaagaaggactacgggcgggaagagagggaggcgcagtgggccaccgcgcagaggacgctgcacgggctccagccgccggaggcttcctccaacacgctgttcaacgacaagagcagctaccgcgagctgtccgagatcgccgagcaggccaagagacgagctgagatcgcgaggctgagggagctcaacaccctcaagggccacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctctataccaccagatactgccatatgatggtatggttgggtacccgtctttctagggagtttcttttctctctctcttttttcttattgttatgtttttcaatagtggagtgtgcgcgtgttgtaatcgtttttacctgcgttttcctctaactagccggtgatctcgcgggaagcgaggtgaagaaataatgcaactaaaattctctgccaaaagcattgttccttctcacttggttcatgcagagtttgcagacaggttctgcaatacaatgccgtctgaatgtcgcgttttttttt

SEQ ID NO: 622 - DNA, 219 bp, Zea mays
  Clone ID: PAT_MRT4577_109104C.1
cgtcacaacaccctaaagtgagtcgtattaaagcaactgggtacatacactgcgcacttcgtcatgtacttcccaatatgccactggaacaaaggagacaacttccagtcgacctgcctgaaggacatctcaaagctctaagcccgcaaaccttgggtcaaggggtagacatgcatctcggcttggctattgatagtccagaggcgacattagcagtca

SEQ ID NO: 623 - DNA, 1328 bp, Zea mays
  Clone ID: PAT_MRT4577_109142C.1
atctcgcccacacgaactcgagacctcgcccgcccaaatacaaaagcctcagatctcagtgaccagcgccgccgcttcgttcgtgtcgaatagagaagagaggaaatggcggcgagcgagggcgtgctcctggggatgggcaaccccctcctcgacatctccgccgttgtcgatgacgccttcctggcaaagtatgacatcaagctgaacaatgccattctcgctgaggagaagcactcgcctatgtatgatgagttggctagcaacagcaatgttgaatatattgctggaggagccacccagaactctatcagggttgcccaatggatgcttcaaactcctggtgcaacaagttacatgggatgcattgggaaggacaagtttggtgaggagatgaagaaaaatgctcaagctgcaggagttactgctcattactatgaggatgagactgctcctactggcacatgtgctgtatgtgttgttggtggcgaaaggtcattgattgcaaatctgtcggcggcaaactgttacaaatctgagcatctcaagagaccagagaactgggcactagttgagaaggcaaaatacatctacattgctggatttttcctcacggtgtcacctgattctatccagttagttgctgagcatgctgcggcaaataacaaggtgttcctgatgaacctctctgctcccttcatctgtgagtttttctatgatgcccaagagaaggtcctcccgtatgctgacttcatcttcggcaatgaaaccgaggcaaaaatcttcgccaaagttcgaggatgggagactgagaatgtcgaggagattgctttgaagatctctcagcttcctttggcttcaggcaagcaaaagaggattgctgtgattactcaaggtgctgatccagtggttgttgctgaggacgggaaggtgaaaacgttccctgtgatcctattgcccaaggagaagcttgttgacaccaacggcgcaggtgacgctttcgtcggaggctttctctctcggctggtccagggcaagagcatcgaggactgcgtgacggctggttgctacgccgccaatgttgtcatccagcgcccaggctgtacctacccagagaagcctgacttcaactagtgcaatactcaggcacgttacgagcggttcggcgtgtacactccctgtatcctttccggtccggccaattttttgtacgaggcatggtttgccatcattatactgttagcttcggcgatgcttgcaatgcaacgagaatgcgttggaaccatatatgcaatgctacccgatcgattcggcaaaaaaaaaaaaaa

SEQ ID NO: 624 - DNA, 1790 bp, Zea mays
  Clone ID: PAT_MRT4577_109144C.1
cgggtcgagctcgagccctcgcccgctcagtcacaaagcctcagatctcagtcgcctgcgccgccgcttcgttcgtgtggaggggagaagacaggaaatggcggcgactgagggcgtgctcttggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagttgctgagcatgctgcagcaaataacaaggtgttcctgatgaacctctctgctcccttcatctgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtatgctttttatcagtttgatgctaaactaatattacttgacataggctgagaaggtagattcaaccaaatatttttttgcactatttttttgtcaaatatgcatgcttttgcctgttggtcatgcaacaaaacataataaatttcttctgtacatgttttcttacaatctttttccacccctttctgtaacaaacactctttgctcttatggttccgcttgggatctttgatgtccctttggaaactaagttgattgcacaatggttgtttgcttgtccaaggattttgcatctgtagttttaacttttgtgcttgaatgaagaactgatatctgacatcttaagtgtttttgtagaggctgttgagtatgatgtactaattattatgctgataataggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctctcctgatccggccaatatttttgccgtgaaatttgtgttctgcaactatggacgtctcctttgttgctgtataaggcatgatttgccatcattctgttgcttcggtgatgcttgcaatgcaatgagaatgtgttggaaaaaaaaaaaaaaaaagcggcc

SEQ ID NO: 625 - DNA, 1438 bp, Zea mays
  Clone ID: PAT_MRT4577_109145C.1
attgggtccctcgaggccggccgggatctcgcccacgcgaactcgagacctcgcccgcccaaatacgaaagcctcagatctcagtgactactgactagcgccgtcgcttcgttcgtgtcgaggggagaagagaggaaatggcggcgagcgagggcgtgctcctggggatgggcaaccccctcctcgacatctccgccgttgtcgatgacgccttcctggcaaagtatgacatcaagctgaacaatgccattctcgctgaggagaagcacttgcctatgtatgatgagttggctagcaacagcaatgttgaatatattgctggaggagccacccagaactctatcagggttgcccaatggatgcttcaaactcctggtgcaacaagttacatgggatgcattgggaaggacaagtttggtgaggagatgaagaaaaatgctcaagctgcaggagttactgctcattactatgaggatgagactgctcctactggcacatgtgctgtatgtgttgttggtggcgaaaggtcattgattgcaaatctgtcggcggcaaactgttacaaatctgagcatctcaagagaccagagaactgggcactagttgagaaggcaaaatacatctacattgctggatttttcctcacggtgtcacctgattctatccagttagttgctgagcatgctgcggcaaataacaaggtgttcctgatgaacctctctgctcccttcatctgtgagtttttctatgatgcccaagagaaggtcctcccgtatgctgacttcatcttcggcaatgaaaccgaggcaaaaatcttcgccaaagttcgaggatgggagactgagaatgtcgaggagattgctttgaagatctctcagcttcctttggcttcaggcaagcaaaagaggactgctgtgattactcaaggtgctgatccagtggttgttgctgaggacgggaaggtgaaaacgttccctgtgatcctattgcccaaggagaagcttgttgacaccaacggcgcaggtgacgctttcgtcggaggctttctctctcggctggtccagggcaagagcatcgaggactgcgtgacggctggttgctacgctgccaatgttatcatccagcgcccaggctgtacctacccagagaagcctgacttcaactagtgcaatactcaggcaccgaggcacgttacgagcggttcggcgtgtacactcccctgtatcctttccggtccggccaattttttgtcgccgtgatatttgttcagcaactatggacgacgtcgcctctgttctgtacgaggcatggtttgccatcattattctgttagcttcggcgatgcttgcaatgcgacgagaatgcgttggaaccatatatgcaatgcaaagttagcagctcagtctacccgatcgattcggcagctcgctacttccct

SEQ ID NO: 626 - DNA, 1519 bp, Zea mays
  Clone ID: PAT_MRT4577_109147C.1
ccaaaggaggcggccggccgtgcccacatgtcacggaaatcatgtagcatcaccgtgcgtacgtccaccaaccaccgtcgaacacgaggagggtgacaggtgggccatccgaggtttgggcgagccaaacaaaaaccctcttcacaccggtcaccacttcatctcgcccacacgaactcgagacctcgcccgcccaaatacgaaagcctcagatctcagtgaccagcgccgccgcttcgttcgtgtcgaggagagaagagaggaaatggcggcgagcgagggcgtgctcctggggatgggcaaccccctcctcgacatctccgccgttgtcgatgacgccttcctggcaaagtatgacatcaagctgaacaatgccattctcgctgaggagaagcacttgcctatgtatgatgagttggctagcaacagcaatgttgaatatattgctggaggagccacccagaactctatcagggttgcccaatggatgcttcaaactcctggtgcaacaagttacatgggatgcattgggaaggacaagtttggtgaggagatgaagaaaaatgctcaagctgcaggagttactgctcattactatgaggatgagactgctcctactggcacatgtgctgtatgtgttgttggtggcgagaggtcattgattgcaaatctgtcggcggcaaactgttacaaatctgagcatctcaagagaccagagaactgggcactagttgagaaggcaaaatacatctacattgctggatttttcctcacggtgtcacctgattctatccagttagttgctgagcatgctgcggcaaataacaaggtgttcctgatgaacctctctgctcccttcatctgtgagtttttctgtgatgcccaagagaaggtcctcccgtatgctgacttcatcttcggcaatgaaaccgaggcaaaaatcttcgccaaagttcgaggatgggagacagagaatgtcgaggagattgctttgaagatctctcagcttcctttggcttcaggcaagcaaaagaggactgctgtgattactcaaggcgctgatccagtggttgttgctgaggatgggaaggtgaaaacgttccctgtgatcctattgcccaaggagaagcttgttgacaccaacggcgcaggtgacgctttcgtcggaggctttctctctcggctggtccagggcaagagcatcgaggactgcgtgacggctggttgctacgccgccaatgtcatcatccagcgcccaggctgtacctacccagagaagcctgacttcaactagtgcaataatactcaggcacgttacgagcggttcggcgtgtacactcccctgtatcctttccggtccggccaattttttgtcgccgtgatatttgttcagcaactatggacgacgtcgcctctgttctgtacgaggcatggtttgccatcattattctgttagcttcggcgatgcttgcaatgcgacgagaatgcgttggaaccatatatgcaatgcaaagttagc

SEQ ID NO: 627 - DNA, 1438 bp, Zea mays
  Clone ID: PAT_MRT4577_109260C.1
cctagggaacgcgagaccggccgtcggcgagagaaggactcgaatggagtgcgcaagggagttgcgggttcgctccacgtttacggcggcggccatggcgtccaagaagcaggtggggcctggaggcgcggttcccgctcaggaacagatgaacggcggcgatgccgccagactggtcaggaagccaatggatacatttccacagccagcggcggcaagaggccgtagggcacttgtcgacgttggcaatcttatgaatggccggccttctcttgtgaaccatcagaagcaagcggttgcggcagcggcaaccagtcacaaaccactcaacgttggcaacaagaagccacttgttcctcaggcagcagcaagaggccttcgaccccttgccgacgttacgaatcttatgatcaatgaccgtgctgctcctgcaaatcgtcagaagcctctggatgctgtgtttaacaggaacgggaaggcagtaaagctgaaggaatgcaaggtgaagcctgaagtcattgtgagcattccagattccgagaaggagaagaaaagcaaattccctggaggtcagaaagtctgtaggagggtgccaacactttttgacaatttgacaaaatgcagcagggcctctgatgggattaccaccccgaagaagaagaatccatatgacattgatgcacctgattcttgcaatgagctggcagtcgttgaatatgttgaggacatttacagattctacaagagcactgagggcacctgccttcctctcagcagctacatgagctcacaggctgaaatcagtgagagaatgagagctatccttatcgactggattatcgagtacttatctatggagagtgtaccaagaaaggagctacagctcgtcggcataagtgccatgctgatagcaagcaagtacgaagagatatgggctccactggttaaggacttgatgtgcctctgtgacaacgcatttaccagagaccagattctgaccaaggaaaaggccatcctggacatgctccattggaacctgacggttccaacaatgtacatgttcattgttaggtacctgaaagccgcaatgtgtgacgcagagcttgagaacatggcattcttctactccgagctggcattggtccagtacgcgatgctggtttaccctccatcggtgaccgcagccgctgccgtctatgctgccaggtctacacttgggatgaatccaccgtggactgatattctggaacatcacactggcctagctgagccacagttactggactgcgctaggcggctgatcagcttccatgccctggctccggaaagcaagcagaaggcggtgtacaggaagtactccaagcccaagctcggctccgtcgcgcttcaatcccctgacaagaagctgttgtcaggttgaggctcgttgctgctcatt

SEQ ID NO: 628 - DNA, 1720 bp, Zea mays
  Clone ID: PAT_MRT4577_109262C.1
tacctcgtgtccgacgagccctagggaacgcgagaccggccgtcggcgagagaaggactcgaatggagtgcgcaagggagttgcgggttcgctccacgtttacggcggcggccatggcgtccaagaagcaggtggggcctggaggcgcggttcccgctcaggaacagatgaacggcggcgatgccgccagactggtcaggaagccaatggatacatttccacagccagcggcggcaagaggccgtagggcacttgtcgacgttggcaatcttatgaatggccggccttctcttgtgaaccatcagaagcaagcggttgcggcagcggcaaccagtcataaaccactcaacgtcggcaacaagaagccacttgttcctcaggcagcagcaagaggcctgcgaccccttgccgacgttacgaatcttatgatcaaagaccgtgctgctcctgcaaatcgtcagaagcctgtggatgctgtgtttaacaggaacgggaaggcagtaaagctgaaggaatgcaaggtgaagcctgaagtcattgtgatcattccagattccgagaaggagaagaaaggcaaattccctggaggtcagagagtctgtaggagggtgccaacactttttgacaatttgacaaaatgcagcaggtatgaacacaagcaaaattctaaggcctctgatgggattaccaccccgaagaagaagaatccatatgacattgatgcacctgattcttgcaatgagctggcagtcgttgaatatgttgaggacatttacagattctacaagagcactgagggcacctgccttcctctcagcagctacatgagctcacaggctgaaatcagtgagagaatgagagctatccttatcgactggattatcgaggtacagtacaggcttactctaatgccagagacactttacttgaccgtctacatcatcgaccagtacttatctatggagagtgtaccaagaaaggagctacagctcgtcggcataagtgccatgctgatagcaagcaagtacgaagagatatgggctccactggttaaggacttgatgtgcctctgtgacaacgcatttaccagagaccagattctgaccaaggaaaaggccatcctggacatgctccattggaacctgacggttccaacaatgtacatgttcattgttaggtacctgaaagccgcaatgtgtgacgcagagcttgagaacatgacattcttctactccgagctggcattggtccagtacgcgatgctggtttaccctccatcggtgaccgcagccgctgccgtctatgctgccaggtctacacttgggatgaatccaccgtggactgatattctggaacatcacactggcctagctgagccacagttactggactgcgctaggcggctgatcagcttccatgccctggctccggaaagcaagcaaaaggcggtgtacaggaagtactccaagcccaagctcggctccgtcgcgcttcaatcccctgacaagaagctgttgtcaggttgaggctcgctgctgctcattgtattgtatatcatcgcttcgatggtcccatttgtttgggtcgtgtgctcttatgcttttctactgaagcagagcatgtgttggttagtcagtttgcttaaacgactactgaagcagagccttgtatgtgtgttgggagaatgtgatatgtgatgtcaagctccaactttttcccc

SEQ ID NO: 629 - DNA, 317 bp, Zea mays
  Clone ID: PAT_MRT4577_109267C.1
gcagtttcgacgtcaagctacccgtaccgtggagcttgcaacgccttacgcctccacacttaacagtgatggtcgtcatgggcaaggagcagcaacacgaggaggaggtggtgtaagggaaggtctttcaagaagaagtgcaagtcgtccaatagacggtggtgccggtgccatctgaggaggacaaggaggccgaggcggtgctcatgcacaagatctctaggctggtcgtagtcatagccaaactgtcattcctgagcccgtggccggaggtgaacgcgctctttatcgagcttgtgacggcgtgcatcccgcgc

SEQ ID NO: 630 - DNA, 323 bp, Zea mays
  Clone ID: PAT_MRT4577_109273C.1
cccacgcgtccgcccacgcttccgcctatgttttcgaaaaaaaaaaaaaaaaaaaaaaaaagaaaatataaaaaaaaaaaaaaagaaaaaaaaaaaaaaaaaaaaaaaataaaaaaaaaaaaaaataaaaaaaaaaaaaaaaaaagggtcggccttttaaagaatcaaaattaacttacccttcattgcaattaaatagtttttttattgtgccacctaaataaaattaattggccgttttttaaaaacttctgaactggaaaaaccttggcttaaccaaattaaatccctttgaagaaaatccccttttcgcaagttggctt

SEQ ID NO: 631 - DNA, 605 bp, Zea mays
  Clone ID: PAT_MRT4577_109470C.1
tactccatctggtgtcttcgttatacttatgcttatcggctacataatatatgctgcgtggaatcgctatgatagcgttacggaagattgccggaaaatgaaagcactgaaaaaacgggcggaagccgctgatgttgctaagtctcagttccttgcaactgtttctcatgagatcaggacacccatgaacggtgtgctaggaatgcttgatatgctattagacacagagctgaagtcaacccagagagattttgcgcaaactgcccaaatctgcggaaaggcattgatatccctaattaatgaagtgcttgacagggccaaaattgaagctggcaagttggagctagagtctgtaccgtttgaccttaggtccatccttgatgaagtcgtctctctattttcttcgaaatcaagagaaaagggaattgagcttgcggtatatgtctctgaaagagttcctgaaatcctgctgggcgatcctggaaggttccgtcagataattacaaacttagttgggaactcaattaagttcacggaaaggggacacatttttgtgcaagttcacctggcagaccactccaatctagcaactgaaccaaaagttg

SEQ ID NO: 632 - DNA, 454 bp, Zea mays
  Clone ID: PAT_MRT4577_109586C.1
acgcatctagcaacatataaagcacaatagtgtttcaacattggcagccaaaatattctgcctcctcgtgctggttgtactttcaccacgtgctgctactgctaccattctcccgcaatgatcgcaagcttctatagcttacattcttcaccagtacctctcaccagaggtgtattccctatgtgaaaacccaactctttaaccctacaggatccaacacgcaatcacagctgacatcttacctttatcacactagcttctccaacaattataaaacctattacatcacatacctttgctgcatttattggcacaaaacatcaggtcacaacaactacaacaacttgtgctaacaaaccttactgtctactctcaataacaataaattatttcattcaaccaaataacttaatttaactctacttcttatttcaacaacaacacctaccattca

SEQ ID NO: 633 - DNA, 225 bp, Zea mays
  UNSURE (1)..(225): unsure at all n locations
  Clone ID: PAT_MRT4577_10969C.1
  unsure (1)..(225): unsure at all n locations
ccaccccnggggcacccacccgncccctggtggtcttccatgcctcccatcggtggcggcgacgccctccccgacggccagntcgggtggatcgacagagaacgaccagttgcagcaggtctccgtccccgcgctcgccgacggaaataaggtcatcctcttcggcgtccccggcgccttcaccccgaaatgtagaaaccagtatgtgccaggctccatcacaca

SEQ ID NO: 634 - DNA, 1716 bp, Zea mays
  Clone ID: PAT_MRT4577_110073C.1
tttaaaacccccccctttaccacccctttttaccattttttttacccactttaacataaaaagttttcccatttaaaaaccaccctttcaacacccacccatttaaatcaaataactccctacctctcccccccctaattataacattaaccttcccactcataattttttcccccttttaccccatattaatttcttccataaaacaattatccccatttttttcccaaattctaatataaccctccacccaaaaaaatttttttccttcacctacccatctaaaattccctggcctaccccccaaccctctctttttatatttcaagcgcccccccttttttttttttttttttttcctggtacccccctccaggtacccggtcccggtcccggggggtggatgacgaggacggcctgagctttgagacagcatgcatgcatggctccgcgacccccacgcgcctatatccatccatcatcctattcctatcccgccacatactccaccacctattattccgctcccgacgcccagaattcacgagaacgcacccgcccgcctcctccttccgtccccatccagatgatgcttagggtttccgcgtctccggccgccgcggtggccaaccatctctctggtggggccgcggcgaccacggctcctgccagggtgacggcgcagcgcagcggcgtctcgctgtccgccgccgccgccgccggcaaggggaaggaggtgctcagcggggtggtgttccagcccttcgaggagatcaagggggagctcgccctcgtgccccagtcccccgacaggtcgctcgcgcgccacaagttcgtcgacgactgcgaggcagccatcaacgagcagatcaatgtggagtacaacgcctcgtatgcgtaccactccctcttcgcctacttcgaccgcgacaacgtggccctcaaaggatttgccaagttcttcaaggaatccagcgacgaggagagggagcacgctgaaaagctcatggagtatcagaacaaacgcggaggcagggtgaggctccagtcgattgtggcgcctttgaccgagtttgaccaccccgagaaaggcgatgctctgtacgctatggagctgactctggctctggaaaagctggttaatgagaagctgcacagcctgcatggtgtggcaacaaggtgcaatgatcctcagctgatagacttcatcgagagtgagttcctcgaggagcaggtggaagccataaataaggtctccaagtatgtcgcgcagctgaggagagtgggcaacaaggggcacggggtgtggcacttcgatcagatgctgcttgaggaagaggcctaaaaagaagaacggacagatgaatgaaggaaacaagtgtgtaatgttgatcaggcggaggaataataatgggtcaactgacaactctgggtcggtggatttgtagttggtttgggttttttagttgtagaacggtgttgccctcctagagagggatgaacacattatgcatgcgatgtgtcagttcggtcggtgctatgctcgttgggatttgattgtcggaaataaactccctaatctatgtcttggtgatgaagttgagaaagccctgcgggtgtaggtggatttgtaaaggtttttcttcagttggttaggttcgctgttgcctacctcatttgcccctaatcatcatccccgtaatttttttataatat

SEQ ID NO: 635 - DNA, 1738 bp, Zea mays
  Clone ID: PAT_MRT4577_110074C.1
ccacccctcgaggctcgccccgagaccacgagaacgcacattggctacctcgaggccggccgggagccgcacaatccatccatccatctattctccagtccacccattccattccactaccgacgcccagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccgtccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgaaaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataatgggtcaactgacaactctgggtcggtggatttgtagttggtttgggttttttagttgtagaacggtgttgcccccctcctagagagggatgaacacattatgcatgcgatgtgtcagttcggtcggtgctatgctcgttgggatttgattgtcggaaataaaacatgggtgatgaatgtgtaccctccctaatctatgtcttggtgatgaagttgagaaagccctgcgggtgtaggtggatttgtagagttttttcttcagttggttaggttcgctgttgcctacctcatttgcccctcatcatcgccgtaatttatttatttataatataaaagatccagcttttcccccactaaaaaaaaaaaaaaaaaaactcgagactagctcattttcttgcttcttgtttgccggttctgacctctggtttaggataggatctgaatgcccaagtgcctcagaggagagtctgcgtgtgtggtactggtagtctggtaatggtagagcaaggaaagtaacaaaagctcggggttgtccagaagtggaatttattctgcgtctgaacatagttgtatgactgtatgagttgaagctttcagtatgtgcatcgatggatgatgatagattcaaagactggtagcaattctacaaatttaggacgacttatatagaatagaaggctagctattgttagtaaatgtttggttatgtatcaagctatgttgtagttatgttcatgctt

SEQ ID NO: 636 - DNA, 457 bp, Zea mays
  Clone ID: PAT_MRT4577_110079C.1
ggttgtgtgtttttttttttttttttttttttttttttttttttttttttttttttttttttttttttttttacttaatctaacattacccaaactggcattatgacaatggtagccgatgatgaccacaagggaaacagtaatttaggggcaggggggggcctttggtgggtgggaagggggcccccccacaaaccccccagaccagggggagaaccacccgccaggggggccaacggggggcgctttccgtttttgcccgacaaaaggaaaaataaaacatcacgagggggggggaaactgaataattctaggccatgggtataggccccttttttgggatccccacggggccttgggttgccgctcccttgttgggtgaagcacgggccattggctcggggggctccatcacttggcatcatctttatcctccccactaccctctttattatcc

SEQ ID NO: 637 - DNA, 322 bp, Zea mays
  Clone ID: PAT_MRT4577_110208C.1
gggttggcttctcctctcgctgcggttcgggatcgagctcgagaggttctccggggttaggattcgtgggtgagcggatcgagaggcggcgtcgggtgttgagtaccgctgcttcgtctgcggactcacctgagacacggacgaccactccctcgaaaacaccttgatcacctacggggaggttctagagtccaaaatcattctcgatcgaaagacgcaaaggtccctcgacttcggcttcggtaccttctgcacaaaggaggagatgcggaactccatcaaggacataaacggcaaggagctgaacggtcgtaacataccg

SEQ ID NO: 638 - DNA, 2609 bp, Zea mays
  Clone ID: PAT_MRT4577_110225C.1
aattcggcacgaggcctcccttactgtcgaggatagattcacggctagtgcgcttagccactgtaggcggaagcggggaaggccggacacgccgcccgccccaccccgtatgtacattgcggggctctaagcaattagtaagtcaaatgcgcctacttacgactcagagttggtcaccagaagctattaaccattctacaccatgcggacgtgtaggtcttatttggcgctgcggcttatggaaaaccaggggtagtagacatgtggaaccacaatcgtgtggcaacatcatcggtctcggccctgcgtgatgctagagccaatcgtacgaggtggggtggcgattactctccaacggggctgtcacacctgcaatgtgggctagcatcactcgttttggatttaactttatgctaacagaatctaggtgtcattaagctagattaagctcgctgcttgacttagtagtgtaaatctgtaaagaaaattacctggtttgggtttagtctctataaaagaaatggaacagaggaatgttctggcattgggtgaacatgttctaaaagctactgtttggaagcggaagcataagactgctatggagcaccctgaaggcaatgatgtgatggtgttctctcagcatgatcaaagaaagcaccctgtgatatttgacgacagagctaaatgtaagaagtctaaattaatttcctgtgggagtggagttatattggagtcatattggaactttatagaacaagtgggctgcctgtgcgcgtgcttttctaccaacatggtgactggagtgattttccagaggatgttgtaaatctagcacaacaggacttccagttgaagaagccaattacaactgctgtgttccagaacaagcacatcctgttggacttcattcacatgatttgcatagattatgagatgaccatagacaaaccactagcatgggttgatgataatggcaaacgcttctttccagatttatctgctgggctctacacatctaaaccatctcagcatgagaatggtgaagctgatgagtgtgatggaacgcctacaagtgtagctgaaagttctagttcggtatctgttggtgaagtagtttctcatggtaagaggatcaatgatattgcagaggacaacatgagagcacataacatattgtatgaagctgttggtgaaaatatttcaggtccttcattccatttgaatgaatattctagtggaaccatacaagctactggcaagccaaacgattgtcgacgtattgattcagctgtgcggaatttgttgctcaaaggattaggtcagccgtttagtgaggaagatattattggtatctatagaacaccactgctagatcagcgagggcaagttcgttgtggtctcttccagaaggagatcgaagagaccaggagtcgtcgggggaatgcaaatgtacgttatgcttggcttccttgctcaagatataccatggagcagatggcaatgcggggtgctctggaaatcgcgaagcctcataaggggtccatttgtggtgttgggacttgtcttgctcctgcaaactgtacaaattcatgtgccagatattctgattttcatgaagatggcatcatcagaatgatgttgtgccgtgtaataatgggtaatgttgaggttgttttgcctggatcaaagcaatttcagccatccaatggaagttttgataatggtgtggatgatcttcaaaatccacagaattacatcgtatgggatgctaatgtgcataaacacatatatgctgaatatgctgttattgtccaagcacctctcgtgaccaatgaatgttcgggcttgaaggatagcgtgcccaacatatctgagatcataagttctggttctcgagacaatctaaccaaggaggataggttcgcgccttgtggtgtcgaacaagaagcacctaggctggggcgtgctccaagggccccctcctcaccatggatgcccttttcgatgctttttgctgctatttccacgaaagtgcctcgttcggacatggagttggtcatcagatactatgaagaattcaagaggaagaggatgagccggagcgacctggtggtacggatgaggcaaatagtcggtgataagatattggtttctacaataatgaggcttcaccaccagaagaagcccccatcgatggcagcagcagcagctgggctagcaagagcactcgcaaggggggaagagggagggggagtagccgagtaagattagtttaagccgccttgtcttttgagaaatttatggagcacatatgctttgtcgacatggccagacccaaggtgtcaaaagggagggagatgagctgagcaactgttgtagtgtagtctcaaactcaaagcgtttaggtcttgacatttgacaaactaaaactcagaaacattatcatgagtagtgttttttttttcgtttctctttcctggatttaactattgttattgctatttcgtggatatctgggcactgaaggccgtgctattgttggttaatgatggtatgattaagggtgcgcttgccattttaaagaaaaaaaaaaaaaaaaaaggccccta

SEQ ID NO: 639 - DNA, 1728 bp, Zea mays
  Clone ID: PAT_MRT4577_110243C.1
atggcggcgccgtcggcggccacgcgcaggaaactgcagcgcaagttccgcctgcgaggcttcaccctcaaggtggacgccctcgaggaggccgccgccttcctcgaccgcttccccgacgccgaggacgacgcgctcgatctcctcctcgacgagctcgacaaggaaccgctgcagtcgtcgatactggaccgggacgcggtcaggcgcgtggtggcgctgcttgtcgaggccgaggaggcgctcgatgtggcgtcgccagcggccacaagcgcaaggtctgcgctgcgggtggtggacgcgttcctcgtgccgcggttccactacgatccaatcaagaaagtattttacgagtatgtgaacgctgactcttctttgtggatctgggaaattctccacggggacttgagtattggttcgttctttttaggcttctcaattgaaccggggcacacaggcagattagctgtccatggagaagctggagataaagcttccctttatagggataggtatcaagtgctgctgcagagactgtctcgtgataaatatttctctaagccggcttttgacacagttgcgaccgaacactgtagttgcgaggtaaatacatgtggatttcctcccctggaggacagagaagcgtcagtctcattgctcatgggttttgatttctttgggggaggtgtaataccaactgaagaaacactaaggttatcatcactggaaaaaaaggctgtgaatgatatgtttgtcattctttcggatgtgtggctggacaatcctgagtatgagataacccttagctatgtacctccacacagatttcagttcggaaagcttggcgagatgattgcagctcgatctagattaaaggaacatagtcgtttcttattcattcctggacctgatgatgcaggtccttctaaagccctcccaagatgtgcacttccaaaatatctaattgaagaacttcagaagcacataccaaattcaatcttcgtaagcaacccctgcagctatgctctttgttattttgagatctcattgcacaatcacatgatgtacaatggcattggggtgaagttttacacacaagaaattgtgtttttccggcaagatctcctttacaggatgcggcggtcatgtctcattccaccaacaacggaagaaacaagtgacccttttgaacacattgtattgggtgacaaaagcgagcagaaagccttcaaatatactgggatcacttgctttaatccaggttcgtttgcgaatgacagcaccttcgcagcatatcgtccttgcaccaaagaggttgagctttctgcgttggaaggctaacataaagggagaataaactgaagttctccaatttgatgaagtgtaaagtcttcgacaaattaaagaactgccacttccacccaaggaaccgtgaaaatagcatggctttcatgacgatgtggtgtttttgtgaagagaactgatgctgatatctcatcataggctcagcaaagcagtaggagcagcccattggtgtttgtgcagcatctctagctgtttgtaacaatctttaatactgcacgttagaccagactattttacttgtactgtttagtttttcattgaatcatggtaacaactaacaagattactttttgacagtgctcataactgctgtatcttcatattttgatcacccccctttccaattgttatatttggtagtct

SEQ ID NO: 640 - DNA, 1623 bp, Zea mays
  Clone ID: PAT_MRT4577_110317C.1
tatgggagccgcggtgccggccgggacagccaccacagcccagacccctcgcctcggcctcttttaaatatcgcgcatcccggcgccgcaaatggctcacgcggcgctgctccattgctcccagtcctccaggagcctcgcagcctgccgccgcggcagccactaccgcgccccttcgcacgtcccgcgccactcccgccgtcgccgacgcgccgtcgtcagcctgcgtccgatggcctcgtcgacggctcaggcccccgcgacggcgccgccgggtctgaaggagggcatcgcggggctgtacgacgagtcgtcggggctgtgggagaacatctggggcgaccacatgcaccacggcttctacgactcgagcgaggccgcctccatggccgatcaccgccgcgcccagatccgcatgatcgaggaggcgctcgccttcgccggtgtcccagcctcagatgatccagagaagacaccaaaaacaatagtcgatgtcggatgtggcattggtggtagctcaaggtacttggcgaagaaatacggagcgcagtgcactgggatcacgttgagccctgttcaagccgagagaggaaatgctctcgctgcagcgcaggggttgtcggatcaggttactctgcaagttgctgatgctctggagcaaccgtttcctgacgggcagttcgatctggtgtggtccatggagagtggcgagcacatgccggacaagagaaagtttgttagtgagctagcacgcgtggcggctcctggagggacaataatcatcgtgacatggtgccataggaacctggatccatccgaaacctcgctaaagcccgatgaactgagcctcctgaggaggatatgcgacgcgtactacctcccggactggtgctcaccttcagactatgtgaacattgccaagtcactgtctctcgaggatatcaagacagctgactggtcggagaacgtggccccgttttggcccgccgtgataaaatcagcgctaacatggaagggcttcacctctctgctgacgaccggatggaagacgatcagaggcgcgatggtgatgccgctaatgatccagggctacaagaaggggctcatcaaattcaccatcatcacctgtcgcaagcctggagccgcgtaggaggaggccaaggagcacaagttactagcacaggcacaggagtgccaagtgcaataatgtagatccgtggcaccatcgccgtctactcatctatactgcaccaaaatcaacattctcctaggacatgttaaataattttctgccactcgtcgagatatttcaaattcactgttccacaaaaaaaaaaaaaaaacggccgactagtgagcttccgggcctcccctacctttcctttccatcccggagtcgctttcttcacacaagcatttgtacgtccttgtgtgctgggtctatgagtacttgggccaaagtctgggcacgtgcccaacaggcatccatatatgggctccgccacttcaccccacccgtttgtagatccttgtttcgagtttcagggtagagtattatttcaccccttgtttggccgacacgtcataagtggataagcttctacactttttctgctgttcccc

SEQ ID NO: 641 - DNA, 398 bp, Zea mays
  UNSURE (1)..(398): unsure at all n locations
  Clone ID: PAT_MRT4577_110361C.1
  unsure (1)..(398): unsure at all n locations
tgctggcttcggctagagccattatcaagtcctnctcgggttagggttccttagggttctgtggaggggcgatggcggcggctgatgtgaagcaccgtagcttcatcagcggacttgcctgagccaccagcaacgagtcgctggagaatgccttcttcttttacgganagatgctcgactcctaggtcatcaccgaccgatagacggggaggtcccgcggcttcagattcgttaccttctactccgagaactccatgctagacgctatcgagaacatgaacggnaaggagctcgacggtcgtaacatcaccgttaaccacgcccaatcccgtgacggcggcggcggctgcggcggctgtgtctacagcggcggtcgcggaggctgcggctatggtggc

SEQ ID NO: 642 - DNA, 731 bp, Zea mays
  Clone ID: PAT_MRT4577_110481C.1
attgggacctcgagccggcaggccgggatagcctgagtcaacagctgcaaatggcagacacaagaggaattgcaacagtggtgaggcagttgatacaaaaccaaggtatagttagaggcctcccaagctcaacagggatcgaaatgactgtggttactacaggtcggcaaagggctagggcccggagaccacaaaggcaggataataacgcatcaccttccatacatgttgcagcacagaatatgggcaatgttgcctctgagagcagcaatcaaatccagctgccacattctaatggcgacaatgctgcacagatggttcttgcatctcctcagcagtcatcgtctgtcgaacagctgtcaacttctagcaccacagctcttatagtgggtgagcctagatcaactaggcggttaaggcctttggagtccccaaccataagaagaacaaggaggaggccgctgtaggtaccaaagtggtgtcactcccttcaatgaaacctacagaccatgccccattgttagttattaccatgattagctccaataacatctcaaggttaataatgtaggcatgtatatgccatcactcgttcccacctttctcttacataccatgtaccatctatgtagcttcatcatggagtcaaaatgtcagttccaagatctatgataatcttgatctcctgtatactcgaaatatattttctgatttagtctctgtttctggta

SEQ ID NO: 643 - DNA, 3185 bp, Zea mays
  Clone ID: PAT_MRT4577_11048C.1
gaaagcacctccgactcggagtcgcggcgagagccgagaaccttctcattcatcttcctcttctatccatcctgcctgcctgcttgcctccgtattccagctagatctccgggcagccgattgaccgagaagtttgtggttgtggcggcggcggagagggaaacggggagcgggagggcggcgcggatgccactgctgcgccggcgccggcggggccggtgatgcccgccgtggcggtcgcttgaggccgccgtgcgtgggaggtggacgggggagcgaggcggtgcggaccgaggttgcgttgggttggattcgattgggctgcgtctgctgagaaggtctaggaggagctatgaggtactacttccgtcaggtccagcgtttggttggagatatggaaggaggagctctcttgtttatagatgacctcaactccaagtgacaaagtgaacagctgttgaacttcccgtctatttctgtttctttttgctggatttggagatggaggtgaattcctctggtgaggaaacggtgataaaggtaaggaagccatacacaataaccaagcagcgggagcggtggacagaggctgagcacaaacggttccttgaagccttgaaactttatggcagagcatggcagcgcatagaagagcatgttgggacaaagacggccgtgcagatcagaagtcacgctcaaaagttcttcaccaagttggaaaaggaagctattaacaatggtacttctccggggcaagcccatgacattgacataccgccaccacggcctaaaagaaaggctaacagtccatatcctcgaaaaagtggtctcagctctgagacaccaaccaaagaacttccaagtgacaagtcaacaaaaccaaatatgcccttgagcaatgagaatgtactaatggcaggtgatgcatctcttcagaaatttcaaaggaaggagttgtctggaaaagaaagttgctcggaagttcttaatctcttccgtgatgccccatctccatcattttcttcagttaacaaaagctcttcaaatcatggtgcaccgattgaggcaagtaaaacaaaaatccgagatatgaccattatggaaaatagttctcttaaccccaacatgcaagaggatgtaaaggaaatcaatgatcaggagatggaaaggcttaatggtacccaaatcagctctaaatgtgaacactctcatgagggatatttggacatctcaatgcaacaaatgaagctaaagccagagtctgtggagacaacatatgtggacaaacaaaccgcaagagcttcacactccctagcggagagaactgggacaactagcattccggtcactgcaactgaagaaactcattctgttctaacaagtgatcaagtgggaatcaatggaagcatgaacccatccatccatccaatgtttcctgcagatccaaaatttgatagcagtgccacaccacagccttttcctcataattatgctgcctttgctccaatgatgcagtgcaactgcaaccaagatacccacagatcattggtcaacatgtcatccaccttctccagcatgcttgtttccacgttgttgtcaaaccctgccatccatgcagctgccaggctcgcagcatcatactggccagcagctgaaggtaacactccgattgatccgaatcaagaaaatcttgcagatggtgttcaaggaaggagcatagggtctcctccaagcatggcttctattgtagcagctacagttgctgcagcatctgcatggtgggcaacacaaggtcttctccctttcttcgccccacccatggctttttcatttgtgccagctcccagtgctgccttccccacagttgatgttccacgaccttcagagaaagatagagattgcccagctgaaaatgcacagaaggaatgccaagaagctcgaaaacagggacagtttgaaggtttcagagttgccgcttcttcagagtatgatgggagtggaaaaggcgaggtgtctgtccacacagagttaaagatatctcctgtccagaatgctgatgccacgtctgccgcaggagctgacacgactgatgcattcatgaataagaaaaagcaggaccgctcttcatgcggttctaacacaccttcaagtagtgatgtagatgtggacaatgtccctgagaaagagggcaatggtaatgagaaggcgaagcaagcctcctgcagcaactcttcagctggtgacactaaccaccgcagatttagaagcagtggaagcacgagtgattcatggaaggaagtttccgaagagggtcgtctggttttccatgcgctgttcagtagagaaaagcttccgcaaagcttttctcccccacaagcagaaggctcgaaggaagttggcaaggaggaggaagatgaagtcaccacagtggcagttgacctcaacaagagtaccacaagcattgatcatgacctcgacacaattggtgagccaagggcttcctttcccaatgaactgtcgcccctgaagctgaaattgcgccgaacaggcttcaaaccatacaagagatgttctgtggaagcgaaggagaatagggtgccggctagcgacgaggttggtaccaagaggattcgtcttgatagtgaagcatcaacatgagcgatttctacatggttaccgctcggacttcctctgccgccatgaagtttatgacaaagttgtatttacatctaaactagtataggacttaaagaccttgcaatgcaatgcttcatgaaactgttgtgtgctgtattttagtacttgtgaagcagcccggtagactgcttttaaacctttatctcgtagactctgatttaagcatcaagcaactattgaactttatatttttggcgggaaggaaaataattattttttgatttatgcagtgcaactgcaaccaagatacgtacaggtcattcaccaacatgtcatccacgttctccagcatgcttgtttccacgttgttgtcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttca

SEQ ID NO: 644 - DNA, 1689 bp, Zea mays
  Clone ID: PAT_MRT4577_110516C.1
tttcggacgcgtgggcggacgcgtgggcgggcgtcagggaatgcctggaggaggtcggccacatcacgcgcctcgccgacccgcgggacgcctggctgcccatcaccgagtccaggagcggcaacgcctactacgccgcgttccacaacctcagctccggcatcggcttccaggcgctcgtgctccccacggccttcgcatcgctcggatggacgtgggcgatcatctgcctgaccctggcgttcgggtggcagctctacacgctgtggctgctcgtcaggctccacgagcctgtcgcgggcgccacccgctacagccgatacatgcacctcgccaccacagttttcggcgagagatgggccaagatcctggcgctgctcccggtgatgtacctgtcggcggggatctgcacggcgctcatcatcgtcggcggcggcagcatgaagctgctgttcggcatcgcgtgcggcgagccgtgcccggcgcgcccgcccaccaccgtggagtggtacctcgtcttcgtctgcgcggccgtgctgctgtcgcagctccccaacctcaactccatcgccggcgtgtccctggtgggcgcgaccgcggccgtcgcctactgcaccatgatctggaccgtgtccgtggccaagggcagggtgcccgccgtgtcctacgaccccgtcaaggcccccagcgacgtggacggcgcactcgccattctcaatggcctcggaatcattgccttcgccttcaggggccacaatgtcgtgctggagatccagggcacgatgccgtcgacactgaaacacccatctcatgtgcccatgtggaagggggttaaggtagcgtacgccatcatcgcgctctgcttgtaccccgtcgccatcggtggcttctgggcttacggcaaccaggtacgtgtaccacatatatacatacatacgcacgggcttcggacgacgtcgagagtgactgatgatttgcgatgcacgcgcagatacctcccaatggcatcctgagcgccctgtacaagttccacagccgcgacacgtccaggctagtgctgggggtcaccacgacgctggtgatcgtcaactgcctcaccacgttccagatctacgccatgccggtgtacgacaacatggaggccgggtacgtgcacaagaagaaccgcccgtgcccgtggtggatgcgctcgggcttccgcgccttcttcggcgcggtcaacttcctcatcgccgtcgcgctgccgttcctgtcgcagctcgccggcctcctcggagggatctcgctgccggtcaccctggcctacccgtgcttcatgtgggtggccatcaagaagccgcggaagggcaccgccacgtggaacgtcaactgggcgctgggaatcctcggcatgagcataagccttgtcctcatagtcggaaacctgtggggccttgtggagaaaggcttgcgggtcaagttctttaagcctgccgattcccagtgaaaaaaaggatgcagatttgtcaatcggttagatttgtaatgccatgcttttatatatgttgatttcttcgccaggaacgtataatgtcctcctgcaccttgacaatttgcaagaaagcaaagtccagttaaggtactcgtggtcgttcctcgtgccattgtgccttttgctcatttttttttctttatttatgcgctttatat

SEQ ID NO: 645 - DNA, 3370 bp, Zea mays
  Clone ID: PAT_MRT4577_11058C.1
gcggcctggttcctccgttcgtgtaagggtctattgcgatctcgagccgcacaggccacagcctctctcccctctgctcccgcggccctcgcagcgcccagcattcagcgcacggggctgcggccaccgcagcgaacagcaaagcacctccgactccaagtcgcgagagccttctcattcgtcttcctcctcttccacccatcctgcctgctcacttccgttccgtagtccagctagatccccgggcaaccgatccaccgagaagcttgtggttgtggcggcggcggagagggaagcggggagcgggaggtcggaggtaggcgcggatgccactgttgtgccggcgccggcgggggccggtgatgcccgcttgagctgggcctccgtgcgtcggaggtggacgagggagcgaggcggcgccagaccgaggttgcgtcgggctcgatttctactgggctgctgtctgctgagtttacggaagtgtttggccctagaagagttgaagataaggagtggagctaggtttaaactctggtgacttggttgttgtgtgcaacgaatcaactatgctgagtttttctgtagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcattccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccaccttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaatctgttgtgtgctgtattttaatgcttgtcaagcagcccgctagactgctttaaaaccttatctcgtagactctgatttaagcatcatgcaactatcaaacttttttttggtcaaaatgtattttccttatgttttatatttttggaaaggaaaataattgaaatattatttattttgaaggctcacgcaaaagtttatttgatcaaggtgtaggggaataggctgagcgagagggtgaacattatgactaatatagggcagaaaatatttgaacattgtcatgtttgctgttgctagaagattgtgtagagaaagtactcacataaatgtttcacttctatttt

SEQ ID NO: 646 - DNA, 197 bp, Zea mays
  Clone ID: PAT_MRT4577_110884C.1
ggctgatgacatggaagcactgtacaagcaggtccgagcagccaaccgaggtgatccttctgaggtcagtacaccaagcaaccaccaaagggagcacaaagaggtacacccccagccactgccgtacgagcagaggaaggccagtatcattgaaaggaacgaccaactcaactcctcgggcggcgcgcatgacgacg

SEQ ID NO: 647 - DNA, 384 bp, Zea mays
  Clone ID: PAT_MRT4577_111062C.1
agggaaagccgtgcggccggccgtaaccttgcatcctttacagcgtcggcccacgctttcttttcattgaactatgctgcttatttagaggggcaacacctactaccagagagccaactctctttagtgagccctgcttccttctagacacaaccacaggcgccgccgatctaccagcacgctgcgcctaactgctggcaccgtcttacaactgcaacaattagctgccattcaaccaacttgctttgacaaacccagcagcattctaccaacaacccatcattggtggcgccctgttttagatttcttatgagtgatagttcaataataaagtgctgggtctagatgtttgggcttcccagaaataagaaagtacatttctag

SEQ ID NO: 648 - DNA, 709 bp, Zea mays
  Clone ID: PAT_MRT4577_11119C.1
gcggggacctcagcactagtctcctcttcgcacgagcgcaacaccatccacccaccagttcgaagcggaggcgaccggcaacctgcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggctgccttcctgtgttcgtattgtagtagttgtggtagctggttgctttgtcgtcctgtagtcgtgcttctttgggtctgtaagaaccgctggttcgatgggattggattggacggtgaagtaggaatgttggcatgttagacttttctccaacgtagcgttgcctctaatttgatctctcaatttattttcaattggggtgcactgtaattcttcctgtctaattcaaatcccctttctgaaattttgtgacctcccaagttttggacccctcgattgttcgaacgagtttttgaatt

SEQ ID NO: 649 - DNA, 588 bp, Zea mays
  Clone ID: PAT_MRT4577_11121C.1
tagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggcgatgggattggattggacggtgaagtaggaatgttggcatgttagacttttctccacgtagcgttgcctctaatttgatctctcaatttattttcaattggggtgcactgtaattcttcctgtctaattcaaatcccctttcc

SEQ ID NO: 650 - DNA, 877 bp, Zea mays
  Clone ID: PAT_MRT4577_11122C.1
gagagtctcctcttcgcacgagcgcaacaccatccacccaccagttcgaagcggaggcgaccggcaacctgcggcggagatgtcaggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggctgccttcctgtgttcgtattgtagtagttgtggtagctggttgctttgtcgtcctgtagtcgtgcttctttgggtctgtaagaaccgctggttcgatgggattggattggacggtgaagtaggaatgttggcatgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacccttcgttgcgccgccgcctccaaaatcgttttttcgtccccacaagaaaccaataatccgccggcgttgaaatgttggtttatcaaaacctcctatctggggacgagctcctgtcggtttctttcccctacaaggagctcaaaaacggcgtcctggggaaggccaaggaaaagtggttcacccaaggccctgttgatgtaaactttggggc

SEQ ID NO: 651 - DNA, 2601 bp, Zea mays
  Clone ID: PAT_MRT4577_11123C.1
gctggtgccggactgacggttagagatggcccacccctcctccgccgccgccgtatcctccacggcgcccgctgcaaaccctagttatggcgcccgcgaggaaggaggcgcccgctctccgccgtctccgtctccgtctccgtctcagagggggcgggccaaggtggtgatcgttatgggcgccacgggcgccggcaagtcgcggctggccgtcgacctcgcggcccacttcgccggcgtcgaggtggtcagcgccgactccatgcagctctaccgcggcctcgacgtcctcaccaacaaggctcccctccacgagcagaacggtgttcctcatcatctacttagcgtgattgatccctctgtcgagttcacttgccgtgatttccgcgaccgtgccctgccgattatacaggaaatagtggaccgcggtggcctccctgtggttgtcggcggcacaaacttctacatccaggctctcgttagcccattcctcttggatgatatggcagaagaaatgcagggctgtactctgagagatcacatagatgatggtataggccttaccgatgaagatgaaggcaatgggtttgaacgcttgaaggagatcgatcctgtggctgcgcagaggatccatccaaacgaccatagaaaaatcaaacgctacctcgagttgtatgcaaccacgggtgccctacccagcgatctgttccaaggagaggccgctaagtataaacttgctgggaattcctggtcatcatgtcagaacagaaatggggtcggcctagtaactccagactctactgctgtttcctgtgggtagatgctgatcttcaagtcctggacagttatgtcaacaaaagggtcgattgcatgatggatggtggtctgctggacgaagtatgcagcatatatgatgcggatgctgtctatacccaggggctgcggcaggccattggggttcgtgagtttgatgagtttttcagagcatatttagccagaaaagaatctggtgagggttcctgtgcaagcctgttaggtatgcatgacgatcagcttaagagcttgttggacgaatttttttcccagctgaaggcaaacactcgcagactagttcgacgtcaaagacggagattgcataggctgagtaaagattttgggtggaacttgcatcgtgttgacgcaacggaagcattcttctgtgccactgacgactcatggcaaaagaaagttgtcgaaccatgtgtggatgtcgtaagaaggttcttgtcggacgattccactgttttgccaagcacaagcgcaagtgacccctcttcaagagagctgtggacgcaatatgtgtgcgaggcctgcgacaaccgggtgctgcgaggtgcgcacgagtgggagcagcacaggcaagggcgaggccaccggaagcgagtgcagcgcctgaagcggaagagcctgaggccatggccatcgctgctgccccaagaccgcagctgatggtaactttttcacagcagaaccggcgaggagtgggacggggacgttgacgtggacatggtcgtctcgtcccacccaaaaaagcgtgccagcatgacagcgacatgctttcccaatcccgaattcccggcacgtcgacggggggaatacctccatgccttttagcagctgaagaagcaggcaccaaagaactgcttgtcaaaagtattgtaccacacgtacgacgggtctagaagccacagaaacgtagtgtggaagtggatagatacatgaacaatggcccatctttctatactgctaaagtttagcatatgctaaggaggtgtttaagattaaaaaaaaaaaaaaaaaaaaaaaaaaaaaaaccctcagcactagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggctgccttcctgtgttcgtattgtagtagttgtggtagctggttgctttgtcgtcctgtagtcgtgcttctttgggtctgtaagaaccgctggttcgatgggattggattggacggtgaagtaggaatgttggcatgttagacttttctccaacgtagcgttgcctctaatttgatctctcaatttattttcaattggggtgcactgtaattcttcctgtctaattccactcccctgtctgaagaaaccaaaaaaaaaaaaaaaaaaaaaaaaaaaaaaaaaaagggcgcgcgct

SEQ ID NO: 652 - DNA, 453 bp, Zea mays
  UNSURE (1)..(453): unsure at all n locations
  Clone ID: PAT_MRT4577_111398C.1
  unsure (1)..(453): unsure at all n locations
aagtaaatcagagttgcatacattttttcgggcctcggnccccggtcatacccaagcccatgcctacacacacgttttcatacgatagattacgtagccacgctttttcgggcctcacacgagcgcatacatacgtacgcgcgcacaaaacggggggcgctcggtatcactctcacacacccccgcgttggacacgggggggggcgacggttcgggggggatcaaacaggcgaaaaaggggggctttttttcgccgccggccccctgggggtccttgggggccttttttttttcggggggctcggggaaggggaaaccgccggagccgacgggcggcgccgccgggacctccttcttgatcttgggggggggcgcgggctccggggccttctttgcctcgtgcttctcggtccgggcctggncccgtcacacgaggggatccgtgatcattat

SEQ ID NO: 653 - DNA, 1019 bp, Zea mays
  UNSURE (1)..(1019): unsure at all n locations
  Clone ID: PAT_MRT4577_111497C.1
  unsure (1)..(1019): unsure at all n locations
gtcgaagggcaacatctttcatcacagnagatgtttggtatggaatctatgctggaacaaacccaggtagagcagttataaattatgcggttaatgtaggagattaagtattacttgcagctttaattgcttggttatttttctatatatttaaattttcacgagatggcgttattgcttgatcttttcatatcaagcaaggcttgacatttgtgattttatattaatattttcaatcaaattaacagtcaaacttgctcttcagtttactacttgcaaataaagcaacatccgtttttgttatttttatgagaaaataaaatacaagttaggactatctctgaataaataaaagactcctggtcatagatacatgttgttttaggataagatctggtgaaaacttgaaaattacaaacatcaatatcaaatttatctggtttagaaacatgttaatatatgtctagatttttgtttgaaaatacttgcaaaatctcgtgatttcaagaatttttagaatatgttctagaagaaattggtggtgaaagaaaatatcaaaaccgtgcaaagacaaatgtgacaactatttttcacgggagggagaattccttgctttttatcactctaatcatgcagtacatttactttttcttcttttttcctgctgatgattccaaatgatgtacacaatgttctaattcccaaacatacatgcatgccatggtctgattcccaaacatacttgctatgttgtaatgagcctgcagagacatttgtacgcgccgacggggcattcatcccatttgctcacgacttcgacatctccacagtcacaactacagnttaggggtgttggtgacattggggatgttaaggttatagatctgcagagtccacttaatagcctcatagggaggcaagtatgcaaaatcggcagaagttctggtcacacaacgggaactgtggtggcttatgcccttgagtacaatgacgagaaaggaataagcttcttcactgac

SEQ ID NO: 654 - DNA, 292 bp, Zea mays
  Clone ID: PAT_MRT4577_111499C.1
ggacgggggaacaacttttcaattttattggacaaaaatgggtgcgaacaaaaaccttgctcatttttttttgggctggtttcatagggggggcaaacaaagggaacaactggggtcccaacacctaatccaaaggtagaacggacactaacacggtgacagaagcgaacggtaacacgatcctttagatggataagataactcggccgaagccagtatgggcccacacattagtctcttcagccgccgttgtcgtcttcgtatcctccaccactacctttggtccgaccgt

SEQ ID NO: 655 - DNA, 2732 bp, Zea mays
  Clone ID: PAT_MRT4577_111563C.1
gctctcaattccccactcatagtcatatttgctcagccttttgcaaacgagttgaaatcaccttgttcaaatcgtcccctcctctctctctctcgctcgctcgccaagcacaatcttctgcgcgttcgtgttgcggatttgttaattggttggtcagctcctctctgacccagaggcaaagccatggctctcacgctgcgttcctcgacgtcgttcctgtcgcctgtggaccccacgtccaagctcctccacaagcccgccgacgaggcgcagccctgctgcgtcgccgtaccccctgcgcccggccgcaggccgcgcgcgctcagggcggccgcggccgctgcgccctcaccggcgacgcaccgcgcgccggcggaggcggccgagctgctgcacggcggcggcgcggaccagcaccacgggctgccgcgcggcggggtgccggtgtacgtgatgctgccgctggacacggtggggccaggcggccagctgtcgcggcagcgcgcggtggcggctagtctgatggcgctgcggggcgccggggtggagggcgtgatggtggacgtgtggtggggcgtggtggagcgggagggccccggccgctacgactgggaggcctacgccgagctcgtgcgcatggtggagcgagccggcctccgactccaggccgtcatgtccttccaccagtgcggtggcaacgtcggcgacacctgcaacatcccgttgccgccatgggtgctggaggagatgagcagcaacccggacatcgtgtacacggacaggtccggccgccggaaccccgagtacatctccctcggctgcgacacgctgccggtgcttaagggccggacccccatccaggtctacaccgactacatgcgcagcttccgcgagagattccgtgactacctcggcaatgtcatcgcggagatccaagtgggcatgggtccttgtggagagctgaggtatccttcataccctgaggccaacggaacctggcgttttccgggcatcggcgagttccaatgctatgataagtacatgcgggcttcgaatttagagtatacctagcaaacttggttaattgatcgatgttggttgctctgatgtttgcagcatcccgttgccgccatgggtgctggaggagatgagcagcaacccgaacatcgtatacacggacaggtccggacgccggaatcccgagtacatctccctcggctgcgacacacttccagtgctcaggggccggacccccatccaggtctacaccgactacatgcgcagcttccgccagaggttccgtgactacctcggcaatgtcatcgcggtaattaaccagccaccgttactacgatcacttaacgttgcaatagcagttgaccataaagaggccatgcctgatgttgtgatcctaggccaaaccactcgtgtctcactgtcgcaggagacctcagtgggtatgggtgcttgtggagagctgaggtatccttcgcacccgcaggccaacgtaatggggggtttcacgggcaaccgggacttccagtgctatgacaaggtaggcgcccgtgactcgaaaggtattcggcgttgctgcgacacgttgcctgagttgttgtgcgttggtacagtacatgcgggcatcgctggaagccgcggcggtggcgtcgggccacgaggagtgggggaggggcggaccgcacgacgccggcgagtacaagcagatgcccgacgacacgggcttcttccggcgcgagggcacgtggagcaccgagtatgggcatttcttcctggagtggtactcgggcatgctcctggagcacggtgaccgcgtcatggccgcggccgaggccgtgttcggcggcacgggcgcaacgctctctgccaaggtcgccggcatccactggcactaccggacccggtcccacgcggcggagctcacggccgggtactacaacacgcggggccacgacgggtacgcgccgatcgcgcgcatgctggccaagcgcggcgctgtgctcaacttcacgtgcatggagatgaaggacgagcagcagccgcagcacgccagctgctcccccgagctgctggtgcagcaggtcaaggctgcgaccagcgccgccggcgtgcagctcgccggcgagaacgcgctggagcggtacgacgatgcggcgttctcgcaggtggtgtcgacggcgcgcggcgcaggcctggccgcgttcacgtatctgcgcatgaacaagacgctcttcgacggcgacaactgggggcggttcgtgtccttcgtcagggctatggccgacggtggcgcgaggccagcgctgccgcggtgtgacacggggcactcggacctgtacgtcgggtttgtcgacgccgccaaggagaggaaggcggcggaggccaagggcgccgccaccaccgcagcattgtaggtggtcgtcggtagatgcccatgcatgtgcttgcataatgcatacagacacatgcgccgagctgttgtataacgtacacaggagaactgtataaattcagggccttcaggttgcaaagttttataggctgtaatcgagcaggtagataaggaggcaggcatgtcagaacttaggctatcttcagtttatttgttccatttcaaactgtattataaggagcagcttggtgactttcactgtcataaatttagctgaaggaaaatagaaatgccaattactacaaaaaaaaaaaaaaaagcggcc

SEQ ID NO: 656 - DNA, 1343 bp, Zea mays
  UNSURE (1)..(1343): unsure at all n locations
  Clone ID: PAT_MRT4577_111565C.1
  unsure (1)..(1343): unsure at all n locations
accggtaccggcactcccgggctcggctgcgacacgctgccggtgcttaagggccggncccccatccaggtctacaccgactacatgcgcagcttccgcgagagattccgtgactacctcggcaatgtcatcgcggagatccaagtgggcatgggtccttgtggagagctgaggtatccttcataccctgaggccaacggaacctggcgtttcccgggcatcggcgagttccaatgctatgataagtacatgcgggcatcgctggaggctgcggcggtggccgcgggtaccaggagtgggggaggggcggaccgcatgacgccggggagtacaagcagatgcccgacgacacgggcttcttccggcgcgagggcacttggagcaccgagtacgggcatttcttcctggcgtggtattcgggcatgctgctggagcacggcgaccgcgtccttgccgcggccgaggccgtgttcggcggcacgggcgcaacgctctccgccaaggtcgccggcatccactggcactaccggacccggtcccatgcggcggagctcacggccgggtactacaacacgcgggaccgcgacgggtacgcgccgatcgcgcgcatgctggccaagcgcggcgccgtgctcaacttcacatgcatggagatgaaggacgagcagcagccgaaacacgccagctgctccccggagctgctggtgcagcaggtcaagaccgcggccagcgccgccggggtggagctcgccggcgagaacgcgctggagcggtacgacgaggcggcgttctcgcaggtggcgtcgacagcgcgcggcgccggcctggccgcgttcacgtacctgcgcatgaacaagacgctctttgacggcgacaactggcggcagttcgtgtccttcgtcagggccatggccgacggcggcgcgagaccagcactgccacggtgcgacacggggcactcggacctgtacgtcgggttcctcgacgccgccaagaagagcaaggcgccggaggctgagggcgccgccaccgccgcggcattgtaggtggatgctcatgcctgtgcgtgcacacagacacatgcgccgtgctgttgtataacgtgcaccggagaaggggaactgtatgtatagattcagggccttgcaggttgcagagttttataggctgtaatcgagcaggtcggtaaggaggcaggcatgtcagaacttaggctgtcttcagttcatttgtcccatttggaactgtattgttataagtctaatctctgtagagagaattctatatggtgttattttccatactaacataatatacataataaaatataatataagaatgtg

SEQ ID NO: 657 - DNA, 162 bp, Zea mays
  Clone ID: PAT_MRT4577_111657C.1
gaacaaacaaacattacccaaactgacattttgacaatgtttggcgttgatgacaacattggaaacagtaatctaggtacaagcaggcgcctctggtggctggcaagtgtgaccacacacaaacacaccataccagttgttgaaccacccgcctgtggcgcc

SEQ ID NO: 658 - DNA, 266 bp, Zea mays
  Clone ID: PAT_MRT4577_111758C.1
aaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcctctgaagataaaccttttaacttgagaagccgcgaccccatctactccaacaagcttggcaagttctttgagatcaccccagagaaaaaccccaagctgtcgggacttggatatcttcctcagt

SEQ ID NO: 659 - DNA, 1717 bp, Zea mays
  Clone ID: PAT_MRT4577_11183C.1
gccggccgggtctcgagacaccactgcgccattggccagctagagccaaccagaagagcttgcagttactgagagtgtgtgtgagggagaggatgggtggcagcggcagggctgctctgctgctggccctggtggtggtggccgtgagcctggccgtggagatccaggccgacgccgggtacggttacggcggcgggtacctcgaggccggccgggccggggctaagagggaagaacaatcgagctactaataaggtcgtatacatatcttctatatactcctctgaaagttgtgaactccggtcgagcttaaaaacagcagcaatggcgaagctttggacattgctgctggctgcagtggtggtcctctcactcctagtgagccccattgcttgcacccgaaagctcaacaaacccaagccgaagccgggcagctacaggcggccggtcaagccgaagccaaaaccggtcacgggcagctacaagccggcgcctgtggccgccagaagaaaccacacagctacacccacgccatcgccgactgtctacggccccggtggctggctgtcaggcgccggcgccacgtactacggcgcgaccaacggcgacgggagcgacggcggcgcgtgcggctaccagacggccgtcggaaagaagccattcgactcgatgatcgccgccgggagcacgccactgtacaggggaggcgagggctgcggcgcctgctacgaggtgaaatgcacgaccaacgccgcgtgctccggccagcccgtgaccatcgtaatcaccgaccagtcccctggcgggctgttccccggcgaggtcgagcactttgacatgagcggcaccgccatgggcgccatggcccggcccggcatggccgacaagctccgcgctggcggcgtgctcaggatcctgtacaggagggtgccgtgcaagtacaccggcgtcaacatcgcgttcaaggtggatcagggcgcgaacccgtactacttcgacgtgctcatcgagttcgaggacgacgacggcgacctcagcgccgtggacctcatggaggccggcagcggcgtctggactcctatggcgcacaactggggcgccacgtggcgcctcaacaacggcaggaagctcaaagcgccgttcgggctccggctcacctccgactcccgcagggtgctcgtcgccaacaacgccatcccggccgcgtggaagcccggcaagacctaccgctccttggtcaactacccctgaaaagagaaataccgacaagtggatggcgtgtattgtgcgtccgggtgttgcgagtggcggcggtgtactactggtgtcggaaaacagaagagaatgaaagaggaggttgaagaagagaataatgtccttcttccctccctggacggtctctgcagtccccaaaagtgatgtgtgacggtgttagtcaaatcatgccggtaatttgatacttcatctcgatttgagttttactgctatactactgtgattgaggtaagacagaatcttatttcttgaccacgtagtacataaactacaaagcatgcccgttgcgttggtaattagactcttgtagtggtttttgccaatatcaagatgtatgtagaatgtgtgtgcatgcgttcacagtgatgagaatatacatgcgtgtatctgatcctctaaaaaaaaaaaaaataaaagaaacaactacatactatgtttatat

SEQ ID NO: 660 - DNA, 229 bp, Zea mays
  Clone ID: PAT_MRT4577_112075C.1
tttcggaccaactagcaacatagaaagcacaatagtgttcgggcaatggcagtcaaaatattttgcttccttatgctccttggtctttctgcaagtgctgctaccgcaaccatttttccacattgctcacaagctctatatagattcctttttttccccatacctttaaccagcggttgtttcagtgtgtgaaaaccctattcttctatcctacatgatccaacatgct

SEQ ID NO: 661 - DNA, 139 bp, Zea mays
  UNSURE (1)..(139): unsure at all n locations
  Clone ID: PAT_MRT4577_112288C.1
  unsure (1)..(139): unsure at all n locations
tctctcgcgatctatatcgtacgcagacgcgccctcactacacatgcagatgatgcttanggtttncccggccccggccgacactgtgccaacccagcttttcggtgcgcccgcgacccctgctcccgtcgtcagggtg

SEQ ID NO: 662 - DNA, 304 bp, Zea mays
  Clone ID: PAT_MRT4577_112369C.1
caaaccaccaagccgtgcatgcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttacagcctgcgaggtaggagcactagaccggcgggattctgcatcgtttcgtgagctccagctccagctcgttggaggacgattgtatgtgcggaaggtgg

SEQ ID NO: 663 - DNA, 284 bp, Zea mays
  UNSURE (1)..(284): unsure at all n locations
  Clone ID: PAT_MRT4577_112620C.1
  unsure (1)..(284): unsure at all n locations
cacccgctggtcacgctcggccnccccatggtcctggaggagccgctgctccanacgttcnacctcccgcctttcctcgtcaagggcgactacaggtgcgctgnacnagtacttntccacggtggcgaacagggcgctgganaccgccgaggnnctgggcctgtcgcgcgagnaggcctgccacaacctcctcttcgcnagaanttcaanagntagggnggcntcaangtgntgtccnngggcctgctggncancgtgacnagnggcggcnngaaggnnatgat

SEQ ID NO: 664 - DNA, 559 bp, Zea mays
  Clone ID: PAT_MRT4577_112636C.1
aattcggcacgaggaacccgtcagggcggcgaatctgagcaactgcacccagagcgcgatccattgccggcgaagaagcaacttgttgcgagcctcctctatggcgagctccgaccatggttccaccaccgccctcaaggacgtgccgggcagctactgcctgccgctggtgggcggcgggcgcgaccagcctttttttttactacttgcaggggcaggacaagtacttagagtaccgcgtggagcgctaccgctccacacgaggtgcgcatgaacctgccatcgcgccactacatggcgcgcgacccgcgaatggatgcggtcctggacgccaagagcttacctggactcttcgacatggacaaggcggagaataaggacctgttcacggccacatacatgccgtgcacctccctcaccggaggctaccgcgcctgctggtacctggacccctgcgagcccacccacaccatggagaagcagctgatctaatccctcctgctctacagtaggacaaggtgatccccaccttacgctccaacttctcctagctcctcgc

SEQ ID NO: 665 - DNA, 273 bp, Zea mays
  Clone ID: PAT_MRT4577_112665C.1
tcgagatcctcaaggtcatccgcaagaacctggtcaagaagtgcatcgagatgctctttgacgacgcggataacaaggacgactacggcaagttctacgacgccttctctaagaacatcaaggtcgggcatccacgatgtctcggacaaccgcgccaagctcaccgacctgctgctctaccactccaccaagagcggctgaccagacgactcagcctcaaggactacctatacgcgcatgaaggacgggcataacgacatctactacatcacc

SEQ ID NO: 666 - DNA, 251 bp, Zea mays
  Clone ID: PAT_MRT4577_112678C.1
ccccaggccgaacccttctgcgcccggtgcgaccttgtatccaccagcctgccctctccttcgcgagaggcggccccggtgaccgcgtcggcagtgggagaccggaccgaggcttctcccgctggaaggttccagccatgcggagtgccgatctgcggggaaaggacgaggagctctactcctccctctttgattccggaaaaagcgacggcgttaagtcaggttcgcagcggattgacaggaacattgaa

SEQ ID NO: 667 - DNA, 236 bp, Zea mays
  Clone ID: PAT_MRT4577_112707C.1
acggttcccatccatccatcgccatcctctaggccaggccaaaggaaccctagccatgagcgcctcctacaagaagctcttccaggccgccaggtccctcgggctcttcggttctcaccgctccgtccttgccgcctagggccgcaccggcgcgctcggcacgctcaccaactttggcaggaagacccttcccaccgcctactttatcctaccacatgcagggatcccaccatgcc

SEQ ID NO: 668 - DNA, 263 bp, Zea mays
  Clone ID: PAT_MRT4577_112978C.1
ggctatcgcagcaggcattttacctttattacccttgttccttcaacaaccgggaggcctattacagcagttacctttggtgcatttgttgggacaaaacattaaggcacaacaactacaacaacttgtgcttggaaaccctggtggctacttttaacaacagcagtttctttcattcaaccaaatggctgcattggaccctgcttgttatttgcaacaacaacttccatttaacaaggaagctggtgactacccccagcaat

SEQ ID NO: 669 - DNA, 317 bp, Zea mays
  Clone ID: PAT_MRT4577_113047C.1
gagccccccagttcttttatttttagctcttttccaagggaacagcccaaaactttcaaagggaaaaaaaaaagattttgggactaacaggtggggggccaattatacaacatgaacccttttgagtcacaagtttggggggggtttggatatgccccctgatccaaaaaaagaactcctgagcccccacctggaccttttaaaggggggcaaggggaaaaaccgaaaaaagcccaataaggttgcaagttgctcaacagctgcatgtttacctttggatcaacattcacagggaaagggaaagcttggcaaacatt

SEQ ID NO: 670 - DNA, 3013 bp, Zea mays
  Clone ID: PAT_MRT4577_113066C.1
gcaccagtttcaacgatcgtcccgcgtcaatattattaaaaaactcttacatttctttataatcaacccgcactcttataatctcttctctactactataataagagagtttatgtacaaaataaggtgaaattatgtataagtgttctggatattggttgttggctccatattcacacaacctaatcaatagaaaacatatgttttattaaaacaaaatttatcatatatcatatatatatatatacatatatatatatatatataaaccgtagcaatgcacgggcatataactagtgcaacttaatacatgtgtgtattaagatgaataagagggtatccaaataaaaaacttgttcgcttacgtctggatcgaaaggggttggaaacgattaaatctcttcctagtcaaaattgaatagaaggagatttaatctctcccaatccccttcgatcatccaggtgcaaccgtataagtcctaaagtggtgaggaacacgaaacaaccatgcattggcatgtaaagctccaagaatttgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgtcgagttcctgaggcatcagtgcagcccgacggcgacgccctactgctcgcctcagtgccagtcgttgcggcagcagtgttgccagcagctcaggcaggtggagccgcagcaccggtaccaggcgatcttcggcttggtcctccagtccatcctgcagcagcagccgcaaagcggccaggtcgcggggctgttggcggcgcagatagcgcagcaactgacggcgatgtgcggcctgcagcagccgactccatgcccctacgctgctgccggcggtgtcccccactgaagaaactatgtgctgtagtatagccgctggctagctagctagttgagtcatttagcggcgatgattgagtaataatgtgtcacgcatcaccatgggtggcagtgtcagtgtgagcaatgacctgaatgaacaattgaaatgaaaagaaaaaagtattgttccaaattaaacgttttaacctttaaagagtttcttttaaaggaccccagcaagctctcggcgtacagggaccggccggttcaaggggacgcaggaggagtatgaggcggcgctgcttgcgtcgacaacgctgtacatcggtaatatgtccttctacaccacggaggagcaggcctacgagctcttctcccgcgccggcgagatcaagaagatcatcatggggctcgacaagaactccaagaccccatgcggtttctgctttgtactgtactactctagggaggatgctgaagatgctgtcaaatacattagtggaacgatgcttgacgatcgtccaatccgcgttgatttcgattggggctttgaagaaggcagacagtggggccgtggacgaagtggtggacaagtcagagatgagtaccgtacagattatgatcctggaagaggtggttacggtaagatggttctgagggaactagaagcacagcgagaattagttgactatggtggatcttttcaaccgaatgcaccacctccctatgagagaagtgagcggaagagaggacatggagattctcataggaatgacagaggagattaccagcggaaacgctaccggaacgatgaccggtcagcaccagaggagtccaagagagcaccggactctgatccagcggagaagaatcctagattccgtgagaaaggtgactctgacgaagaagaggatgactacgacggcaaacgtcgtcgctaaagctgtggaacagccgttgctactacatgcagctgttctggtgtccagacgttgcagaagagtccacagctagcagcagtatccggatctcgccctgttgtacaacagatttaattcttcggtcggccattcctccttttctagtgctcctatcatctgttaatctgaatgtgcgcggtgttacatgtgctccaagtggggcactgttctcacagatacaatgagccttatctgtacgtttgctgctgatgaagcttgagaccagtgcatatattaattctaacagattgttaccgaaccc

SEQ ID NO: 671 - DNA, 191 bp, Zea mays
  Clone ID: PAT_MRT4577_113206C.1
tcgcacggagcgtacgtcgctcttcagctcgcgccgcaaacgtgcgcgcaacccagctggcatcgacgcctgcaccggacgtcgatgccgagctacttcggcaccttttacggcgatgagcaccagcaggtagctggtaatggagattgacagcctcagagtaggatttgatcgagttgctcagcaacgtt

SEQ ID NO: 672 - DNA, 150 bp, Zea mays
  Clone ID: PAT_MRT4577_113275C.1
aaggatggtcgccacaggaagcatcatgtgatcagcacacagactgaaacctacaagaaaaaggtgaagcactcctacgaggcgtacaagactctgcagcaggagctggggttgcgcgaggagccggcgtggatcgtggacaacaccggc

SEQ ID NO: 673 - DNA, 2169 bp, Zea mays
  Clone ID: PAT_MRT4577_11332C.1
tgagcccgcgcgccgtggaaacgcgaggcgtgagttgggttgcaaatgttcgtaaacgtggggcgagtttgattttcttgcgcccttgcctcacctgacctagcgggtccagagtaccgtggaccgcacggccaacgtgctgggccacccgaccccgagcctccgcgaccactacgcgctcggccgcaagctggggcaggggcagttcggcaccacctacctctgcacggacctcgccacgggcgtggactacgcctgcaagagtatagccaagcggaacgtcatcaccaatgaggatgtcgaggacgtgcgccgcgagatccagattatgcaccacctggctggccaccggaacgtcgtcgccatcaagggcgcgtacgaggaccagttgtacgtccacatcgttatggagttctgcgcgggcggggagctcttcgaccgtatcatacagcgggggcattacagcgagcgcaaggccgcggagctcacgcgcattatcgttggggtcgtcgaggcttgccactcgctcggggtaatgcacagggatctcaagccagagaacttcctgctctcgaacaaggatgacgatatgtcgctcaaggccatcgacttcggcctctccgtgttcttcaagcctggtcaaatttttaccgatgttgtgggaagcccttactatgtagctccagaagtgctgcgcaaacgatatggaccagaagctgatgtgtggacagctggagttattctttacatacttctatgtggtgtaccgccattttgggcagagacacagcaaggaattttcgatgctgttctgaaaggtgtaattgattttgatttggatccctggcctgtgatctctgagagtgcgaaggatcttataagaagaatgctgaatcctatcccatcagagcgcttaacagcacatgaagttctatgtcatccatggatttgtgaccatggagttgctcctgatcgtcctcttgatccagctgtcctgtcacgcatcaagcagttctcagcgatgaataagttaaagaagatggccttgcaggtgattgctgagagcctttcggaggaggagattgcagggctgaaggaaatgttcatggcaatggatacagataatagcggtgcaattacatatgatgaactgaaggaaggattgagaaagtatggctccacattaaaggatactgaaattcgtgatctcatggaggcggcggatatagacaacagcgggaccattgattatatagaattcattgctgctacattgcacctcaataaactggaacgtgaggaacatctagttgcagcattttcgtattttgacaaagatagcagtggttacattactgtggatgagcttcaacaagcgtgcaaagagcataacatgccagctgcttttcttgatgatgtgattaaagaagctgaccaggataatgatgggcgcattgattacggggaatttgttgccatgatgacaaagggcaatatgggagttgggaggagaacgatgagaaacagcttgaacataagcatgagggatacgcctgctggtgccctctgaagtctgagcatccaagaaatttgttgcagtatgagagaacgcctggtacgggctgcggaaagcttcttctaatcctttcctacacgaattctgcctacattttttggttgctatatctgttgaagcattgtagggttgtttcaggaattccgggtagggtaactcaactcctgctctttcctcgatgagaagtgtgaattgttatgcgttagttggattgcaaatgttcgtagacgtcgggcgtgtttgattttcttgtgcccttgcctcacctaacctagctgggcaagggtaccctcgccagccgaggcaagctgaagcggctcacctgatacctggccaagcatggaaaaatctttacggcacgggaaacgaggcagatggtaaagaatccaatccaaacacaaacaggctggattttgtccagacaggcgaggcaagcgcttggcgtcttggcgaggaaaccaaacgttcctgttgccctcactaattgcaagttttcatatgcagctgggccatcacgccaaaaaaaaaaacttctctacgtgtaaacgtgtatattcgacatcctgatataaataggaatttcaagctggcgc

SEQ ID NO: 674 - DNA, 1433 bp, Zea mays
  Clone ID: PAT_MRT4577_113655C.1
gataagcaacaattcatttatagcagcttgtttctggagactggagtacacatgagacaaacattgtctcaccaatgtatacgtatataatccatcacacatgaatacttaggttatttgtcttctagcttccgcctgacacaatcacagaactagaatgtaaaaaggggtaaagaaataaaaaaggacgactcctaatggagtccgccattgccgtattgtgacttgccggtttgtgcgcacctcagctgaccaccaaggaggtcaggaaaggcaccacgaaaacgaatgcttcttgagagttaaagctgcacgacgatggatagtggaaacagagcttctcaagaagcattcgttttcgtggtgcctttcctgacctccttggtggtcagctgaggtgcgcacaaaccggcaagtcacaatacggcaatggcggactccattaggagtcgcccttttttttttttttttttttttgataagcaacaattcatttatagcagcttgtttctggagactggagtacacatgagacaaacattgtctcaccaatgtatacgtatataatccatcacacatgaatacttaggttatttgtcttctagcttccgcctgacacaatcacagaactagaatgtaagtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaccagcatggactgcggatcgatggatgctgttacccccgtcaggctttattctaagttaaatcctaaggaaaaaatggtgcttcttggtgctgtcaaaaaaaaaaaaaaaaaagcggcc

SEQ ID NO: 675 - DNA, 408 bp, Zea mays
  Clone ID: PAT_MRT4577_113657C.1
tgctcggaattcgagctagagctcctccttttcttctgttcgggtaaaggtacacgaggctctccggggttctgactcgtgggtgagcggatcgagatggcggcgtcggatgttgagtaccgctgcttcgtcggcggcctcgcctgggccacggacgaccactcccttcacaacgccttcagcacctactgcgaggtcctcgagtccaagatcatcctcgatcgggagacgcagaggtcccgcggcttcggcttcgtcaccttctccacggaggaggcgatgcggaacgccatcgagggcatgaacggcaaggagctggactgtcgctacatcaccgttaacgaggaccattcccgctgttgccgttgaggcggctgctgtgggtactgtggtggccgtggaggctgc

SEQ ID NO: 676 - DNA, 347 bp, Zea mays
  Clone ID: PAT_MRT4577_113658C.1
gcagcaccaagaagcaccattttttccttaggataaacttaaaacaaatcctggcaggagtaacagcatccatcgatccacagtccatgctggttgatgcatgggtctgctggagccgctgatgaacacagcactaacaactgacacagagcgaccttgcaatcaaaaacacagatgggcaacaacagacgagacgaacgaagataagccctctggactagggttaacatcacggtagcaaacaggataacttggccgtgcgggccccaccgttcagttactccagttgccgtcagagttgccgtagccgacgacactgttgtcaccgtcgtagtcttcaccaccac

SEQ ID NO: 677 - DNA, 404 bp, Zea mays
  Clone ID: PAT_MRT4577_113661C.1
tcggatcgggtacgtggatgtgaggttctccggggttcgggttcgggggagagcggatcgagatggcggcgtcggatgatgagtaccgctgcttcttcggcggcctcccctgggccacggacaaccacttcccttccacaacgcccttcagcacctaacggtcgaggtacctctagtccaagatcatcctcgatcgggagacgcaaaggtcccgcggattcggcttcaaacaccttctccacggaggaagcgaatgcggaacgccatcgagggcatgaacggcaaggagctggacggccgcaacatcaccgccaacgaggcccagtcccgcggcggtcgtggaggctgcggccgccggaaaccgtggaggccccggaggccgcggctaccgccgttgctgtccc

SEQ ID NO: 678 - DNA, 363 bp, Zea mays
  UNSURE (1)..(363): unsure at all n locations
  Clone ID: PAT_MRT4577_113663C.1
  unsure (1)..(363): unsure at all n locations
gcaccaaaaagcaccatttcttccttaaggattaacttatacataaagcctgacgggggtaacagcatccatcgatccgcaccccatgctgctcgatgcatgggtctgctgaaaccaacgatgaacacatgactgggggcgggcgcagagcgaccttgcaatcaaaaacacagatgggcaacaacaaacaccacacgaactaagataaaccctttggactagggtaaacatcactttcgcgaacaggataacttggccgcgcgggccccaccgctcagttacttcagttcccgtcggagttgccggaaccgccgccacgggagcctccgcnctttccaacccctccttcaccggggcctctgt

SEQ ID NO: 679 - DNA, 496 bp, Zea mays
  Clone ID: PAT_MRT4577_113664C.1
gcagcaccaaaaagcaccattttttccttaaggattaacttagaataaagcctgacgggggtaacagcatccatcgatccggagtccatgctggttgatgcatgggtctggcgaaaccggggatgaacacagcactaacaactgattcttagcgaccttgccatcaaaaacacagatggggaacaacaaacacgacacgaacgaagataaaccctctggactagggtaaacatcacggtagcgaacaagataacttgggcgcgcgggccccaccggtcagttcctgcagtttccgtgggagttgccgtagccgccgccacggttgccaccgccgtaggcgtcggcaccaccaccgtattctgcggcgccaccgtaatcgacgccaccggcgtatgcgccaccgccatcacggaggccggcaccgccctaggcggcggctgcacgggcaccaccgtacccaacgccggcggctccacggacggcgggggactgggcc

SEQ ID NO: 680 - DNA, 467 bp, Zea mays
  Clone ID: PAT_MRT4577_113665C.1
gcagcaccaagaagcaccattttttccttaggattaacttaaaacaaatcctgacaggggtaacagcatccattgatccacagtccatgctggttgatgcatgggtttgctggagcccaggatgaacacaggactaacaactgacaaaaagcgaccttgcaatcaaaaacacaaatgggccacaacaaacgaaacgaacgaaaataaaccctctggactagggtaaacatcacggtagcaaacaggataacttggccgggcgggccccaccggtaaattcctccaattcccctctgagttgccgtagcccccgccaccgttgccaccgccgtagccgccaccaccaccaccgtagaacaccgccgacaccgtatgcgtcaacgccaccgacgtaacccccgcggccatcatggggcccgccacctccgtattgcgcgccttcacgggatccaccgtagccgccggcg

SEQ ID NO: 681 - DNA, 371 bp, Zea mays
  Clone ID: PAT_MRT4577_113668C.1
attcggctcgaggttggctactcctttttctccggttcgggttcgggttcgtgaggttctccggggttcggtttcgagggtgagcggatcgagacggcggcgtcagatgttgagtaccgctgcttcgtctgcagcctcgcctgtgccacggacgaccactgcctgcacaacgccttcagcacctacggcgaggtcctggagtccaagatcatcctcgatcggtagacgcataggtcccgcggctctggcttcgacaccttctccacggaggaggcgatgcggaacgccatcgatggcatgaacggcaaggagctggactgccgcaacatcaccgtcaacgaggcccattcccgcggctgccgtggaagctg

SEQ ID NO: 682 - DNA, 542 bp, Zea mays
  Clone ID: PAT_MRT4577_113693C.1
cccacgcgtccggtttcgtgggtgagcgggtcgagatggcaggcgtcggatgttgagcaccgttgtcttcgtcggcaggcctcggctgggccacggacgaccactccctccacaacgccttcagcacctacggggaggtcctcgagtccaagatcatgctcgatcgggagacgcaaatgtcccgcggcttcaggttcgtcaccttctgcacggaggaggcgatgcggaacgccatcgagggcatgaacggcacggagactggacgggcgcaacatcaccgtcaacgaggcccagtcccgcggcggccgaggaggcggtggcggccgcggttaccgtggtggccgcggaggcggcagctacagcagtggcaggcgccgtgatggcggcggcggctaccggggtggcagcagatagcgtggtggcagcggcggctaccgtggtggtggcggcggctcagagagggcaaccgaggcggcggctactgaaactgcgacaggaactggaggaactgatcggaggggcccgcgcggccaagctatcct

SEQ ID NO: 683 - DNA, 683 bp, Zea mays
  Clone ID: PAT_MRT4577_113695C.1
ccgctgttttgtcggcggcctcgcctgggccacggacgaccactccctccacaacgccttcagcacctacggcgaggtcctcgagtccaagatcatcctcgatcgggagacacagaggtcccgcggcttcggcttcgtcaccttctccacggaggaggcgatgcggaacgccatcgagggcatgaacggcaaggagctggacggccgcaacatcaccgtcaacgaggcgcagtcccgcggcggccgtggaggcggcggcggtgggtacggtggtggccgtggaggcggcggctacggcggtggcgggcgccgtgatggcggcggcggctaccgcggtggcggcggctacggtgggggctgcggctacggtggtggcggcggcggctacggcggtggcaaccgtggcggtgggtacggcaactccgatgggaacctggaggaactgagcggtggggcccgcgccggcaagttatcctggttgctgccgtgttggttaccctagtccaaaggggtttatttttgtttctgtccggtttgggggtgccccactgggtttttgatggaagggcgctctgtgcaagtgttaggcttttttattcctggtttcaggagaccttgctttaccagcatggcctgggtacgtggtgttgtaccccgtttggcttttttttagtattttaggg

SEQ ID NO: 684 - DNA, 557 bp, Zea mays
  Clone ID: PAT_MRT4577_113696C.1
ggcgggcacggcttctcctccccctccggatcgggttcgggctcgcgaggttctccggggttcgggttcgtgggtgagcggatcgagatggcggcgtctgatgttgagtaccgctgcttcgtcggcggcctcgcctgggccacggacgaccactccctccacaacaccttcagcacctactgcgacgtcctggagtgccaagatcatcctccatcgggagacgcagaggtcccgcggcttcggcttcgtcaccttatccacagaggaggcgatgcccaaccccatcgatggcatgaacggcacagagctggacggcacgaacatcaccgtcaacgaggcccaatcccgcagcggtcgcagaggctccaccggagggtacggaggtggccgtcgaggcggcgactacggggagggtggccgccgtgatggccgcggcgactaccgcggcggcaacggctacggtgacggccgcggctaccgtggtggcggcgtccgctactgcggtgaaaaccgtctgcacggctacctgaactccgaccgaaactggatgaactgag

SEQ ID NO: 685 - DNA, 461 bp, Zea mays
  Clone ID: PAT_MRT4577_113698C.1
gcagcaccaagaagcaccattttttccttaagattaacttacaacaaagtctgacgggggtaacagcttccatcgctccccagtccatgctgtttgatgcatgggcctgctgaagccgaggacgaccacagcactaacaactgacacataccgaccttgcaatcaaaaacacagatgggcaacaacaaacactacacgtacgaagataaaccctgtggactagggcaaacaacacggcagcgaacaggataacttggccgcgcgggccccaccgctcagttcctccagttcccatcggagttgccgtagccgccgccacggttgccaccgccgtagccgccgccaccaccaccgtagccgccgtcgccaccgtagccgccgccgccaccgccgtagccgccggcgccatcacggcgaccgccaccgccgtagccggcgtctccacgggcaccaccgtaccc

SEQ ID NO: 686 - DNA, 526 bp, Zea mays
  Clone ID: PAT_MRT4577_113699C.1
ccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccggcgtagccgccgccaccaccaccgtagccgtcggcggcaccaccgtagccggcgtcaccggcgtagccggcggcggcatcacggggcccgccaccggcgtagccgccggcttcaccggcaccaacgtacccggcggcggcggcggcttcacgggcggcgggggaatgggccttcttgaccgggatggtgcgggccgtcagcttctttggcggtcatgcccc

SEQ ID NO: 687 - DNA, 460 bp, Zea mays
  Clone ID: PAT_MRT4577_113701C.1
cttcctacgctttcgtccattttttttttttgcagcaccaagaagcaccattttttccttaggattaacttagaacaaatcctgacaggagtaacagcatccatcgatccacagtccatgctggttgatgcatgggtctgctggagccgaggatgaacacagcactaacaactgacacagagcgaccttgcaatcaaaaacacagaggggcaacaccaaacgcgacgaactaagataaaccctgtggactagggttaacatcacggcagcaaacaggataacttggccgcgcgggccccaccgttgaatttcttcagttcccgtcgaagttgccgtaaccgccgccacggttgtcaccgtcgtagccggcaccaccaccaccggagccaccgccggcaccgtagccagcgtcgacaccgtcgtaaccgtcggcgccatcacggagcccgccaccaccgta

SEQ ID NO: 688 - DNA, 522 bp, Zea mays
  Clone ID: PAT_MRT4577_113705C.1
ccttaggatttaacttagaataaagcctgacgggggtaacagcacccatcgatccgcagtccatgctggttgatgcatgggtctgctggagccgaggatgaacacagtactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgacaccaccaccgtagccgccgtcgccaccaccgtagccgacgccaccgccgtagccgccgccgccatcacggggcccgccaccgtcgtagccgccgacttcacggccaccaccgtacccggcgacgtcgtcgtctccacggtcggcgcgggactgggccttgttgacggtgatgttggggtcgttcagtttcttgccggttcatg

SEQ ID NO: 689 - DNA, 714 bp, Zea mays
  Clone ID: PAT_MRT4577_113706C.1
agtgctttcttagaggtgggttggcttctcctccccctccggttcgggttcgggttcgtgaggttctccggggttcggtttcgtgggtgagcggatcgagatggcggcgtcggatgttgagtaccgccgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggcggtcggcgcgagggtggtggtggcggctacggcggcggcggcggcggctggagggactgatgtgtgggcccatcctggcttcggccgagttatcttatctatctatagtatcgtgttaccgttcgcttctgtcaccgtgattagtgtccgttctaccttttggatttaggtgctggtaccccctgttgttcccctcttgtttgctcccgcctatgaacgagacgagagaagaacga

SEQ ID NO: 690 - DNA, 434 bp, Zea mays
  Clone ID: PAT_MRT4577_113723C.1
ccttaagattaacttagaataaagcctgacgggggtaacagcatccatcgttccgcagtccatgctgtttgatgcatgggtctgctggagccgaggatgaacacagcactaacaactgacacagagcgaccttgcaatcaaaaacacagatgggcaacaacaaacacgagacgaacgaagataaaccctctggactagggtaaacatcacggcagcgaacaggataacttggccgcgcgggccccaccgttcagtttcctccagttcccgtcggagttgccgtagccgccgccacggttgccaccgacgtagccgccgccaccaccaccgtagtcgtcgccccaccgtagccgtcgccaccgtcgtagccgctcgcgtcatcacggtgcccgtcaccgtcgtagccgccgtcttcacggacaccaccgtaccca

SEQ ID NO: 691 - DNA, 500 bp, Zea mays
  UNSURE (1)..(500): unsure at all n locations
  Clone ID: PAT_MRT4577_113725C.1
  unsure (1)..(500): unsure at all n locations
ccccaccagnggcacgagccggccccacctctcagccccaattcatctccttcgagtggaaatgcggtgctcattttccgagctgagcgtatacgagaggcggcgtgggatgttgagtaccgatgcttcgtcggcggcctcgcctgggccacggacgaccactccctccacaacgccttcagcacctacggggaggtcctcgagtccaagatcatcctcgatcggaagacgcagaggtcccgcggcttggggttcgtcaccttctacacggaggaggcgatgcggaacgccatcgagggcatgaacggcaaggagctggacggtcgcaacatcaccgtcaacgaggcccattcccgcggcggccgtggaggcgggggcggcggcgactacggtggtggccgtggaggcggcggatacggcggaggcggacgccgtgatggcggaggtggctacggagggggcggcagctacgggggtggcggaggaggctacaaagggag

SEQ ID NO: 692 - DNA, 919 bp, Zea mays
  Clone ID: PAT_MRT4577_113729C.1
taatgggggggcattaccaagaagcaccactttttctttaggataaacttaaaacaaatcctgacgggggtaacagcatccattgacccacagtccacgctggtagatgcatgggtctgctggagccggggatgaacacagcactaacaacggacacagagcggccttgcaatcaaaaacacagatgggcaacaacaaacgagacgaacgaagataaaccctcgggactagggaaaacaacacgggagcgaacaggataacttggccgcgcgggccccaccgcttagtacctccagttcccgtcggaggtgccgaagccgccgccacggttgccaccgccgtaaccgccgccaccaccaccgtaaccgccgccgcccccgtaaccgccgccaccgccgtaaccgccaccgccatcacggcggccgccaccgccgtaaacgccgccttcacgggcaccaccgttaccaccgccgccgccttcacggccgccgcgggactgggcctcgttgacggtgatgttgcggccgtccaactcctttccgttcatgccctcgatggcgttccgcatcgcctcctccgtggagaaggtgacgaaaccgaaaccgcgggacctttgcgtcttccgattgaggatgattttggactcgaggacctccccgtaggttctgaaggcgttgtggagggagtggtcgtccgtggcccaggcgaggcccccgacgaaacaacggttctcaacattcgacgccgccattttgattcgctcacccccgaacccgaaccccggagaacctcccgaacccgaacccgaaccggagggggaggagaaaccaacccccctttaagaaaacccgtttttttttttttttttttttttttttttttttttttttttttttttttttttttttttttttttttt

SEQ ID NO: 693 - DNA, 559 bp, Zea mays
  Clone ID: PAT_MRT4577_113739C.1
gcagcaccaagaagcaccattttttccttaagattaactcaggaataaagcctgacgggggttacagcatccatcgatccggagtccatgctgtttggtgcatgggtctgatggaaccgtggttgaacacacggactaacaactgacacagagcgaccttgcaatcagacaaacacagatgggcaacaacaaacacgacactgaacgaagataaaccctctggactagggtaaacatcacggtagcgaacaagataacttggtcgcgcgggccccaccggtctattcctccagttcccgacggggttgccgtaaccgccgccacagatgccaccgccgtaaccggcgtcaccaccaccgtaggcaccaccggcaccgtagccggcgccaccggcgtagccgccaccggcatcacagctcccgccacctgccgtagccagcggctgcacatgcccaccgtacccaccggcgcgcgtctccacggactccgcggtactgggcctccttgaccgtgatgctgcggccgttcagctccctgccgttcatgccctcgatggcgt

SEQ ID NO: 694 - DNA, 1355 bp, Zea mays
  UNSURE (1)..(1355): unsure at all n locations
  Clone ID: PAT_MRT4577_113764C.1
  unsure (1)..(1355): unsure at all n locations
tttgtgccccaacccaaaatgggccccccccttccgtgaaacccccccattacccatgcccgtttaccccccttccgcaaggggccaagggggcccggccccatcattgtcgttggcctgattattccaccaaagcatgatagtcccgtgcccccttggcccattgcaaaaaaaagagcttatctggtgcatcggcccttgaggggtagtgaagagactgcggacttcttccttttgccgtttgtgttcctctcccatgaaggcttttttcctcgggagtctcagtttcagctcctttcatttcacttttccttgagaaacttgctctcatgctttgttgcaataatcaggccaacgacaatgatagtgccgtgcacccttggcacattgcagaaagagtgtaaacagctatggttaatgggtggttttcatgaatggtgatgatcaatatatgtattgttgcacatgatcagcaatgttgtattggtggggtgactaatgcctgccgccaaactgagcgatataacgcatcattaatgacatttgttcaatctggactttaaacatttttccnaaaaaaaaaaaaaaaaaaaaaaaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggctgtgggtactgtggtggccgtggaggcggcggctactgcggtggcgggcgccgtgatggcggcggcggctccggcggtggcggcggcggctacggtggcggcggtggctacggtggtggtggcggctacggcggtcggcgcgagggtggcggtggcggctacggcggcggtggcggcggcggctggagggactgatgtgtgggcccatcctggcttcggccgagttatcttatctatctatagtatcgngttaccgttcgcttctgtcaccgtgttagtgtccgttctacctttggattaggtgttggtaccctggtgttcgctttggttgctcccgctttgaaacgagacgagagaagatgagcaagggttt

SEQ ID NO: 695 - DNA, 2919 bp, Zea mays
  Clone ID: PAT_MRT4577_113768C.1
gtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcagcagcggtggaggcggcggatctggtggtggtggaagcggtggcggcggcggatctggtggcggcggcggcggcggcggtgggacaagcggtcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccatcgggcttccagtgcttctgatatatatggtgtagtattatatatgtccatgcatgcaatgcatctcgtcgtccatcacatgttgttgttgttgtgtgtgttttcgatgatcctgtctctgttataaatatcattattattacagtaaaaaaaaaaaaaaaaaaaaaaaaaatgctttctcagaggtgggttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggcggctacggtggcggcggcggctacggtggtggtggcggcggctacggcggtggcaaccgtggcggcggttacggcaactccgacgggaactggaggaactgagcggtggggcccgcgcggccaagttatcctgttcgctaccgtgttgtttaccctagtccagagggtttatcttcgttcgtctcatgtttgttgttgcccatctgtgtttttgattgcaaggtcgctttgtgtcagttgttagtgctgtgttcatcctcggctccagcagacccatgcatcaaccagcatggactgcggatcgatggatgctgttacccccgtcaggctttatcctaagttaatcttcaaggaaaaaatggtgcttcttggtgctgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagcctgagcactccatccactactttactcaaagtctagagctagcttttgctttgctcaccagacaaacagcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtaccttggccccttctccgcccagacgccctcgtacctgaccggcgagttccccggcgactacggctgggacaccgccgggctgtccgcggacccggaggcgttcgcgcggaacagggcgctggaggtgatccacgggcggtgggcgatgctgggtgcgctgggctgcatcaccccggaggtgctggagaagtgggtgcgcgtggacttcaaggagcccgtgtggttcaaggccggcgcgcagatcttctcggagggcgggctggactacctgggcaaccccaacctggtgcacgcgcagagcatcctggccgtgctcggcttccaggtcatcctcatgggccctcgtcgagggcttccgcatcaacggcctcgacggcgtcggcgagggcaacaacctctaccccggcggccagtacttcgacccgctgggcctcgccgacgaccccgtcaccttcgccgagctcaaggtcaaggagatcaagaacggccgcctcgccatgttctccatgttcggcttcttcgtccaggccatcgtcaccggcaaggggcccctcgagaacctgctcgaccacctcgacgaccccgtcgccaacaacgcctgggtctacgccaccaagttcgcaccggggtcttaagctagctaccgggccgcggcgtgccaggacattgtgttgtacactactcgtttctgtcgtgatctgtaccatgaacgaatgcaaatattcttgtgctctcccagaaggaacgaactggactagttttgctcttccaaacaaaaaaaaaaaaaaaaaaggcccctagggcc

SEQ ID NO: 696 - DNA, 1398 bp, Zea mays
  Clone ID: PAT_MRT4577_113770C.1
cctcgaggccggccggggatccatctcccacgcccccgcctcgcctcgggatcccgccgccgctccatctgcctttgctcccccacccgcaggcagcgagcgacagcgacggcgagggatggccaaggccaggtcgttggcgaagcagaagcaggcgcagcaatcaaacggcggcggcggccacgcgctgtcctccaagctcgcccggtacctcgacccggaggcctccttggacaaggaccaactgctggacgcggtgcactggatccgccaaaaaaaaaaaaagacacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcgtcacgcgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgcaaaatggttgtgctcatctgaaaagctacttactctcgctttgagtgcgaatcaaggcaaaggttgccagtttttcaaacaaaaaaaaaaaaaaaaaagcggcc

SEQ ID NO: 697 - DNA, 1199 bp, Zea mays
  Clone ID: PAT_MRT4577_113817C.1
cagttcttctgatttggtcatgatttatattcgaaatttaatttggaatttgtctaattattcaacacaaccaaactggcgcgcgcacgatgtatcgccaaacatttattcagctagctagttgagtaaaattcgtcttctggagagggaaaattggagctgggcctacggcaagcccgagcccttctccctggcctccctcatgttccgctcccgctctaccctgtccacatcccgcgcgatccggtcccgctccttcacggcggcgtccacgtcctccgcgtcggggaccacgcgctccttgacgccgtgcgcggtgtccttggccgcgtcccaggtgctccgcgccgcctgcttcgccatgtccccgatggcctgcgccgtctcggccaccttccccgcgccctccttggtcatctccaccaccttctccccgtacgacgcggtcccctccacggcccggtccttggcctccccggccctgtccatggcgcgccccgccgcctccccggtccggtccttggccgccttcgccgccccctgcgcccggtccgcggcctcgtgtcccgcctccttggcccgctccttcacgtgccccgccctgtccgcggcctcccgcgccgcgtcacgcgtctcgttcttcgctcgctccgtcgcccgggacgccgtgtccgcggcgtcctccgccacgcccttcgcctggtccttggcccgctcggccatgcccgacgcctggtccgccacgcggccggccttgtcctgcgccctgctcttcgtctccccggccatcctcttggcgtgctccttggcgtccccggtggcgtccttcgcctcctccgccgcgtccttgtacttgtcccctatttctctccggtcttccggcgcgttgtcgtatgcctgggacgatcttggcgcagcctgcaagcagaggcgggtccaggtcgctgcctgcgggcgcggcggaaggaagcacgccggcatgggaagagcctgcatgccagcagcgttgccgttaccggtgagctttgcggcgccggcgacgcgcgcgcctccgagcagcatggcagccatcagcctggacatagacgacgacgtcgacgactaattaacaggcgagacagtgcgttgacgtgaggtcttggatttggatcaacgagctaccaattgtggatgggtttcagggctaggcggtcccgtac

SEQ ID NO: 698 - DNA, 851 bp, Zea mays
  Clone ID: PAT_MRT4577_113942C.1
gagagttgccttggttggcataacatctatgtctttcgactttatcttaacctcagcagcaacagcatcatcatcttcgttgaacgaataagcaacatctttgaatgcctggagcagggtgctgttaagacctcatgtcctctttcattgactaaaactgtatcagctaataatagtgaaaactgcttcgtcttttcactggttgtttctgcctggatgttatgcaaaccaagggatacattaaaaaccattcccttttttatcctgcgatcattcttggcattcagatttaagccagattctcggaattcaaggcctattccagttccagctgactttgttagattaggaagaagttcaggtgcatccctctcaatcacagccactgcagcttgataaactgcactcatctgattgcctggtttcacttgttgaatagcagcttcatgagctttcctaagggtctcatatgctttattctgtgtaggggtagcgtcgataagatatgtccgagcaacatttgagcaatagctactgtatttggaaccaattgcacagatgataatacttgctgaatcataatacaggtactcgtcattgctagacgcaccaggctttagatcaaacttacccccactttgaaagactggagggtagcatatatcaacattatcaggcttcaatttcaccttgacctttagtgggtccagaatagccttctctgcgtcatccatcaacgatgagtgtgagacttccttctcctcatcgataaccttctccaacttaggaatcacaaaatttctcccggcctcgaaagtcccaatagcagccttcttacacatgtgatctct

SEQ ID NO: 699 - DNA, 2567 bp, Zea mays
  Clone ID: PAT_MRT4577_114301C.1
gatgagggaagcaaaatgacatagatgatgagggaagctaaggactcggatcggatgtatttcacaggattccacgacactcagagcagacccgaaatgtgacacgaagaagacacacggtcctgcctcctggcaatcaaggtactactagacactaccgtgacctgtaccaacagtgacccctttggacccacacgcagacacacacaaacaggcatcgccattgaccgtcgtccctcatcgctgaaaacttgcatattataggaaggaaggacacctcagtcgacctcctccatcttgctctcctccgcggcgccctcgtcaagcgcgggcatgtcggcgtcctcgtcgccagcagcatcctcgtcgatgttgaggccgagcttgagcatcctgtggatcctggccgcgaacgtgttggggtcgtcgaggctgaaccccgaggtgagcagcgccgtctcgaagagcagcagcacgaggtccttgacggacttgtcgttccggtcggcctcggcgcgcttccggagctcctccatgatgccgttgtccgggttgatctccatggtcttcttggaggacatgtacgcgctcatgctgctgtcacgtagcgcctgcgccttcatgatccgctccatgttggcggtccacccgtactcgcccgtcaccaggcagcacggcgagtcgacgatgcggtccgacaccaccaccttctcgacgcggtcgcccaggatgtccttgatcaccttgcacagctcctcgaaccgcttcttgcgctcctcccgccgcttcttggcctcctcgtcgtcctcgtcgtccagctttaggccttccttggttgccgacaccagcttcttgccgtcgtactccttgagctgccccacggcgtactcgtcgatggcgtccaccatgaacagcacctcgtagcccttcttcttgagacgctccaggaacggcgagttctccacggccttcctgctctcgccggtgatgtagtagatgtccttctgcccctccttcatgcgcgtcacgtagtccttgaggctcgtcgtctcgtcgccgctcttggtggagtggtagcgcaggaggtcggcgagcttggcgcggttctgcgagtcctcgtggatgcccagcttgatgttcttagagaaggcgtcgtagaacttggcgtagtcgtccttgttctccgcgatctcgaagaacatctcgatgcacttcttgaccaggttcttgcggatgaccttgaggatcttgttctgctgcagcgtctcgcgggagatgttgagcggcaggtcgtccgagtccaccacgcccttcacgaagcccagccactccgggatgagctcctcgcagttgtccatgatgaagacgcggcggacgtagagcttgatgttgttgagcttcttgcgcgtgtcgaacaggtcgaagggcgcgcggcgaggcacgaacaggatggccttgaactccagctgcccctccaccgagaagtgcttcacggcgaggtggtcctcccagtcgttggtcagagacttgtagaaggaggcgtactcgtcgcgcgtgatctcctcgggcttgcggagccagatgggcttctgcttgttgatctgcacccactcgtggctcacctccttcaccttcttcttctttttactcttatccttggtgtccttgtcctcgtcgtccacctcctcgacgtcgccctcctcctccttcttgttgtcctcctcctcctcgtcgtcgctgatctccttctcggtggtcttctccgtccacaggtagatggggtagctgatgaactccgagtgcttcttgacgaggtccttgaggcggcgctcctccaggtactcgagctggtcgtccttgaggaagagcgtgatcttggtgccccgaccgagctgctcccccgtggtgtcatgcgtgacggtgaaggacccgccggcctgggactcccacacgtactgctcgtcgtcgttgtgcttggtggtgaccatgaccctgtccgcgacgaggtaggcggagtagaagccgacgccgaactggccgatcatcgacacgtcggtggcgcccgcggccagcgcctccatgaactccttggtgcccgaccgcgcgatggtgccgaggttgttgacaaggtcggacttggtcatgcccacgccggagtcgatgatggacagcgtcttgctggccttgtccgggacgagccggatgaagagctccggctgcgcgtccagcttcgacttgtccgtcaggctctcgaagcggatcttgtcaagcgcatccgatgcgttggagatgagctctctgaggaagatctccttgttcgagtagaaggtattgatgatgagggagagcagctggttgatctcggcctggaatgcgaaggtctccgtctccgcaccgccagccatgtgcacgtccgcagacgccattgccctgcttgttgttgtcggagaatcgaatgcttagttgttgcggatagattgctgagagagagtgagagagaggcgaaggatcgatcgctcaattgttgctcggtttcgtgtcacgttcgggcttaattcgacccgcga

SEQ ID NO: 700 - DNA, 1272 bp, Zea mays
  Clone ID: PAT_MRT4577_114398C.1
atttgctggaacagttatatgaagagccatattgcatctagtgattttgagggtatagtacaggtttgggatgttactaggagtcaagtttttgttgggatgagggagcatgagcgacgcgtgtggtcggtggacttctcaattgtggacccaacaaaattggtcagtgggagtgatgatggatctgtgaaactgtgggatatgaatcaggctgggagtattggcactattagaacaagagcaaatgtgtgttctgtacaatttcaacctgatactgctcgctccattgccatcggctctgcagaccacaaaatttactgctatgatctacgtaacatacgagctccttattgtacactagttggccacacaaagactgtaagctatgttaagtatctggatgcatcaacaatactatccgcatctactgacaactcattgaagctttgggacttatcgatgaatccaggaaggataattgacagtccagttcaaacatttacagggcatacaaatacaaagaacttcgttggtctttccatatctgatggttacattgctactggctctgaaacaaatgaggtttttgtctaccacaaagaatttcccatgccagtgttggcttataagttcagcgtgacggaccctatatcgggacaggagattgatgatcagtcacagttcatttcatgcgtctgctggagagggcagtcttcaactctactttctgcaaattccagcggcaacattaagatcttagaaatggactgaggagtttgcatctgtttgagtctcagctataaatagaccgacttcttaggccgtgctcaacaaatcatgcatatagccgtggtagatgtcactgtctagggagttgagtttaaaatgagagattggatgagtaatgctgctagagatagcttaccaagttgtgcgcgtgcgtggcttcaaaatttgtggcgattaaatccagagttgccaacggtgcagcttaatccgagttgcagagttgggaaaggtagtagctgtagcagatttagcgtggttttataggattacagattagcgtggtagcaaaagtagcataaataggaaacagaattggggcgtgggatagtaccacggggaaaggttttgtacatcattggtttgaggtatacttgtacaggcaatcaatccagtttctacctaccagtaccagcatcagacttgctcttgtcatagtgttacttgaaaggtgaaaggtataaatcgctgtacatctgttgaatc

SEQ ID NO: 701 - DNA, 320 bp, Zea mays
  Clone ID: PAT_MRT4577_114420C.1
tcgtctttagtgaggtcctgttcttcatctacctcctacctcccatcatcttcaatgccgggttccaggtgaagaagaaacagttcttccggaatttcatgacaatcacactgttcggtgctgttggcacaatgatatccttcttcacaatctctctcggcgcaatagcgatattcagcagaatgaacattgggacgctagatgtcggggattttctcgctattggagctatcttttctgcaacggattctgtgtgcacgctgcaggtcctccatcaggatgagacgccctttctgtacagtctggtattcggagaagga

SEQ ID NO: 702 - DNA, 395 bp, Zea mays
  UNSURE (1)..(395): unsure at all n locations
  Clone ID: PAT_MRT4577_114454C.1
  unsure (1)..(395): unsure at all n locations
gaccgcngcggcccaggnnnccggcgccgagggcgggcaagggagggaagggncngcnggcggccaagacgacggcggccaagagcaccgacaaggacaaggacaggaagaaggcccccgngncgcgctcggggggcgcgggccnccagnncccggngggncgcacccaccgccagcgcaaggcgcgngccncngcgcacggccgcgncggcgccaccgccgccggcnannccgccgccacccgcgaggaccccaccgccgagggccccgagccggccggcnccgccggcaaggaccccangggcaagcgcancaccccgcgccacccgcagcncgccanccgcggggacgaggagcccgacacccccancaagggcaccancgccgggggcggc

SEQ ID NO: 703 - DNA, 2142 bp, Zea mays
  Clone ID: PAT_MRT4577_11460C.1
cccacgcgtccgcccacgcgtccgcggacgagtgggcagcccgccgcgcagagcagcgcagcgcagcgcaggcgccctccaactccgggctccgcaaccgctgctccccctccctccctccctccagctcggcctgcctcagcccgcgccgcgcgatgtcagaggaggacgaggaccagccgccgcccaagcggccgtgcgcgtcgccgcccgcggaccaggtgctcgacaacgtgctcgagacggtgctccagttcctggacgccccgcgggaccggagcgccgcctcgctggtctgccgctcctggcaccgcgccgagtccgccacccgcgactccgtcgccgtccgcaacctcctggccgcctcggccacccgcgccgcgcgccgcttccccaacgcgcggagcctcctcctcaagggccgcccgcgcttcgccgacttcaacctcctcccgcacggctgggacgcctccgccttccgcccctgggccgccgccgtcgccgcggggtccttccccgcgctcacctcgctctacctcaagcgcatccccgtcaccgacgctgacctcgacctcctctcccgcccgctcccggcgtcattccgcgacctcacactgcacctctgcgacggcttcacctcgcgcgggctcgcctccatcgcctcccattgcaggggcctgcgagtgctcgacgtggtggagtgcgacatggccgaggagcaggaggtcgtggactgggtggccgcgttcccgccggagcccaccaacctggagtcgctctcgttcgagtgctacgagccgcccgtggccttcgccacgctcgaggcgctcgtggcgcggtccccgcgcctcagccgcctgggggtcaacctgcacgtctcgctcggccagctgcgccgcctcatggcgcacgcgccgcgcttgtcgcacctgggcaccgggtcgttccgcccggcggaaggcggcgaggaggaggcagagttcggggaggttgtctctgcattcgtgtccgctgggcgagcgcgcacgcttgtttctctctccggcttccgtgacctcgcgcaagagtacctgccaatcatcgacgtggtgtgctcccacttgaagagccttgacttaagctacgccgcggtcaccccgaatcagatcctgatgttcatcgggcaatgctacaaccttgagacgctatgggtacttgactcggtgcgtgacgaagggctcgacgccgtggggatttactgcaagaagctccagactcttcgcgtgctcccattggatgcgcatgaggatgccgacgagttggtatcggaggttggccttactgccatcgcacggggctgccctgctctccgttcaatactatatttttgccagacaatgaccaacgctgctgttgtcgacatgtcgctccactgcccggagctcaaggtattccggttatgtataatgggacgacaccagccggaccatgcgactgaggagcccatggatgaaggattcggtgccattgttaagaactgtaggaagcttaccaggctatccacgtcgggtcaacttactgaccgggcgtttgagtacattggcaggcatggcaagtccctgcggacgctctctgtagcgtttgctggaaacagcgacgtggcgctgcaatacatcctccggggctgctcaaagcttgagaagctggagataagggactgccctttcggtgatgccggcctactctctgggatgcaccatttctataacatgcggttcgtctggatgtcaggctgcaacctgaccctgcgggggtgcaaggaggtggctcgggggctaccacgaatggtggtggagttgataaatggccagcctgatgagaacgagaggaaggaaagtgtggacatcttatacatgtatcggtcactcgatggtccaagggaagatgtaccaccatttgtgaagatcctgtgaagctgcttctggtagtatcatgctgctgcccttgatatgctagttgagtgcagatcatttaacggaatatatgtaagatgttgggctgcagatatggtacaattttttttatctcttcaaattcttaggaggatttccaaagcactgtaatggagcggcgggcagggtgttcaattgacgttgttgttct

SEQ ID NO: 704 - DNA, 2578 bp, Zea mays
  Clone ID: PAT_MRT4577_11461C.1
gggaagatgtaccaccatttgtgaagatcctgtgaagccgccgcgtctgcaggcagagcagcgcaggcgccctgcacctccactctgcagctctgctccccctccctctctcccgctcctcctccttttccttctccagctcggccgcctcagcccgcgccgcgatgtcagaggaggacgaggaccagccgccggccaagcgacccagcccgtcgccgcccgcggaccaggtgctcgacaacgtgctcgagacggtgctccagttcctggacgccccgcgggacaggagcgccgcctccctcgtctgccgctcctggcacagcgccgagtccgccacccgcgagtccgtcgccgtccgcaacctcctcgccgcgtcggccacccgcgccgcgcgccgcttccccaacgcgcggagcctcctcctcaagggccgcccgcgcttcgccgacttcaacctcctcccgcacggatgggacgcctccgccttccgcccctgggccgccgccgtcgccgccggggccttccccgcgctcacctcgctctacctcaagcgcatccccgtcaccgacgccgacctcgacctcctctcccgctccctcccggcgtcattccgtgacctcaccctgcacctttgcgacggcttcacctcgcgcgggctcgcgtccatcgcctcccattgcaggggcctgcgagtgctcgacgtggtggagtgcgacatggccgaggagcaggaggttgtggactgggtggccgcgtttccgcaggagccctctaacctcgagtcgctctccttcgagtgttacgagccgcctgtggccttcgcggcgctcgaggcgctcgtggagcggtccccgcgcctcagacgcctgggggtcaatctgcacgtctcgctcggccagctgtgccgcctcatggcgcacgcgccgcgcttgtcgcacctgggcaccgggtcgttccgcccggcggatggcggcgaggagggggcaggattcggggaggttgtctctgcattcgtggccgctgggcgagcgcgcacgcttgtttccctctccggcttccgtgacctcgcgcaagagtacctgccgaccatcgccgtggtgtgcgcccacttgaagagccttgacttaagctactccgcggtcaccccgaatcagattctgatgttcattgggcaatgctacaaccttgagacactatgggtacttgactcggtgcgcgacgaagggctcgacgccgtgggaatttcctgcaagaagctccagtctcttcgtgtgctcccgttgaatgcacatgaggacgccgacgagttggtgtcagaggttggccttactgccatctcacggggctgccctgctctccgttcgatattatacttttgccagaccatgaccaacgctgctgttgtcgacatgtcgcggaactgcccggagctgaaggtattccggttatgtataatgggacggcaccagccggaccatgcgactggggagcctatggatgaaggattcggtgccatcgttcagaactgcagcaagcttaccaggctatccacgtcggggcaacttactgaccgggcgtttgagtacattggcaggcatggcaagtccctgcggacgctctctgtagcatttgctggaaacagtgatgtggcgctgcaatacatcctccggggctgctcaaagctagagaagctggagataagggactgccctttcggtgacgccggcctcctctctgggatgcaccatttctacaacatgcggttcgtctggatgtcaggctgcaacctgaccctgcaagggtgcaaggaggtggctcaggtgctgccacggatggtggtggagttgataaatggccagtctgatgagaacgaaaggaatgaaagcgtggacatcttatacatgtatcggtcactcgatggtccaagggaggatgttccaccgttcgtgaagatcctgtgaagctgcgcttctgcggagatggctgggtatcgctatctatcagtgggtgcctggtggtattcaggctgctgcacttgatatgctggctgagtgcagatcatttaacggaatatatatgtaagttgttgagctgcagatgtggtacatttttatctcttagaaagatttcgaagcactgtactggagcggggcgggcgggggtatcatgtagtaggagttcatcagatgtggtacatttttatctagtaggagttcatcagtgtatccaaagcgttcacggcaggaggactaagtgcagcagagcaggcttcttcgagggggcctcatggctgcctcagttttgtttgctgctctggagggggctctggtttgaggaccatattttctgtgccggtgcaaccaccatgttttccttcaaattttcgaaatgaaacctgtcatatcagactatattagattcattggaacttacccctatgttgttgttggtgcatattttctgtttcattttttctcgctttagaactatatgagatgagatgagaaagacctcctgatctgagctactgtatattgttaaatgccaatgttcctagagtcccaagttgtttgatctg

SEQ ID NO: 705 - DNA, 456 bp, Zea mays
  Clone ID: PAT_MRT4577_114642C.1
gcacgcgttcggccacgcgttcggccacgcgttcgtccacgcgttcggccacgcgttcggggggccttcggatgcgagctggcgcgctttgacccggttgagttcctggagttcggccgcgggaaggcggtggcctttgtcggggacttgctggcgcggaaccacatgccgtcggtggtttggcttctggcccaaggggggtattccaagggcctggcggggaacccgttggaccaaaacaaggggtaccaattccgggcgtacaacttcaccatcagcatggtctggtcggcgttcctggtgcgcgcccgggagcccgaacacgaagggcccgtgcacacgggccactggagccttttccttgacgagcccgacgaccagtgggtgttccaaatggcccggttcgacttcctgctggtgtcggcgggccactggttcttccggcccttccttttt

SEQ ID NO: 706 - DNA, 136 bp, Zea mays
  Clone ID: PAT_MRT4577_114825C.1
cgatcattgtcatatacggagtacatactatgtattccaaagagagcgaaagctgccacagcaccatgacattacatggagggtggtggcactacatataacatcaccagtcgatcattgggcttacatcattttg

SEQ ID NO: 707 - DNA, 324 bp, Zea mays
  Clone ID: PAT_MRT4577_114846C.1
acgctcgccttttcactggactcactcgccatacacaccctctctccagctccgttcgagcgcctagcagcatcatgcgcggggcggtcacgtagtaagcaactctcggctccctctccccttgctccatatgatcgcgcaacccatcaagctacacgcgtggactgccttccctgcgtcggaacattacgggatcgcaaggatgcctgcgtcggtctacaaagccatctgcttacaaaaaccgcgctcaaaacgcaccaatgacagagaagcgacctccttcgcccgccgatcggactcaacgccgaggcccccacacgccaa

SEQ ID NO: 708 - DNA, 1354 bp, Zea mays
  Clone ID: PAT_MRT4577_115011C.1
gatccaattgcttcattcggggtagtaattttacaaagcccagttatggggatacattggtttcaaaaaaaaaaactcgaaattctcccgcctatccaccttgaattggattggatttgcttcgagcagtcagtcttgccgaagtttttaggagttctccgacctcgtagtcaatcactcagtctcggagacacacattgccactgcgatggccgcccaccaggactcggcggcatcggggagcgggcctcctcgttgtcctcgcgtcctcctggcagcctccggcagcgtggccgccatcaagttcgaggtcctctgccgcagcgtcgccgagtgggcggatgtccacgcggtggcgaccgcgtccgcgctggaattcatcgacgtggcctccttcccgtgcgacaacctcctcacctgcgacgaccaggagtggtactacagcaagcccgtttacgtcgcgccggccatgaacaccttcatgtggggcaaccccttcacggccatcgcgccgctctcggccaacaccctcgcaaaggtacgccgtacgcacgccagctggtcatcgcgctcgccctcaccggtcgccgctgacaactctgcctgctgccaggtcgccggcgggctgtgcgacaacctcctcacctgcgtcgtgcgcgcctgggactacagcaagcccgtttacgtcgcgccggccatgaacaccttcatgtggggcaaccccttcacggcgcgccacctcgccgtcctgcgcgacctcggcatgtccgtcgtcccgccggtcaatggcgcgatggcggagccgtcggagatctgcaagaccctcatgctcttcttcggtccgcaacatctttagcagtcgccaagctcctcagttctttgctcctttatgtatgatgagatgtgtcccttgcttgacctagcatagcaatatggcagtggagcgcttctcgtctttcatttccccgtacagatcgtcaagcaccctgaaaacctcctcagcttcagacggcggcgcgctccaggccgtgaaggcgaacaccttgttcctcacttcaatccagctctgccccggattcttcctcaaccctgcctccttcatcgtcatcctcaccctcttggagtcgtcccacatcccacacgcggcgtacaggtttgtgatcagcgtgcggttgccggtggttgccgtctcagcctgcagaactttggccatggcagcttcggccagtgctgcatccccgtgaatcctgcaggagttgagcagcgctccccacacgcacaggtcaggcttcatcggcatcgtatcaatgagctcacacgcgcccctcagcaggccagcacgccccaggagccc

SEQ ID NO: 709 - DNA, 276 bp, Zea mays
  Clone ID: PAT_MRT4577_115086C.1
gccctggcttgtttagcatatcaacccatcttcgacacactagagctagctagagagagatggaggggacggtttcctccttcccggtggagaacatggtgaagctggagaccgacgagagggccactgccatggaggtcatccgccacagctgttagaactggggcttctttctgctggtgaaccacggcatctcccacgagctggtggacgaagtggaacggctgaccaaggcgcactactccacctttcgggaggccaagttccaggagttcg

SEQ ID NO: 710 - DNA, 491 bp, Zea mays
  Clone ID: PAT_MRT4577_115129C.1
tccgttgctgtcgcctggagtttaccgggtgatctatgacaagacaaatcatagccccaaattttgatcgtggctatggtgaaccagacgagatgctggctttgacaagtttcaagaactttaaatgcgaacgaggagagaacagtggtgcacatatcatcagaataccatttggccccaaagaaaagcatctagctaaagaaaatatctggcctttcattcaagaatttgttgatggtgcactaggtcatattgtgcggatgtcaaaaactttaggcgaagaaactggcagtgtgtgtccagtgtggcctgctgtgattcatggtcattatgccagtgcaggagttgctgctgctctactatctggagcacttaatgtcccgatggtgtttaccgggcattttcttgggaaagataagcttgaagggcttctcaagcaagggagacagacaagagaacaaataaacgtgacatacaaaataatgcgccca

SEQ ID NO: 711 - DNA, 3641 bp, Zea mays
  Clone ID: PAT_MRT4577_115380C.1
gcctggctctggcttctgccatcccactcagcagtgccaaggcccagcgccgaccgagccttcccctcgcctgatctgcgcgtccctgtcctcggctcctgagcactcgcgtactcgctcgtcgcatctgcccacactaccactggccacaccgaaaccctagctgcgcacccaaatcgatcgatccagggacggcagcggcacgacgcgccaaaataggttcagaactagcgtcgcgacaaaatcggttcacgaccgccacggttggaccagctgcgccgtggccgtgcggctgtgcggccggcattggcgcgctgcgcgctgctgcaggccggtgtgccgcgcggctgggcgacgtgaaacggatccacatcgtaggagcagaacttgctggtcgaggtggaggcttgctgcgtgcagcaggacagggagtcagggacaacagattttagcaaagtatgagctgtgaattagtgttagaggaaagcacgaaggaaatagtggcataaaacttgatttgtctaaagataaattggtttcttaaaatggctcagcaaatggcttcagttcatttgaatgatacaacagttgttgatgccaagcccttgcgtacattaactcccatgttccctgcaccactagggcttcacacgttcactcctcagaactcaccttcagttgtttgtgtgaccccatttggaccatatgctggagggactgaattggggatgcctgctgttccaccaatgtttgcagcgcctgtacctgctgcaggagcagaacccagccagagacagccgcatacagctaatatgaacggaggagacactgaattggggatgcctgctgttccaccaatgtttgcagcgcctgcacctgctgcaggagcagaacccaaccagggacagccgcatacagctaatatgaacggaactgcagtcaacagttcggtcacatctttgcaaactcctccttcagctgccacacaggaatctggtaagaggaagaggggcaggccaaagcgtgtgcctgatactactgtttcttcggctccttcagctcctctggctcctactatttctccagttccttcacttcctgtggttactccagttccttcagctcctcaggaattgaacactattgtttccctgacgccttcttcagacgccccacaagaatctggcaagaggaagaggggacggcccaaacgtatacaagacgttcctgtaatggttcctctgacctcgcaaggagatagcacatctgttattcagacacttccagggtccagtgtacatgaatctggtacgagaaggggacgtcccaaacgtttgcaggatagttcagatattgtcactccaattgactcaaaagatagtgagtcctctccccagccacctattgccgcacctgccgaaagtggtaagaggaagaggggacgtccaaagcgcattgatggttccgtgactccttcaagtcattctgttttttcaatagatgatgatgctgttgacacgatgaaacgtggacgacctaggaaaattgataccaaactgttacagtttccatctttattttcagatgatcctagacaaactgcagataatgtactcatgatgtttgacgccctgcgacgcagacttatgcagatggatgatgtgaaacaagctgcaaagcagcagcctaacttgaaagctgggagcatcatgaacaatgctgaacttcgtgtcaataaggacaagaggataggagaggttccaggtgttgaggttggtgatatgttctacttcagaattgagatgtgcttagtggggttgaatagtcagagcatggcagggatagattacatgtctgccaagttcggtaatgaggaggaccctgtagctattagtgttgtgtcagctggtgtatatgataacactggagatgatccagatgttctagtttatactggacatggcatgtcgggtaaggatgaccaaaaacttgagaggggtaatcttgcactagagaggagtttgcatagaggtaatccaatcagagtcattcgtagcgtaaaagacttgacttgtccaactggcaagatttacatatatgatggtctttacaagatcaaagaagcctgggtagagaaagggaaatctggtttcaatgtgtttaaacacaagttgcttagggaacctggccaacctgatggcattgcagtgtggaagaagactgaaaaatggagggaaaatccatcatctagagaccatgttatattacttgacatatcatatggtgtggaaaataaccctgtctgccttgtaaatgaggttgacgatgaaaagggccctagccgcttcacttatacaactaatttgacatatgggaattctctcagctcgatgagaaagatgcaaggttgcaaatgcataagtgtatgcctccctggtgataacaactgctcctgtacgcatcgaaatgctggtgaccttccttacagtgcttcaggcatacttgttagccgaatgcccgttttatacgagtgtggtgattcctgcacatgttcacaaaattgccggaaccgagttgtacagaaaggtacgcagatccgttttgaagtttttaagacaggagatcgtggttggggcctccgtagttgggatccaattcgagcaggcacatttatctgtgaatatgcaggtgaaatcattgacataaatagagtgaatggtgaagatgactacatatttgagacttctcctttagagcagaatttaagatggaactatgcaccggaattgctgggtgagcctagtctttctgactcaaatgaaacaccaaagcagctgcctatagtcatcagtgcaaaacgaaccggcaacatagctcgctttatgaaccacagctgctcacctaatgtgttttggcaaccagttctctatgatcatggtgatgagggatatccacatattgcattctttgcaattaagcatattcctccaatgacagagcttacctatgattatggtcagaaccagcgtaatagtattcaaatgggaacccattctggttttcggaagtctaaaagttgcttatgttggtccccgaagtgtagaggttcctttggctaataaccagccctataaggaatatattggatcataatactccatttcaaagttacacctaagatatctgctggtcgacttttatattcagctcccaaaaatctgtcacaagtttgtgagagcaactgaattgtctttaccagcagaagcagcccgtcatggtggcctgtatgaagcagcaggggtctcctatgtcctaggtgttccatgcaccatcgaataaatccacccctcttcatgttagaatgggaaacggggatgtgttttgcacaaattatctgtcatgcagtcgtcgtattaagttttcttgaactagtttgtagtcatcctcagagaatgcatgatgtgcactttgtagtaatatatgcaggttgttatcccacctactatataaccatcaaaatttcagtgtttgtacaggacgccctatgtagtggcgctgcttgcaaatgttagttagtacactgatattccataattttactcctttccaaattaattcaacttataaaattattctaagtc

SEQ ID NO: 712 - DNA, 1280 bp, Zea mays
  Clone ID: PAT_MRT4577_115406C.1
cctcgaggccggccgggccgggatctccggcctcacaccgcaaccgcaagcaagcgaagcgcagagcctgcctgaccagagctagctgagctacagccaacagcagctggtctgactgacatggcgaaggacatcgaggcatcggggcccgaggcgggcgagttctcggccaaggactacaccgaccctccgccggcgccgctggtcgacgcggaggagctcacccagtggtccctgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcgtgggccttcggcggaatgatcttcatcctcgtctactgcaccgccggcatctcaggtgggcacatcaacccggccgtgaccttcggcctgttcctggccaggaaggtgtccctcgtccgcgcgctgctctacatcgtggcgcagtgcctgggcgccatctgcggcgtgggcctcgtcaagggcttgcagagcgcctactacgtgcgctacggcggcggcgccaacgagctcagcgacggctactccaagggcaccggcctcgccgccgagatcatcggcacgttcgtgctcgtctacaccgtcttctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaaggcctgggacgaccaatggatcttctgggtgggcccactgattggcgccgccatcgccgccgcctaccaccagtacgtgctgagggccagcgccaccaagctcgggtcctaccggagcaacgcctaagttccggccggccgcccgcccgaacgcgccaggagctgggcaccgttacaattctgttcctccacatgacgccctgttccgtttccgtgtggccaggactccgcttgcttcctgctgttttctacttcggaccaaagtgtgacgtatcgttgctttctgtatatgtatgtaggaatgcatcatgtaacgagaatttggaatacaattgcgtgagtttttatccgatcacaatctattgagtagtggcaaaaaaaaaaaaaaaaaaaaaaaaaaaaaaaaaaaaaaccccagcc

SEQ ID NO: 713 - DNA, 470 bp, Zea mays
  UNSURE (1)..(470): unsure at all n locations
  Clone ID: PAT_MRT4577_115435C.1
  unsure (1)..(470): unsure at all n locations
gacatacacacaacaagcaaagcgaagcgcgcgcacagagatctagctgagctactagctatagcagcagctgctgcaggtctcctgacatggcgaagcaagacatcgaagcatcggggcccgaggccggcgagtctcggcaaggactacacgaacctccgccggcgccccgctcgacgcggatgaggtcaccaagtggtccctaccgcgggcatcgccgagttcatcgccacgctgctcctcctctaacatctaccgtgggcaccgggtcatcgggtacaagcaccagaggacggggcggcgtcgggcccgacgcgggcggggggcgtggncacccggcatcgcgtgggncttcggcggcatgatcttcatcctcgtcactgcaccgggcatctcaggtgggcatcaaacccggccgtgaccttcggcctgtcgggcggaggagggggcccctcgtccgcgccctgctc

SEQ ID NO: 714 - DNA, 304 bp, Zea mays
  Clone ID: PAT_MRT4577_11560C.1
cgcaacatcaccgtcaactaggcccagtcccgcggcggccgtggaggcggcgggggtgggtacggaggtggccgtggaggcggcggctacggcggtggcgggcgccgagatggctgtggcggatacggcggtggcggtggcatactgtggcggcggctgatacaggtggtggaggcagttgctacggcggtgtcaacctgtgttgcggttactgcaactcctacttgaactggagtaactgtacggaggggcctgctcagccaattttttactgttttttaccgtgatgtttaccctatttcat

SEQ ID NO: 715 - DNA, 321 bp, Zea mays
  Clone ID: PAT_MRT4577_115738C.1
cccccaaacaccatttttttccttaagattaacttaaaataaagcctgacgggggtaacaggatccattgatccgcaacccatgctgtttgatgcatgggtctgttgaagaccaggattaacacaggacttacaactggcacaaaggggcctttcaatcaaaaacacagatgggcaacaacaaacatgacacgtacgaagataaaccctttggacttggggaaacaacccgggagcgaacaggataacttgggcgagcgggccccaccggtcagttcctccagttcccatgggagttgccggagccgcccccacggttgcc

SEQ ID NO: 716 - DNA, 342 bp, Zea mays
  Clone ID: PAT_MRT4577_115781C.1
ataccgccataccacaagtcttcttcacaagtttaggagtgacagcaacaagagatctcgatgggctctggcaccgtgctcaagtcctacttccttaccaagaagtccgaatggggcgccaccaggcaggccgccgcgcttagaccgtccaccgtctccatggtcgtccgcgcctacgactacgccgatgagctctttaagaccgcgaaaacgatcgcgtcttcttggcggagcattctggcgatggacgagttttacgcgacgtgcgggaagcggctggcgtacatcgggctggagaacacggaagccaaccggcaagcgtaccgcacgctgctggtcacg

SEQ ID NO: 717 - DNA, 1795 bp, Zea mays
  Clone ID: PAT_MRT4577_115783C.1
cattgggtacctcgaggccggccgggaaggaaggagaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatccttttcgaggagacgctgtaccagtccgccgtcgacggccgcaagatcgtggacatcctggtggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggttggttggtttggtttctactcctgccattattattggctgcaacctgcatgccatgaccttcatgcatgcaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccgccggccatcacccgggataccgccgcccctccgagagatacgtgtgtactgatcgtggttaagcacgtactccgatccattcccatcacatgaagccatgataatgatgatatgatccatggaccatgcatggtgctctggtcgatgccgtacgtgtgtccctgatacaatactatttgtactgatgctagtcatcatatatatcgagctcgccactgcgaagtctgggagataatgcatgtatgcttgacggcgagatctgaggaaaaataatactatatatgtttcgaaaaaaaaaaaaaaaaaaaaaaaaagtcgacgcggccgcgattgcc

SEQ ID NO: 718 - DNA, 1749 bp, Zea mays
  Clone ID: PAT_MRT4577_115786C.1
cattgggtacctcgaggccggccgggaaggaaggagaagaagacgagtgtcaagtgaacctgaaatttgcggtgtcactggctggtatagcctgagtgtgagtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagcttggcaagtacacctccgacggcgaggccgccgaggccaaggagggaatgttcgtcaagaactacagctactaattaatcgcccggccatcaccgcccgggataccgccgcccctccgagagagatacgtgtgtactgatcatggttaagcacgtactccgatccattcccatcccatgaagccatgataatgatgatatgatccatggaccatgcatgcatggtgctctggtcgatgccgtacgtgtgtccctgatacaatactattagtactgatgctagtcatcatatatatcgagctcgccactgcgaagtctgggagataatgcatgtatgcttgacggcgagatctgaggaaaaataatactatatatgcatgttaaaaaaaaaaaaaaaaaaaaaaaaaaaaaaaaaaaaataaaaaaaaaaaaaaaaaaggcccctagggcc

SEQ ID NO: 719 - DNA, 1731 bp, Zea mays
  Clone ID: PAT_MRT4577_115789C.1
cattgggtacctcgaggccggccgggaagggaggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgagggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctataaaaaaaaaaaaaaaaaaaaaaaaaaaaaaaaaaaaaaaaaaaaaagaaaaaaaaaaaaaaaaaagcggcc

SEQ ID NO: 720 - DNA, 157 bp, Zea mays
  Clone ID: PAT_MRT4577_11578C.1
gctgcactcaggcttttgcagaggcttttggcattagatcccaacgataggccaactgctgcagaagcattagctgatccgtattttaaaggcatcgcagaagtagagagataaccatcatgccagcggataacaaaaatggaattcgagtttgagc

SEQ ID NO: 721 - DNA, 1805 bp, Zea mays
  Clone ID: PAT_MRT4577_115791C.1
cattgggtacctcgaggccggccgggaaggaaggagaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggtggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcaccgcccgggataccgccgcccctccgagagagatacgtgtgtactgatcatggttaagcacgtactccgatccattcccatcccatgaagccatgataatgatgatatgatccatggaccatgcatggatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctatatatgcatgtttcgagatggctctcccttaattaattattacataccgtgtgttactagcttagcttttgcctggctgccggctatatatatatacttgtttgccccaaaaaaaaaaaaaaaaacaaca

SEQ ID NO: 722 - DNA, 2498 bp, Zea mays
  Clone ID: PAT_MRT4577_115857C.1
cccgcccgtccgctgctgcctctgggccggcctgcgtgctctctgttaccgccacaaatggccttggtggtcttggactcgggctacctggggcccattacctccagtcggcactagtcattcgatgtatgtcatgtaacagcaattttttgaacacagatctgctataccctcacattgtttctgaccattcacaacagttcaggcttcttgatgtccctcagcgaccaagtggtcaatctgctcaacaaacagaagggatgagtggtctgcccctttatgatagccacaacgttgaggatgaaaatggctcacagaagtttgtctgcagattatgtgggctcaaatttgatcttctgccagatcttggccgccaccataaagtcgctcatatggtctcaggtgctgttggccacattccactgggccgtgggaagtaccagcttaaccgcggccgacactactattccgctttcaagaaaagtttgcgaccaacaagtacattaaagaagagcagtagctctggaatcgataaaaatttgaagtttcagatctctggcttaacatctcaaatagttgaatctgaaacatccagccttggtaagttacaggatttccaatgctcagatgttgcacaaactttattttccaagattcaaaagacaagaccccatccaagcaactttgatgttttatcggttgcccgctctgtatgctgtaagacgagtcttcttgctgcgttggaagttaaatacggacctttacctgagaacatatttgtgaaagctgcaaagctttgcagtgacaatggcgtccaaattgattggcatcaagagggattcatatgccctaaagggtgcaagtctagatataattcaaatgctctgcttcctatgcaactcacggcagttgattttcttgaagctcctgttgattcccgtaatgatgatgaaatgtggggaatggaagaataccattatgttcttgattcaaagcacttcggatggaagcctaaaaatgagagtgttgttctctgtgaagacataagctttggcagggagaaagttccaattgtctgtgtcattgatgtggatgcaaaagattctttaggtatgaagcctgaagaacttttgccacatggcagttctttgccttgggaaggatttcactatatcacaaaccgtgtgatggattcatctcttattgattcagagaactctatgcctgggtgtgcatgttctcatcctgaatgttctcctgagaactgtggtcacgtgagtctctttgatggtgtctacaatagcctggtggatatcaatggaacaccaatgcatggcagatttgcatatgatgaagatagtaaaattattttacaggaagggtatccaatatatgagtgcaattcatcatgtatttgtgactcgtcctgccagaataaagtattgcagaaagggctgcttgttaagttggaactctttagaagtgagaataagggttgggctattagggctgctgaacctattctacagggtacctttgtctgcgagtatattggtgaagttgtgaaggctgacaaggctatgaaaaatgcagaaagtgtgtcatcaaagggtgggtgcagttacttgtttagcattgcttcccagattgatagggaaagagttcggactgtaggggctattgaatactttattgatgccacaaggtctggaaatgtttcccgttatattagtcacagttgttccccgaatctcagtacccggttggttttggtagagagcaaagattgccagcttgctcacattggattgtttgctaatcaagatattgccgtaggagaagaactcgcctatgattaccgacaaaagcttgtagcaggcgatggctgcccatgccattgtggaactaccaattgccgaggccgtgtctattgattttgcaggaatacactaactgttcaatgctcggttgcagaactccagagatttcaacagttgtgtaggcttgctgagcgatttagcattgcaattttcctacagcttgagtgcagggctaggatctcattgttaatgctacaaatagtgattgtgatataggactcaggcaagcattaggcaataacatagtgtcgattttagtcatggtaccatcatgtttaactgattatttgttagaagcagcctgaaatgaaactgattcaggctgctctgttcgtaggcgagaattctctctgtaaaattccttcattcatattttatggttcatgagcaccatcattgacgtgaagtaataaactagttatcccagtggcctattgtgcggataatactccctctgttttttttagggagcgacaaattcgagaggtatttttagttgtactaattgcgtgatggatatcagcaatgaaaaaggttttttccaaaaaaaaaaaaaaaaaaaaaaaaaaaaaaaaaaaaaaaaaaaaaaaaaaactcgaggggggggcccgggtaccc

SEQ ID NO: 723 - DNA, 2210 bp, Zea mays
  UNSURE (1)..(2210): unsure at all n locations
  Clone ID: PAT_MRT4577_115917C.1
  unsure (1)..(2210): unsure at all n locations
ccggccgggccgggttcgtcccttttcgatcgccctgccggctgccgctcgcccttttctctgtttcccaattcccatacgcatggaaacatctcgtcgacccaaacccatccacccacaaggcggaatacacgatccagtccgatcctcgccccgcgagctgctccaaaccctggcgatgtcgacggcggcggccgcgaagactccgatcaagaccctgggctccgcggccgcgggtgtcataactccgaccaaatctcaggcccccgcggcggccaagacgccctgtacctctcgcgcgcggtcctcccacgcatccgagaattccaaccccaacatcccgggcacgccgcctcccccgcagtcgacgccgtccaagcccagcctcaagtccccggcgggcgcgggagccaggtccgccaccgcgaagaaaaagccctccacgcccgcgccccccgcgccaccgctggagcgggagcggcgattcctcgtggcgaagaagggcgcgcggcggaggcgcaacgtcgggaccatgggaggcggcggtggcggccgcgggggagagatcgacttcgataagtgccgcgaggccgctcgcgaggcgctgcgcgcgtcgcagggggagttcttccgcaaggaggtcgccgcatccacagccaccggagagggtcaattgggacaggaggaggaggggaagccgctggctgaagaggatgtgaaaggtggagcattcgaggagcggcaggaggaggagaccgacgcggagctggaggggagcagcaaggttagggcgatgaggacgaaggcgatggctaaggcgatgagcagcgttccgaatcctggctctggccgcgtcaagcatatggtgcaggccttcgagagcctgctcaacatctccggcgccacctccgatgctgaaagggccggtgagggctcatgggcgctgcccgggttgcagctatggaaggaggatgataagggtgatctggggttcccaccagtgtcggtgttctcttctgctgatttccagaatgcagggtctaatcgactctgctcgtcactaaatggaaacaccgtcaggtcgagctgggacagcagaacatcgactggcgagtgcagcaggagaaattcatctgagtcactaaggagcagaacatcggctggcgggcgcagaagcaggagaaaccagtcatctgagtcactaaggagcagctggaacaaaaagctcaaggtcaccagccagcatccattcaagttgaggacagagcaaaggggaaagtttaaggaacagcagttcgtccaaaaggtgcaagagatgcttgcagaggaagagaagaagcgtattcatattgcgcaaggattgccatggactaccgatgaacccgagtgcttgataaagcctgcagtcaaagaaagaactgagccgatagaccttgttttgcatagcgatgtgcgtgcgcttgaacgtgcagaatttgatcagcacgttttggataggaacaagttcgctgagcaacaaagactagaatgggagaggcaacaggaattagaggaagaagaaaggataaggcaactgaggaggaccgagctggttcctaaagctcaacccatgccatactttgaccgccccttcattcccaaaaggtcgactaaaccggctacagttcccatggaaccgaaattccacctcaggccagaaaagatatcctgttactgtcgacagcaatgtatggagcttggaaagctgaatccacaacagcagtgccaacatccactatggcaatcgagaagtacagagcatcaacacacatgatccaaaaaatgtttccattcctgctgtcttcgtcattcttgattcgtcgtcttccatatgtgaagaaattgctatcaggcgtgtttttcagctttgctcggatcgcctggcctctaatttctgttatgtacatgcatatgcaaatcgttggctctgtgcttcagatgcaatcccaccaaggttggaattttgctgcccaagaaactgatcaagaaattcaaagatgaatttcggtggtacattattgacttcagatgaatagtcgagtaatctgttgctgttgctgacttggttgtgtatgggcataagtgtagcaaactgaaactttgcacaattaaatctctgcactccaacatgttcactacatgtgctcaaaaaaaaattngaaaaagaaatt

SEQ ID NO: 724 - DNA, 2031 bp, Zea mays
  Clone ID: PAT_MRT4577_115921C.1
gccggccgggttccgaaggtaaaaatgacatgagttcccgttttgctcccgagttctctctcacgtccatccctctctctcgtctcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctccttcaagatcctgatccctacgcgcaggcgtaggagattgtattccgtctgattaatcggcggagagcaagcgggtgttgcggctgcgcgagcatggcgggcgaggaggctgcggagggcagcggaaccaggaggcacatggatctaaacctgtatctcggcctccctccattgccgcggcctccagtctggctggacccgacgttgatgcccaacttgaccggtgctgcgccagaatcctcaataactggtgagcctgaggaatcgttggccctgggggcggcagcctattctccgtcgaatgcactttccaccccggaggagcacccaatgcttgatcccatagtttattcctggctcgacggcaacaggaccgatggtgaagaggacactgatgctcctgagccggggccagtggatggtgccaatgtctctaggtcgcagcttgtggtagctgccacaggattggaaggggatgatgatcttcctctagtaaggtttgtgcgccctagccagatggttgttgctggtggaatggagacggtgaacacaagtatacttcagcagtccattcaaagggctgctgcaattgaggccaggactcctgaactccgctttcagagggtgatacagattagccagcagcatagaattgtgaggccagcatcagtgaaccgcagtcaaggggcagctagtacagatgcggataggcttgtctgggcaatccagcgcactcataactctttagaagcaacaaggcggcaaaaactagatgacaacaacttgtgtggaaacggttctgctaagaaggatgagtcctgtgactgcaactccagctttgagtgcaatatctgtcttgacccagctaaacagcctgtggttacaccctgcggtcacctcttctgttggccatgcttgtaccagtggcttcatgcacattcaccccactctgagtgccctgtatgcaagggtgaggtgctagaactgaatgtcactccgatatatggaagaggcggtgaagaagggaattccaccaaccctgacttcccacctaggccacgagcaaacagaagggagagcctgaggcaacagctgcaaatgacagacacaagaggaattgcaacagtggtgaggcagttgatacaaaaccagggtataattagcgttctcccaagcccaacagggatcgagatgtcggtggttcctgcaggccggcaaagggctagggctcggagacagcaaaggcaggataataatgcatcatcttccatacacgttgtagcgcagaatatgggcaatgttgcccctgagagcagcaaccaaatccagttgtcacattctaacggtgacaatgctgcacagatggttcttgcagctcctcagcagtcatcatctgtcgaacagctgtcaacttctagcaccacagctgttatattgggcgagcctgggtcaagtaggcggtcaaggccttcggagtctccaaccataagaagaacgaggaggaggccacagtaggtactcgagtgttgtcactcccttcagtaaaatctacagaccatgccccagtgatagttattaccatgattatctccaataacatctcaaggttaataatgtagaaatgtatatgccatcactggtttctgcctttctcttacattccatgtatcatctattatgcaaaacgagtcgaaatatcagttccagtatctatgataatcttgacctttgtatactgggaatat

SEQ ID NO: 725 - DNA, 2224 bp, Zea mays
  Clone ID: PAT_MRT4577_115927C.1
gggatgaaactttacttagaaaaatagtttctctcgttctttacttcgacaggagctggagcgcccgccctccagcccaggtccgcgccgccgccgcgccgaccacaatcccagcgcccgctgcccagacccagcgccgcctgcggttgtgagcgcgaacaggagagagcgggtcttcggggcgagcgccacgcgcagacggcggttgaggagcctgagaaaaccctggtcttccttcaagatcctggtggatcgcgcccagctccgcgaaatttccttgatgtctatgtaggttcgtcctaaagattcgattttgttggctcttttgatccgacgcagatccgtacggttctcgcctgattctgcaattcaggcgccaggaggcttgctggctgtttttggattggtgtcttctcccatggggtcttgcaggtgtaggagggtgaattctgtctgattaatcagcggagggcaagcggctactgtggctgcgcgaacatggcgggcgagcaggctccggagggcagcgggaccagtaggcgcatggatctaaacctgtatctcggactccctccattgccgaggcctccagtctggctaggcacagcgatgattgccccgacgttgatgcccaattcgactgcgccggaagccccaagaacaggcgagcctgacgaatcgctcgccccggcggcggcagcctattcgccttcgaatgcgctttccaccccggaggagcaaccaatgcttgatcccatagtttattcctggctcgatggcaacagtaccgatggtgaagagcacactgatgcttctgagccagggccagtcgatggtgtcaacgtccctaggtcgcagcttttggtagctgccactgggttggaaggggatgatattcctgtagtaaggtttctgcgccctagtcaggtggctgctggtggaatggagatggtgagcacaagtatacttcggcgatccaatcaaggggctgctgcaattgagtccgggacccctgagctccgctttcagagggtgatacagattagccagcagcacagcattgtgaggccagcatcagcgaaccacagtcaaggggcagctagtacagatgcggataggcttgtctgggcaatccagcgcacacataactcttatgaagcagcaaggcggcaaaagctagatggcgacaacaacttgtgtggaaacggtgctgctaagaaggatgagtcctgtgactgcaactccagctttgagtgcaatatctgtcttgacccagctaaacagcctgtggttacaccctgcggtcacctcttctgttggccatgcttgtaccagtggcttcatgcacattcaccccactctgagtgccctgtatgcaagggtgaggtgctagaactgaatgtcactccgatatatggaagaggcggtgaagaagggaattccaccaaccctgacttcccacctaggccacgagcaaacagaagggagagcctgaggcaacagctgcaaatgacagacacaagaggaattgcaacagtggtgaggcagttgatacaaaaccagggtataattagcgttctcccaagcccaacagggatcgagatgtctgtggttcctgcaggccggcaaagggctagggctcggagacagcaaaggcaggataataatgcatcatcttccatacacgttgtagcgcagaatatgggcaatgttgcccctgagagcagcaaccaaatccagttgtcacattctaacggtgacaatgctgcacagatggttcttgcagctcctcagcagtcatcatctgtcgaacagctgtcaacttctagcaccacagctgttatattgggcgagcctgggtcaagtaggcggtcaaggccttcggagtctccaaccataagaagaacgaggaggaggccacagtaggtactcgagtgttgtcactcccttcagtaaaatctacagaccatgccccagtgatagttattaccatgattatctccaataacatctcaaggttaataatgtagaaatgtatatgccatcactggtttctgcctttctcttacattccatgtatcatctattatgcaaaacgagtcgaaatatcagttccagtatctatgataatcttgacctttgtatactgggaatatattttctgatttagcctctgttaaaggtatgatatgccattataacttccccggtgtggacgttcctt

SEQ ID NO: 726 - DNA, 244 bp, Zea mays
  UNSURE (1)..(244): unsure at all n locations
  Clone ID: PAT_MRT4577_115969C.1
  unsure (1)..(244): unsure at all n locations
gcggtcctcgatccgatccgtcgagtgcacaccacctttcccactccgatcgaatcgatggccgccgagggcgagaagaagatgataaccctcaaaagctncgatggcgaggagttcgaggtggaagaggcggtggctttttgatcgcaggccatccgccacatgatctaagatgactgctcccacaagggatcccttttcctacgtcaactccaaaatccttatccacggtcatcgagtactg

SEQ ID NO: 727 - DNA, 370 bp, Zea mays
  Clone ID: PAT_MRT4577_115970C.1
cttcttttttttttttttttatttttatttggttttttttttttttttatttttttttttttttttgggaaaaaaagaaatttgggccattgaaataagggtccaagatacaaataataattttttggaaaacattgttaaagcacaaagggggacatgcttcctttggctttaaagggttgatgggaaactttccatgtttacttttcgaaaatccaggggggctgggtgttttgccaataaaaagggcccttggggaaccacaggggaattttcttattagcactcttaaagcgggcacttccataaaataaattcctgccaatggtgacaggaaaagcgccccgggtggggccgggcttaaaaacca

SEQ ID NO: 728 - DNA, 1525 bp, Zea mays
  Clone ID: PAT_MRT4577_115998C.1
ctcaaggaagggagagtgctccacagccttcttgctctcaccagtgatgtagtagatctcgttctgtccctccttcatcctggtcacatagtccttgaggctcgtcagctcatcaccactcttggtggagtggtacctcggaagctcagcaatcttggtcctgttctgggagtcctcgtggatgccaagcttgaggttcttggagaaggcctcgtagaacttgttgtagtcctccttgttctcagcaatctcaaagaagagctcaatgcacttcttgacaaggttcttcctgatgaccttgaggatcttgttctgttggagagtctcacgggagatgttcaggggaaggtcctctgaatcaacaatgcccttgacaaagctcaggtactcagggatcaactcctcacagttatccatgatgaagacacggcgcacgtacagcttgatgttgttggccttcttcttgttgtcgaagaggtcgaagggggccctcttgggcacaaacaggacagccttgaactcaagctgaccctcaacagagaagtgcttgacagccaaatgctcctcccagtcattggtcaagctcttgtagaaagcagcgtactcttccttgttgatctcctctggcttcctcatccagatcggcttctgcttgttgaccaagttccactcgtgagagacttccttgatcttctttttcttcttttccttctcttccttctcctcatcaacatcctcaaccttgccctcctcagtatccttcttctcctcctcatcttcatcgtcagaaatttccttctcagtggtcttctcggtccacagggagatggggtagctgataaactcagagtgcttcttaactagatccttgatgcggcgctcctcaaggtattccatctggtcgtccttgaggtagagcaccatcttggtacccctgccgagctgctccccagacgtatcacgagtgacggtgaaggagccaccggcctgagactcccacacgtactgctcgtcgtcgttgtgcttggtggtgacgacgaccctctcggcgacgaggtaggcggagtagaacccaacaccgaactgcccaatcatggacacgtcagcgccggcagcgagtgcctccatgaactccttggtccccgacctggcgatggtcccgaggttgttgacgaggtccgacttggtcatgccaatgccgctgtcgacgatcgtgagcgtgctggtcgccttgtcggggatgatgtggatgaagagctcgggctgcgcatcgagcttgctcttgtccgtgaggctctcgaacctgatcttgtccaaggcatcggaggagttggagatgagctcgcggaggaagatctccttgttggagtagaaggtgttgatgatgagcgagaggagctggttgatctcggcctggaaggcgaaggtctcggtctccgtcgccatggctgcgcgcgtccctgagctgctcgaggcggaggagaagcgtgcgggaggcggctagggttaggaggggtttgagagg

SEQ ID NO: 729 - DNA, 1112 bp, Zea mays
  Clone ID: PAT_MRT4577_116090C.1
aattcggcacgaggctcacctcctcctctccttttcttcctccctcagcctggcctcaactcccctcccatcccgtcccccgatctcatctcgccggcggcggcgatggcgggcaacgataattggatcaacagctacctcgacgccatcctagacgccggaaaggctgccatcggcggcgaccggccttccctcctcctccgcgagcgcggccatttctcccccgcgcgctacttcgtcgaggaggtcatcaccgggtacgacgagaccgacctctacaagacatggctacgcgcgaacgccatgcggagcccgcaggagaggaacacgcggctcgagaacatgacgtggaggatctggaaccttgcaaggaagaagaaggagttcgagaaagaagaagcttgtcgtatgtcaaaacgccagccagaaactgagaaaacacgagctgatgctactgcagatatgtctgaagatctctttgaaggagaaaaaggagaagatgctggtgatccatctgtcgcatacggggacagcaccacggggagctcacctaaaacaagttcaattgacaagctatacatagtattgatcagtctacatggtctggtccgtggtgagaatatggagcttggccgagattcagatacgggtggccagatcaaatatgtggttgaacttgctaaagcattaagttcatccccaggagtttaccgggttgacctgctaacaagacaaatcttagcaccaaattttgatcgtagttatggtgaacctaaagaattattggtttcaacaagtggtaaaaattataaacaagaaaagggagaaaatagtggtgcatatataattcggataccgtttggtccaaaagacaagtatctagctaaagaacatctatggcctttcattcaagaatttgttgatggtgcactcagccatattgtgaggatgtcaaaagccataggtgaagaaactggccgtgggcatccagtatggcctgctgtgattcatggacattatgccagtgcaggaattgctgctgcgttactttctggagcacttaatcttcctatggcgttcacaggacattttcttgggaaagataaattcga

SEQ ID NO: 730 - DNA, 1848 bp, Zea mays
  Clone ID: PAT_MRT4577_116175C.1
aactctctctctccacacacctggcaacctccctagacctggagcgcacgagagagagatagaagagagacggaccgacgaccgacggcgatctcgatcggtaggcagccgttgcttcttcttgcttggcgggcggggcggccaccatagccctctgtagctcagctcttgccggctttccttgtgctccttggaatctcgccctgcatatcttgtactacagtagctagctcctctgctactgtagagctacaggcaagagggaagcaggcagcgaccgagctctagctgttggctgtgcgactgcgagctagagagagagagagagggtgcgggcgacggacggaacggaacagaggagcctagtacttgttgtccgctgtctttcgtccgtgcgactggaccttattccctcacacctgcagctttgaggctcggccgtcacgtagtagtacgtgtacgtttcagggagggagccttctgacctcttgttcccttgccgccttttggtcacctcgggcaccgcgaggcgcagcacctgtgcttccttccgtcgtcttcctgcctcctcttctgttcaccgctctggcgctctcctatactcttctctctctctcgctgaggcaggcgggggcagcctttcctccccggtcgccatcctcgtttatatacacacaccctctcttgccgaaccactgctcgcttctctgcctgcttctgcttgagtcgtgccagtgacccgtgaccgtgaccgcgagcttcagggacgcgggcggcggcgatcatggcgtggcgcggcccgctcggagccggagaggaggccctggacagcggcctcgagctcagcctcggcctcccggcctacttcgcccggccttcaggtttggacgccgccagggaggagcccgccgaggcctctgcctacgctatccaggccgccagtgggagcaatgtctccaaggcaagggtcaggccagcgggcgcggcgccggtggtggggtggccgccggtgcggtcgttccggaggaacctggccgcctcctcctccaggccgtcgtcggggaaacacacccgccaggagggcagcgccaaggacggcctgttcgtgaagatcaacatggacggcgtgccgatcgggcgcaaggtggacctcacggcgtacggcggctacgccgacctctccgccgccgtcggcaagctcttccgcggcctgcttgccgctcagagggaccgagcggccacggcgggtggcgaggaggaggaggagggggagggccccgtgatcggcggcgactacacgctggtgtacgaggacgacgagggcgacagggtccttgccggcgacgtcccctgggagatgttcgtggccaccgccaagaggctgcgcgtgctcaagagctccgacgtgccggcctcgtcggtgacgctgggagctgggggcccggagaggtctgcagccgactgctgctgctgaaacgtgctctgcttcgtcagctgcttgtaaaaagtcccgagtggaggagacgaggagtggccctatccctggcctcttttttgtgtgttgctcttgctgcctttctgctagtggtactagtattgggtgccagtaaaaagtaggagaacaaagtcatgacggtattaaggatgtaatgtgcaagattagcagtggtagtagtcgtaaggtgtttaatgaatctacggtctctgttttggggcatattcgaccgtttaaagctgtatgcacgcgtcgaatttcggtgtggtttctgcatgccggccttaatgtttttcagcttttgtttgcacacgaacgctttagagcaagtttaataatagttggctctaact

SEQ ID NO: 731 - DNA, 660 bp, Zea mays
  Clone ID: PAT_MRT4577_116192C.1
atccacatattgttgcgaccaactagcatcctagaaagcacactcgagcaccaacaatggcagactgaatattctgactccttatgctccttggcctttctgcagtgctgctgcggcgaccatgttaccacaatgctcacaagctcctatagcttcccttcttcccccgcacctgtaccagcggagtcctaggtatgcgaaaacccaagtctccaaccgtataggatccaacaggcaatcggagcgtgggatctgacctgttatcaccctagatgctccaacagtcactcacacctataacaggagttacctttggagcatttattggcccacaacatcagggcccaacgactacaacaacttgtgctagcaaaccttgctgcctactttcagacacaacagatcctcacattcaaccatctagctgaatagaactctggttcttagttgcaacactcagcaagctaccattcagccagctatctgctgactacccacagaacctgcttccattcaaccagctgacaggtttgaactctcctgcttacttacagcagcaacaactactaccattcatgcagctcgctggcgtgagccctgctaccttcctgacacagccacaatcgttagacgttctaccagcacgctgcgcctaacgct

SEQ ID NO: 732 - DNA, 542 bp, Zea mays
  Clone ID: PAT_MRT4577_116302C.1
gggttctcgccatcttattgagaccacgtgcacatattgagcacaatagtgtaccaacaatggcagccaagatattctgcctccttatgctccttgggctttctgctcgtgctgctacggcgaccatcgtcccgctttgctcgcaagctcctatagcttcccttcttgccccgtacctctcaccagcggcgtcttgggcatgtgaaaacccagttcttcaaccctacaggctccaccaggcactcgcagctgtcatcttacctttatcacccttgttcctccagcactcatcacccctattacacctgtttcctttggtgcatttattgccacacatcatgacgccacagctgctacaacgacttgtgctagcgaaccttgctgcctactctcagcaactgcagttcctcttcttcaaccaactaggttcattgtactctgcttcttattcgctacaccctcatctacctttcagccagctacctgctgtctacccccagcagtttgtttcattctaccatctagcagcattgtactctcct

SEQ ID NO: 733 - DNA, 556 bp, Zea mays
  Clone ID: PAT_MRT4577_116335C.1
ggccgcttttttttttttttttttctttggttttttttttttttttttttttttttctttttttttttttttttttttttttttttttttattttttaaaaagggcctttcttatttcggggaagccacaaacatcttccaaaaaacaggattatggaactataacccataagcaatctaaaagggggcccccccaatgatgggttgttggaagaaccctcctgggttggtcaaagcaagttggttgaatgggagcaattgatgcagttgtaagagggggccaccgttaggcccagcgtgcgaggggaatgacaacaactgttgctgggtaaaaaaggcaccagggctcacattagctaactgggtgaatgggggtaactgctgttgttggaaataagcgggaaagttcaatgctgccagttggttgaatggaagtaattgctgggggtaggcagcaactagctggctgaaggggagttgttgttgcaaataagcagcagagttcaatgcagcccgttggttgaatggaagaaactgccgcccctgagagtaggca

SEQ ID NO: 734 - DNA, 235 bp, Zea mays
  Clone ID: PAT_MRT4577_116680C.1
tttatttttttttttttttatctcgaaaaggggcagttttggatttggtccaagctgcctcaagtatttccatgtacagctctcttactctcagctaagagacattatagtttttttagctcctatatatacacatggacactggcacgagcggggcaaccactgcacatatacattcattttagtcctagagtacctcctaacacccttgaccttggggcccggggcaccggtt

SEQ ID NO: 735 - DNA, 2667 bp, Zea mays
  Clone ID: PAT_MRT4577_116788C.1
gtttttgtttttttttttttttaagttctcaaagcaaatcaccgttacatataatagaaccaagaacagaagaacttggcgatgcgttccaattaccaaacatttttttagtcccacaggtgaatgttttctaccactgatgcgaagagaaactgaccacgcaaaacaacaacaaaattaactagaagacagcagagacaatagtagcactagcataccaacaacagattgcataatagcataagtggtaagacccacagaacagacccgatgttctcactctctttcctccataagaataaacccagcttagtctacctcctccatcttgctctcgccagcgtcatcctccagagggggcatgtcagtgtcagcctccggagcctcctcgtcctcgtcaatgctcaggcccagcttgagcatgcggtggatgcggctgccaaaggtgttgggatcgtcgaggctaaagccggatgtgagcagcgccgtctcgaacagcagcatgacaaggtccttaacagacttgtcgttcgggtcagcctcagcacgcttgcgaagctacaccatgatggcgttctcggggttgatctccatcgtcttcttggaggacatgtacccagacatgctggagtccctcagcgcctgggctttcatgatccgctccatgttggcggtccaaccgtactcgccggtcaccaggcagcagggggagtccaccacgcggtcggagaccaccaccttctccaccttgtcgcccagcacctccttgatgaccttgcagaggccctcaaacttctccttgagctcctccttgcgcttcttctcatcctcactctcgtccagcttcaggccctccttggtggcagagacgagcttcttgccctcaaactccttcagctgtccaatagaatactcgtcaatggcatccaccatgaacagcacctcatagcccttcttcttcagcttctcaaggaacggggagttctccacagccttcttgctctcgccagtgatgtagtagatgtcattctggccctccttcatcctggtcacatagtccttcaagctggtcagctcatctccgctcttggtggagtggtacctcaggagctcagcaatcttggtcctgttggtggagtcctcgtggatgccaagcttgaggttcttggagaaggcctcatagaacttgttgtagtcctccttgttctccgcaatctcaaagaacagctcaacgcacttcttgacaagattcttgcggatgaccttgaggatcttgttctgctggagagtctcacgggagatgttgaggggaagatcctcagagtcaacaatgcccttgacaaagctcagccactctgggatcagctcctcacagttgtccatgatgaagacacgtcgcacatagagcttgatgttgttctgcttcttcctggtgtcaaagaggtcgaagggggcccgctttggcacaaagagtacagccttgaactcaagctggccctcaacagagaagtgcttcacggcaagatgctcctcccagtcgttggtcaagctcttgtagaaagcagcatactcttctttggtaatctcctcaggcttcctcatccagattggcttctgcttgtttaccaattgccactcatgagaaacctccttgatcttcttcttcttcttttccttttcttccttttcatcatcaacatcctcaaccttaccctcctcatccttcttatcctcctcatcttcatcatcagagatctccttctcagtggtcttctcaatccagagagagattgggtagctgatgaactcggagtgcttcttgatcagatccttgaggcggcgctcctcaaggtactccaactgatcatccttgaggtagagggtcatctttgtacccctgccaagttgctccccagaggtatcacgtgcgacagtgaaggagccaccagcctgagactcccacacgtactgctcatcatcattgtgcttagtggtgacgacaaccctctctgcaacaaggtaggcagagtagaaaccgacaccaaactggccaatcatggacacatcagcaccagcagcaagtgcctccatgaattccttcgtgcctgaccgcgcaatggtaccaaggttgttcacaaggtctgacttggtcataccaatgccgctgtcgatgattgtcagcgtgttgttggccttgtcggggacaatgtggatgaacagctctggctgtgcatccagcttggtcttgtccgtcaaactctcaaacctgatcttgtccaaggcatcggaggagttggagatgagctccctgaggaagatctccttgttggagtagaaggtgttgatgatgagcgagagcagctggttgatctccgcctggaaggcgaacgtctccgtctccgaggccatggcgaaacgaccttcccgaacgcgaggagagcgcgagcggtaggcggcggctagaggggactgagaaagtggcacgagacgagggtttgtggggcgaagatgcgttgcggcgcggtgaggattttatcgttgggggaggaggcgaggggttctcgaatgttctacgagccactgggggccggggagcgcggttgactgacctgccgaccgatgggcccggagttacgccggctccagcgctccgcccccacgcgtccg

SEQ ID NO: 736 - DNA, 347 bp, Zea mays
  Clone ID: PAT_MRT4577_116827C.1
ccgacgcgtccggttaagctcgtgctcctatcgctcttcaccgtctgcatcaccttcgcatttcagctgagctgcctgaccgctaacgggccagtgatactgccagcggaggcgatcacgattgtggtggtgctggggctcaccttctacaccttctggtgctgccaataagggctacgagttcgaattcctggggccgttcctggtgtctgtctgcctcatccacatgctcttctagcaccagcgtatcatctgcgtgctgggcaagacccggaccatggtgtaacgctgcatcgctcagctcgtcttctccggtttcatgatctatcatcaccgacaaccgcatc

SEQ ID NO: 737 - DNA, 414 bp, Zea mays
  Clone ID: PAT_MRT4577_116932C.1
tcgttttcgtaagcgttcaaaccgaccaatgtgggcaactgtacacagagcgcgggccattgccggggaagaagcaacatgctgcgagccttctttatggcgagctccgaccatggatccaccaccggccccaaggacgtgccgggtagctactgcctgccgttggagggcgccgtgcgcgaccgcctcgacttctactacttccaggggcacgacaagtactgggagtcccccgtggagcgctacgggtccaccgtagtgcgcatgaacctgccgccaggccccttcatggtgcgcgaccagggggaggttgctgtcctggacgcccagagctttcccgtgctatgcgacatggacaaggctgacaagaaggacctgatcgccgtcacctacatgccgtccaccttccttacc

SEQ ID NO: 738 - DNA, 3401 bp, Zea mays
  Clone ID: PAT_MRT4577_116976C.1
gccggccgggtcgggatttctcagcgaagcagccacgcccacgcacacgcagtctggaagcgtttacatgacacgtccacccatcctgacctatcgccaagccaagagctacagttcccaagcgccgaggaaaagccggcccgaattccatcgtttcatcgaccgcccgctgcaatgaaccgcgcttcttggttgctccttgttctggtgcagctctcttgcttgcactgctactcagccacccgccatggccgctgccgttagcacggacgtccttggacctgccccccaggcagccgctgcgccggctccgttctcttcttgggaccaggctgccctgtgagtacctcaatcgtggttgtcaaggtgaacctgctcctgcgcgcaagtcgcaacggtggtggctgcagctgcggcgtgctccttcgctggaaagtggggcagtatcttttcgcatctcctcgactccgcctctctcggatctcgccgaaggacgagcaaaggcccctgatcgcccgcttctactacaactatattctgtcgccagcgcacaagcggcgggggcacggggtagattcggagcggctcttggcttgcagtccagacgcccttcacccctgatctggaccggagggagcggctccttccgtcagttgttcttgctttgcctgggcctcttccgcctgcttcgtgttcttcacaggagccggtgacctcggacgatatcttggaggacaagatgtcgggggctgttcttgtcgccatagtcgcctccatcggcaatctattgcaggggtgggacaatgccaccatcgcagctgctgttctgtatataaagaaggaatttcaattgcaaaatgagcccactgtggagggactaattgtgtcaatgtcacttatcggcgccaccattgttactacattctccgggccattatcagactcgattggccgacgccctatgcttattctctcttcaattctgtacttcttcagcggcctcatcatgctatggtctcctaatgtctatgtcctgctgttggcacgcttcgtagatggatttggtattggcttggctgtcacgcttgtgcctttgtacatttcagaaatagccccttcggagattagaggtttgctgaatacactaccacaattcagtggatcaggaggaatgttcttgtcatactgcatggtgtttgggatgtccctgtcgccatcacccgattggagaattatgcttggtgtgctcgcgataccttcattgttcttctttggtttgacaatattttatcttcctgaatctccaagatggctcgttagcaaaggtcggatggcagaggcaaaaaaggtgttgcaaaagttacgggggaaagacgatgtctcaggtgaattgtcccttcttctcgaagggttggaggttggaggagacacttccattgaagagtacatcattggacctgccaccgaggcagccgatgatcttgttactgacggtgataaggaacaaatcacactttatgggcctgaagaaggccagtcatggattgctcgaccttctaagggacccagcatgcttggaagtgtgctttctcttgcatctcgtcatgggagcatggtgaaccagagtgtaccccttatggatccgattgtgacactttttggtagtgtccatgagaatatgcctcaagctggaggaagtatgaggagcacattgtttccaaactttggaagtatgttcagtgtcacagatcagcatgccaaaaatgagcagtgggatgaagagaatcttcatagggatgacgaggagtatgcatctgatggtgcaggaggtgactatgaggacaatctccatagtccattgctgtccaggcaggcaacaggtgcggaagggaaggacattgtgcaccatggtcaccgtggaagtgctttgagcatgagaaggcaaagcctcttaggggagggtggagatggtgtgagcagcactgatatcggtgggggatggcagcttgcttggaaatggtcagagaaggaaggtgagaatggtagaaaggaaggtggtttcaaaagagtctacttgcaccaagagggagttcctggctcaagaaggggctcaattgtttcacttcccggtggtggcgatgttcttgagggtagtgagtttgtacatgctgctgctttagtaagtcagtcagcacttttctcaaagggtcttgctgaaccacgcatgtcagatgctgccatggttcacccatctgaggtagctgccaaaggttcacgttggaaagatttgtttgaacctggagtgaggcgtgccctgttagtcggtgttggaattcagatccttcaacagtttgctggaataaacggtgttctgtactataccccacaaattcttgagcaagctggtgtggcagttattctttccaaatttggtctcagctcggcatcagcatccatcttgatcagttctctcactaccttactaatgcttccttgcattggctttgccatgctgcttatggatctttccggaagaaggtttttgctgctaggcacaattccaatcttgatagcatctctagttatcctggttgtgtccaatctaattgatttgggtacactagcccatgctttgctctccaccgtcagtgttatcgtctacttctgctgcttcgttatgggatttggtcccatccccaacattttatgtgcagagatctttccaaccagggttcgtggcctctgtattgccatttgtgcctttacattctggatcggagatatcatcgtcacctacgggagccttcctgtgatgctgaatgctattggactggcgggtgttttcagcatatatgcagtcgtatgcttgatttcctttgtgttcgtcttccttaaggtccctgagacaaaggggatgccccttgaggttattaccgaattctttgcagttggtgcgaagcaagcggctgcaaaagcctaatttctttggtacctttgcgtgcaactattgcactgtaagttagaaacttgaaggggtttcaccaagaagctcggagaattactttggatttgtgtaaatgttaagggaacgaacatctgctcatgctcctcaaacggtaaaaaagagtccctcaatggcaaataggagtcgttaagttgtcaatgtcatttaccatatgttttacctatttgtactgtattataagtcaagctattcaacgctggttgttgctagaaatctttagaacaaagatgataatgatctgatctgatgttataatattcaaatctcaaataaagaaaatatcgtttctcatgttgtctttgcaagcttttgcactgttcaatatgaaaaaaaaaaaaaaaaaaaaaagctagggcggccgccgactgataagctc

SEQ ID NO: 739 - DNA, 445 bp, Zea mays
  Clone ID: PAT_MRT4577_11701C.1
ctttctacaggtgggttggcttctcctccccctccgattcgccatcgtgttcgtgaggatctcccgtgttctgctccgtcggtgatgcggatcgagatgcccgctgccggatgttgagtaccgctgctccgccggcgggctcgcctgggccacggacgaccactccctccacaacgccttcagcacctacggctaggccctcgagaccaagatcatcctcgatcggtagacgcacaggacccacctcttcggattcgtcaccttctccacggaggaggcgatgcggaacgccatcgagggcatgaacggtaaggaagctggacggccagaacattaccgacaacgaggcccatccccgccgcggtcgtggaggcggcggcggtggatactgatgtggacgtccaggccgcccataccgcaccggctggcgcctggatggcggcgg

SEQ ID NO: 740 - DNA, 298 bp, Zea mays
  Clone ID: PAT_MRT4577_117083C.1
ccgtgtacgccaccaccgccgaccccaagaatggctcgctcggcaccatcgggcccatcgccatctgcttcatcgtcggcgccaaggtcctctccgcggggcgcttcagccgcggctccatgaaccccggcacgtgccttctgccccggcgtcgccgcaggcgatgtcggcggaaactggggctactggatcgtcccgctcgtcttcggcagcctcgctggcctcgtctacgtggacgtcttcattggctgctcgtagcagcaggtctcggaccatgactacgcctagtttattcagc

SEQ ID NO: 741 - DNA, 300 bp, Zea mays
  Clone ID: PAT_MRT4577_117102C.1
atcggcctcagacggacatatatactatactatactctaggaagcaaggacaccaccgacatggcagacaagatgcttgcattgttcgctcttcaagctctttgtgcaagcgccactagtgcgacccatattccagggcacttgccgccagtaatgccatagggtaccatgaacccatgcatgcagtactgcatgatgcaacaggggcttgccaacttgatggcgtgtaccttactgatgctgcaaagactggtgagcttaccgctaagtccaagccagtgatgatgccccagatgatga

SEQ ID NO: 742 - DNA, 1624 bp, Zea mays
  Clone ID: PAT_MRT4577_117128C.1
cccctatcttggcttttctttggtcgtcgctactagcgggatacgagcgccaccttatcggttcccctctctggccctcccggcctcactcaccagcatcggctcttcagtcttcaccatggccgccgcccacctcctcgccgctttgtcctcctccaccgccttgcgccctcctctccgcctccgttctccacagcatccaccacatatccgcttcaactgtactgggaggcggccgttcccggtggtacgcgcggctgagaccgacgccaaaaacgcgaaggcgaacgccaaggccccgaataaggcacccgcggcggatggctccagtttcaaccagctgctcggtatcaagggtgctaagcaagagagcgacatatggaagatccgtcttcaacttactaagccggtgacatggcctccgcttgtttggggagttctctgtggagcagctgcctctggaaatttccactggacagttgaagatgtcgcaaaatctattgtatgcatgataatgtctggtccatgccttacaggatacacacagacacttaatgactggtatgatcgagacattgatgcaattaatgagccttatcggcctattccatcaggtgctatatcagaaaacgaggtaataacccagatctgggtgctattgctaggagggcttggattgggtgctttgttagatgtgtgggcaggacatgattttcctattgtgttttatcttgctgtgggtggctccttactttcttacatatattcagcaccacctctcaagctcaagcagaatggatggattgggaacttcgctctgggtgcgagttacatcagcttgccctggtgggctggccaggcgttatttggaactcttacaccagatatcattgtcttgactactttgtacagcatagctgggctagggattgctattgtaaatgatttcaagagtattgaaggggataggactctggggcttcagtcacttcctgttgcttttgggatggaaactgcaaaatggatttgtgttggagcaattgatatcactcaattatctgttgcaggttacctattgagcaccggtaagctgtattatgccctggtgttgcttgggctaacaattcctcaggtgttctttcagttccagtacttcctgaaggaccctgtgaagtatgatgtcaaatatcaggcaagcgcacaaccattcttcgtactgggcctactggtgacagcactggcaaccagccattaatgaaggcaaacttaaacagaacgagcaaccgttctgataccgaagaggcacgtctggtgaccattaataagctagctgcttgtgtgcagggtaggaagagaacgtctttttacttgtagaacacagatcgattttgtaagggttatgtggtgggaggaaaagttagcaatagcactggatgttgttgtagtaggatctgtagttgcacggtaagatcgttacttcgccattgttagcggttgaactggcaatgctttgaacaaacagttttgtgtatcggccgtattgttgtatgatcaaccctggaagattgtacaacctccgttctgagtatttgcacctcgttctcgagtatttgtaaaaaaaaaa

SEQ ID NO: 743 - DNA, 991 bp, Zea mays
  Clone ID: PAT_MRT4577_117130C.1
gtatatgtcatccctgactccctggatactgatgaaaatgattctcttcaggtaataacccagatctgggtgctattgctaggagggcttggattgggtgctttgttagatgtgtgggcaggacatgattttcctattgtgttttatcttgctgtgggtggctccttactttcttacatatattcagcaccacctctcaagctcaagcagaatggatggattgggaacttcgctctgggtgcgagttacatcagcttgccctggtgggctggccaggcgttatttggaactcttacaccagatatcattgtcttgactactttgtacagcatagctgggctagggattgctattgtaaatgatttcaagagtattgaaggggataggactctggggcttcagtcacttcctgttgcttttgggatggaaactgcaaaatggatttgtgttggagcaattgatatcactcaattatctgttgcaggttacctattgagcaccggtaagctgtattatgccctggtgttgcttgggctaacaattcctcaggtgttctttcagttccagtacttcctgaaggaccctgtgaagtatgatgtcaaatatcagcactggcaaccagccattaatgaaggcaaacttaaacagaacgagcaaccgttctgataccgaagaggcacgtctggtgaccattaataagctagctgcttgtgtgcagggtaggaagagaacgtctttttacttgtagaacacagatcgattttgtaagggttatgtggtgggaggaaaagttagcaatagcactggatgttgttgtagtaggatctgtagttgcacggtaagatcgttacttcgccattgttagcggttgaactggcaatgctttgaacaaacagttttgtgtatcgcccgtattgttgtatgaccacccctggaagattgtacacccaaaaaaaaaaaaaaaaaaaaaaaaaaaaaaaacccacaaacc

SEQ ID NO: 744 - DNA, 412 bp, Zea mays
  Clone ID: PAT_MRT4577_117161C.1
ttgagcacagcacagatcatatctgctaggggagcctgtgagatggggctcgcttctgctcactcggatgagtggccacgacctggcctccaagtgggtctgaccaacgatgcagctgcctactgcactggccttctgttgggtcgccgtgtgctcaagacccgcggtttagataaggaatatgagggcaatgttgaggccactggtgaggacttctgtgttgagccagctgatgagaggaggcctttccgtgctctcttggatgttggtcttatgtaggactacaactgggaaccgagtctatggtgccctcaagggagctcatggacggtggcctgcatatacctgacacagagaagaggcatgctggcttcaagcatgatgacaagcaggtggatgctgatatccatcg

SEQ ID NO: 745 - DNA, 377 bp, Zea mays
  Clone ID: PAT_MRT4577_117310C.1
gggtacaacagctgccttttttagggggcctaaaagaaaacagggttctgactggttgctcacaatccgaaaaaggttcagtctttgggtttaaataacagcattgccatttagttcgggggaataggtcccccaaacaaatgataatttactttaaaacaataaacaccccgtttaaaaaaatgcagaattcaaaatttacgctggtggccagcactacaagcaagggaaaaaggctccatgattgtttgaaggagccccgggccccaaaaagcttaaaaacaagggcattacttgggtgcaaatccatccttttttacaaaaaaaaattcccatttggccccctcaggtttttacacgggggggcaaatttttgg

SEQ ID NO: 746 - DNA, 407 bp, Zea mays
  Clone ID: PAT_MRT4577_117382C.1
gggtccagccacgcgtccgcaaaaacgtccgcccacgcgtctggcaccccgagctgtatagacgagctagtcggtagaacttgcacgagcggcgcagaacgaagtgcagataacaggacatatggctacgcctgcggtgaacgtttactgctgggctatctcaccgttcgtatcgcgggctctgctggccctggctgacgccggcgtcgactacgatctcgtccacatgaaccgccatgacggcgaccaccgccgcccggagcacctcgccagaaaccctttccggaacgtgccggtgctcgaagatggagacttcacgctcttcgaatcacgtgctatcgcgaagcatgttctccggaaacacaagccggcactgctgggcggcagcaagctggagcagacagtga

SEQ ID NO: 747 - DNA, 2474 bp, Zea mays
  UNSURE (1)..(2474): unsure at all n locations
  Clone ID: PAT_MRT4577_117391C.1
  unsure (1)..(2474): unsure at all n locations
cgggccgccttcccgccggtgcctgagagtaaagcgaagtgcgcccgggcccccacaggaggtacacctaatctgtcacctcccccgccgcacctccgtagcctcttgaatctcgccggccacctcacgtcctcacctcgcgtggcctcccgttctgacttcggagtccctcggtctcaacgactagttgagagctcgcggctccgttcgggcgaggggaggaggttcatgaggctgctgtaggctccgttgcagccgccgcgggcgggagtccgtgattttggacgccccaccgcggcaagatccggaagcgcgttggctgttgtgccgtgagtttcagtttcggtggtcgattgcttcagcctgctgagaagtaggaggggcggccatggcggggtcgaggttcgggtcgttcaagtcggagaagggcgactccgcctccgcagcggcggcagcgggtggagcggcgcagaggagggacccgtacgaggtgctcggggtgggccgcaccgccaccgaccaggagatcaagagtgcgttccgacgcatggcgctcaagtaccatccggacaagaatggcgatgaccctgttgcatcagacaggttccaggaagtcacattctcctataacatcctgtcagatcccgataagaggcggcagtacgatacatcaggatttgatgcaatcgaatctgatagtcaggaactggagctggacttgtcgagtctcaacactgtaaacacggtgtttgcagctctttttagtaagcttggtgtgccaattaaaacaactgtttcagctacagttttagaggaggcattgaatggttcggttatggtttctcaactccagctaggaaactcagtgcagagaaaggtggaaaagcaatcggcccatttctattctgtggatataactgaaaaacaagctaaaatggggctagtttgtcgtgttcactcaaacgataaaagcaaattcaagttgctatattttgagcttgaagaaaatggcgggcttagtcttgcactacaggaagacagtgtgaaggttgggaaagttactgctgcagggatgtatttccttggttttcctgtgtaccgttttgaacaaaataacctggcagctgctgcaaaagattctgatggtgcattctttaaaagattggatagctttcagccatgtgacatacatgaactgaaacctggaacacacttctttgctgtctacggtgacaacttcttcaagagcgctagttatactatagaggttgtatgtggtgaatcttttcctgccgaaaaggagatgctacgaaatgtggaggccaagatactcacaaaacgagctgaactttccaaatttgagtcagagtatagggaggttttggcgaagttcactgaaatgaccagcaaatacacacaagaaatgcaagcgattgatggccttctgaaggaaaggaatgagatccatgcttcctataccaacaatccacctctaaaacggagttccagcaggaataaagccaagtcgccttcgaaagtggccaaaactggtacagaaaaacatcatcagaaggaaaagaaggtgaaggatcactgcatggagggatgtggaagtgacagcgataactcaagtgaaaagaaatcaaaagagcggttcccaaggaagaaatggctgaaccttccattcaaacttgacaggagaaagacgtgctgagcaatgtattatatgttccgttgctattctatcctgttatgcataatcctgagctgaactcacatttcttctctttctcatgcttttataggaagtccctctcggcccaacactagattgatatacagagaatttccactgtggcctcccgaaccaagccctctcccactgctaccaccttccttcgttgtacccggattatttcgtgtaaagatcacatgtgatcctaagaattaaaacgtgagtcgttttagcatatattgtgaagcacgtgctggcaagtttccgttcttggcattgggtcaaattgaggtgccctgcttccgattccctgctgcaccgtgcctatgtagcatgtaaagttgtatatgctgcgaatcgtagtacagctatatatttgtgtgtcctaaatcttgagtgtctttttactgccttctgtaaatgctccccaactgatgtaaatacaaaattccatgttcctcgccctaggatccgtgtgccaaattaaaaaaatttaaaaaaaaaaaaaaaaaataaaaaaaaaaaaaaaaaaaaaaaaaaaaaaaaaaaaaaaaaaaaanngggccgtgtggaaaaaatgggaaaagtttttcctgaaaaaaaaaaaaaaaaaagggccccttggtccgcaccttttttctctttttagtagggttaaatgccccctttgggcccccgtgggaaaaatttgggcatggttttcccccaaaaaaaaaaaaaaaacggcccccccgacccc

SEQ ID NO: 748 - DNA, 292 bp, Zea mays
  Clone ID: PAT_MRT4577_117490C.1
ggtacaggtctagaattcccgggccgacccacgcgtccacccacgcgtccgagtcagcaccgccttctgtgctgagattgttgagtccgcagatgcctacctctttgcaggccccattttcaatgactacagctctgttggctactcattcctcctcaagaaggaaaaggccatcatcgtccagcctgagcgtgtgatagtggggaatgggccggcattcggatgtgtgatgatgaaagagttcttgtctgaattggctaagaaggttaataagaacaccactgcctatgag

SEQ ID NO: 749 - DNA, 305 bp, Zea mays
  Clone ID: PAT_MRT4577_117564C.1
gcaaacgagaaccggggtcatttttttctcggctcgtttcatatcgggagcaaacaaagggaacaacaggggtaccaacacctaatccaaaggtagaacggacactaacacggtgacagaagccaacggttacaccattcttttgatagataagataaccttggccgaaaccagggaggggccaacaaataaattccttcaaaccgccgccgctcccctccgtatccgccacaaccacctttgggccgaccgccgtaaaccccaccggcttcatagtcggcggcaccaccctcgcgccgaccgcc

SEQ ID NO: 750 - DNA, 1912 bp, Zea mays
  Clone ID: PAT_MRT4577_117709C.1
ggaatcgcctattcccagtctgcatcgaacctgcatgattcctggtccatacgcatatgcgcatcagatgccaacaggcacacacagcatcacgtcctaaaagcgcgatgcgtgtgcttgcggccgtagatcacatacacacacacatggtaaaagaaacacacacgtccaatgcagccaattcatattattccgagacattaaaccaaacaaacagctttgcaaagccaccgtaacagaataccagtcaaatataggtcattctaaacaacaacgctgcaacaagggcaggtctttttttccctggaagaagcagcaggcttggagcacgaaaaccagcatccagccatcatttatcaacttgagaatcgaaacatagcatgcgggcataacatctagagtgtgtgcttaattaaaaacagcggcaaaggcaatggcaatggcaggcagcttcagcgcacgcgcaccggcgccgtgacgaagagaacaacacgaggtgtactagaagataagctatcagaaatcaagaacggcacagtcctggtaaactccccgacatcagcagacacgcatcaggtcgggagatcggatccgtcttactggccctcgggggcggattctttgggggcagcagctgcttccttgatctcatccccgccgtcctcgttggtgtcggaagtccataaggtcaagttgtcacgcaggagctgcatgatcagagtgctgtccttgtaggactcctctcccaggctgtctagctcggagattgcctcatcaaaggcctgctttgcaaggttgcaagcacggtcaggggagttgaggatctcgtagtagaacactgagaagttgagagcaagcccgagcctgatggggtgggttggagccagatcagcaagagcaatatcctacaaaccaaaagccaacaagaaagaaccacaattaacaatatatgcactgtcatcctatcagtatgaacacaatggtcaaacctgagcagctttgtaggcattcatggtgctctccgcagcatccttcctctctgcacctgacttgaactcagcaaggtacctgtggtagtcacccttcatcttgaggtagaagaccttggactcggcgccgccggcggatgggacgaggtgggagtcgaggagcgcgaggatgccgtcgcagatgcgggcaagctcggcctcgatcttggagcggtaggcgcggatggatgcggcgtgcgcctcgttcccgcggccttcctccttctgctcgatggaggagatgatccgccacgaggccctgcgggcgccgatgacgttcttgtaggcgacggacagcaggttgcgctcctccaccgagagctcgtccccgccgccggcgccgccggcggagcgcgcgacgcgctccatgaactcgaccatctcctcgtaccgctccgcctgctctgccagcttggccatgtacacgctctcctcccgcgtcggctccgacggcgacatagctgcgagcggcggtagggtgtggtgggacgggacgggtcggcggatcggggtcgccggcagcacggacggtcgcacggttgtgggtggcgcagaggatcctgtggagcggaagcgacgagtttcgctaggcatcatgatcatgcatcatggactcggcctactactgtggatttgtatgccattatagacttggtgctgtgaaagactgcttgatgatttgcgggtttgttgctgtgtaaaaaaaggtcccatggctcccagaagaccatgaaggttcggatctatcatgtaattccttgttatctgccaattatgtatggactatggacatgtgttgcgctgttcaacttactactacaaataagtaatcgataatgttcccttcacaaaaaaaaaaaaaaaaaagcccctagggccctcga

SEQ ID NO: 751 - DNA, 1407 bp, Zea mays
  Clone ID: PAT_MRT4577_117710C.1
cattgggtacctcgaggccggccgggctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccggggggcgccggcggcggggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagctcgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggctccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacggcggggatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgctggcgtgccggtgcgcgtgcgctgaagctgcctgccattgccattgcctttgccgctgtttttaattaagcacacactctagatgttatgcccgcatgctatgtttcgattctcaagttgataaatgatggctggatgctggttttcgtgctccaagcctgctgcttcttccagggaaaaaaagacctgcccttgttgcagcgttgttgtttagaatgacctatatttgactggtattctgttacggtggctttgcaaagctgtttgtttggtttaatgtctcggaataatatgaattggctgcattggaaaaaaaaaagtcgacgcgg

SEQ ID NO: 752 - DNA, 2754 bp, Zea mays
  Clone ID: PAT_MRT4577_117732C.1
gaaggtgacctcgagacggccggaatcgcgcgcacgaggccttccccacctacgtggtcatcctcactcccctcggcatcccgcagttgctcgtccccggacccgccgcactactgctataggcgcatccccggcgccttcgcacactctctccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaggactcccatttcgcttcggcggtcgagctccatgtcaacaagctgctccaggccaggcctatcaatctcaagcctcggcggaggccggcatgcgtgtcggcgtcgctgtcgtcggagcgcgaggcggagtactactcgcagaggccgcccacgccgctgctggacaccatcaactaccccgtccacatgaagaacctgtctgtgaaggagctgcggcagctggccgacgagctccggtccgacgtcatcttccacgtctccaagaccggcggccacctcgggtccagcctcggcgtggtggagctcaccgtcgcgctgcactacgtcttcaacgcgccgcaggaccgcatcctctgggacgtcggccaccagtcgtacccgcacaagatcctgacggggcggcgcgacaagatgccgacgatgcggcagaccaacggcctggcgggcttcaccaagcgcgccgagagcgagtacgacagcttcggcacgggccacagctccaccaccatctccgcggcgctcgggatggcggtgggccgggacctcaagggcggcaagaacaacgtggtcgcggtgatcggcgacggcgccatgacggccgggcaggcgtacgaggccatgaacaacgccgggtacctggactccgacatgatcgtcatcctcaacgacaacaagcaggtgtccttgcccacggcgacgctcgacgggccggtgccgcccgtgggcgcgctcagcagcgccctcagcaagctgcagtcaagcaggccgctcagggagctcagggaggtggccaagggagtgacgaagcagatcggtggctcagtgcacgagctggcggcgaaggtggacgagtacgcccgcggcatgatcagcgggcccggctcctcgctcttcgaggagctcggtctctactacatcggccccgtcgacggccacaacatcgacgacctcatcaccatcctcaacgacgtcaagagcaccaagaccaccggccccgtcctcatccacgtcgtcaccgagaagggccgcggctacccctacgccgagcgagccgccgacaagtaccacggtgtcgccaagtttgatccggcgaccgggaagcagttcaagtcccccgccaagacgctgtcctacaccaactacttcgccgaggcgctcatcgccgaggcggagcaggacagcaagatcgtggccatccacgcggccatgggcggcggcacggggctcaactacttcctccgccgcttcccgagccggtgcttcgacgtcgggatcgcggagcagcacgccgtcacgttcgcggccggcctggcctgcgagggcctcaagcccttctgcgccatctactcgtctttcctgcagcgcggctacgaccaggtcgtgcacgacgtcgatctgcagaagctaccggtgcggttcgccatggacagggccgggctggtcggcgcggacgggccgacccactgcggtgcgttcgacgtcgcgtacatggcctgcctgcccaacatggtcgtcatggccccgtccgacgaggccgagctctgccacatggtcgccaccgccgcggccatcgacgaccgcccgtcctgcttccgctacccgagaggcaacggcgttggcgtcccgttgccgcccaactacaaaggcactcccctcgaggtcggcaaaggcaggatcctgcttgagggcgaccgggtggcgctgctggggtacgggtcggcagtgcagtactgcctgactgccgcgtccctggtgcagcgccacggcctcaaggtcaccgtcgccgacgcgaggttctgcaagccgctggaccacgccctgatcaggagcctggccaagtcccacgaggtgctcatcaccgtggaggaaggctccatcggcgggttcggctcgcacgtcgcccagttcatggccctggacggccttctcgacggcaaactcaagtggcgaccgctggtgcttcctgacaggtacatcgaccatggatcgccggccgatcagctggccgaggctgggctgacgccgtcacacatcgccgcgtcggtgttcaacatcctggggcagaacagggaggctcttgccatcatggcagtgccaaacgcgtagaacttgtgctgatctgggcctatagagatgattgtacattttgtcgttaactagagtgtctgaacttgggagattagtcttctttggatgaaagtgtcgccggaacaacagttaccgtttctttttttgaaagagaaaggcaaaagatttgccattccaatatattagaagaggtaaaaataaaaaaaaaaaaaaaaaaaaaaaaaaaaaaaaaaaaaaaaaagtaaaaaaaaaaaaaaaaaagcggcc

SEQ ID NO: 753 - DNA, 604 bp, Zea mays
  Clone ID: PAT_MRT4577_117733C.1
gaggtcggcaaaggcaggatcctgctggagggcgaccggggtggcgttgccacgcgaccggtcggcagtgcagtactgcctgaccgccgcgtccctggtgcagcgccacggcctcaaggtcaccgtcgccgacgcgaggttctgcaagccgctggaccacgccctgatcaggagcctggccaagtcccacgaggtgctcatcaccgtggaggaaggctccatcggagggttcggctcgcacgtcgcccagttcatggccctggacggccttcttgacggcaaactcaagtggcgaccgctggtgcttcctgacaggtacatcgaccatggatcgccggccgatcagctggccgaggctgggctgacgccgtcacacatcgccgcgtcggtgttcaacatcctggggcagaacagggaggctcttgccatcatggcagtgcctaacgcgtagaacttgtgctgatctgggcctatagagatggttgtacattttgtcgttaactagagtgtctgaacttgggagattagtcttctttggatgaaagtgtcgccggaacaacggttacagtttcttcactatgaaaatgggaaggagatgttcttg

SEQ ID NO: 754 - DNA, 2797 bp, Zea mays
  UNSURE (1)..(2797): unsure at all n locations
  Clone ID: PAT_MRT4577_117774C.1
  unsure (1)..(2797): unsure at all n locations
gcggtgnngcggcccgctctagnnaactagtggnactcccccccgggcccttgcaggnaatnntcggcacccgagggattcgatcgctatctcctcttcgccctatagcaatgcgcggtaagcgcggcatttttcttatgcaggttgcataaccactggtgatatgagttgatctctattcgcttggaaagtagagataggttaaatttcggtctgaacggcgaaaccttaaataaaatcttaggatgctgtgtgagagaagcatgctggctccctcaaaggtatgtttgattgaagaatcaacggattgaaaatctcttatggatagaagtgcttattaactaaagattttgaagaagaagctgctgtctgctggaggtaggcttccttgaaatctaacgtcttaatgaacctttaagatcataacaacgtgcacgagtggtacatgctaacacgtcgaaacccttgtcacgaaagaatcatgtttctttcttccttccatttcctggcatttgatgctatgatgtgttcctcttgccagagaatggtgtggacaacgcggtaaatttggtgcagatggatggtgtgttcaaattgatcggagttctctggatggatacctatcgagtagtataattcctctctcagctcactgtccagacaattagtgctatctgtgactgttgggcaatcaggttatcgagattttgctggttggagctgtccggcattgctttcatcttttatcaatatgccggtctttggcagcatatggcgattcagaactgtgcgcagtggtttcctcgaatttaggaccccccaactgcattctgtattgagaacattcctgctaaatacatgatacttgcaggtattgtgttgtgtttgccagaaaccgtgtgctccccgaagcagtttagatatcttcctcccaaccttccctggcaaatcgcggtcactgctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaaatacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgactgtccaatctgcttcgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatgtctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgttatatttagtgctgcttcaagcgtacggctgcggttgaacggcggcggcggctgctgagccacagtaccttgctgttgctgagactgcacccagccacagtgcgccgccgccgcagcagcttgtagctggactttatgaaggtgcctttgttccgcaaggaagagttcttggttgcgggtagctattaaggccatctccaatagatgtcctattatatcccttatttcatcctctatttcaaactttatataaatagtattaaatatctcatctacactgccctatctcctgatcttttaagacagtctttagttaggaaaatgtgaacggtgtgcacctgtggttgtacgtcaaatccggatcccattttctatgcatataattatagtgttgtgttcccaagttgtgatttactccccccgggcatagaagtacccatatagaaggtgc

SEQ ID NO: 755 - DNA, 3472 bp, Zea mays
  Clone ID: PAT_MRT4577_117777C.1
aattcggcacgaggcccgaatcctccagaaaccgtgtgctccccgaagcagtttaaatatcttcctcccaagcccttcggcacccctgccaaatcgcggtcactgctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagttcgtcatacgcctcgcggtttttctagtttccgttttgatttctatgcgcccaatgttttgtccgattgattgatctgcttaggtacgtgagactgtctctattgttcgtgagtgcgtagatggtgggtgagtctggttgtttagatttgtgactggttgctcgacttgattgtgctgactgattgtttcatctatcgtgtaagctgtattaatgtctaatcccttaattgctttgaaaccactgcatgtgcttgattagtttggtttgtaccgacagcttttggtgcctatttgtgatgagattgaacatcctgctgcttgtgtttaatcttctaggttcgtgttcttgctgtatgcgtggttaatggttgactagtacttctctgatgctgaggatgattgctattgattgactagaatttaacatttccctgtggggaagtaatctcctatgttctgtcgaaagcagcacactctggcaactgtattgctgcatatattttccgtcaaaaaaatatttgctaaacatgaaaaccacacttattttgccttttcatctctccttgtggcacaatactatggcccagttttgaacctatggcccaacactcttagctaataactcaactaattgttaactaactcgcagctaacaattagttcattagctgcctcaatctagctaaccatttggttgctagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatatctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgtcatatttactgttgcttcaagtatggcccgtacggctgcggttgaacggcggcggcggctgctgagccacagtaccttgctgttgctgagactgcacccagccacagtgcgccgccgccgccgcagcttgtagctggacttgatttatgaaggtgccggaagagttcttggttgcgggtagctattaaggccatctcgagtagatgtcctattacatcccttatttcatcctctatttcaaactttatataaatagtattaaatatctcataaaaaaaaaaaaaaaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaaatacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgactgtccaatctgcttcgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatatctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgtcatatttactgttgcttcaagtatggcccgtacggctgcggttgaacggcggcggcggctgctgagccacagtaccttgctgttgctgagactgcacccagccacagtgcgccgccgccgccgcagcttgtagctggacttgatttatgaaggtgccggaagagttcttggttgcgggtagctattaaggccatctcgagtagatgtcctattacatcccttatttcatcctctatttcaaactttatataaatagtattaaatatctcatctacactgccctatctcctgatcttttaagacagtctttagttaggaaaatgtgaacggtgtgcacatgtggttgtacgtcaaatccggatcccattttctatgcttaattatagtgttgtgttcccaaaaaaaaaaaaaaaaaaggccccta

SEQ ID NO: 756 - DNA, 2326 bp, Zea mays
  Clone ID: PAT_MRT4577_11786C.1
gggaccctcgaggccggccgggatcttcttggttggtcggaaatgagctcgacaggttgaggttgtcagccagcgagatatctgatctcctccggctccggtgcggtgaggaccccatcccgccggcggacaaaagttacatggcctgccccccgcccgaacaggaagagggcccacacgtcggccactctgtctgaccacagcacccccaccacctagcttgattcccaaaacgttttcccctggaaagagaaaaagagaaaaacggagattccttgcccccttttcccttccccatcgtcgaaaccctagccccgcctcgccgccggcacgccggatcggtcggcgccatgtccaaggccagggtctacgccgacgtcaacgtgctgcgccccaaggagtactgggattacgaggcgctcaccgttcaatggggtgagcaggatgactatgaagttgtcaggaaggtcgggagaggaaaatacagtgaagtatttgaaggtattaatgttaacaataatgagaaatgcatcatcaagatcctcaagcctgtgaagaaaaagaagatcaaaagagaaattaaaattcttcagaatctttgtggaggccctaacattgtgaagctgctcgatattgttagagatcagcattcgaaaacgcccagcttgatctttgaatatgttaacaacacagatttcaaagtgctgtacccaacattaacagattatgacattcggtattacatctacgagttactcaaggcattagattactgccattcacaaggtattatgcaccgagatgtgaagccccacaatgttatgatagatcatgagcttcggaaactccggctgatagactggggtcttgctgaattctatcatcctggcaaggaatataatgtccgtgttgcatccaggtacttcaaggggcctgagcttcttgttgacttgcaagattatgattactctttggacatgtggagtctgggctgcatgtttgctgggatgatttttcgtagggaaccatttttctacgggcatgacaactatgatcaaaggagtactgggactacgaggcgctcaccgttcaatggggtgagcaggataactatgaagttgttaggaaagttgggagagggaaatacagtgaagtctttgagggtattaatgttaacaataatgagaaatgcatcattaagatcctcaagcctgtgaagaaaaagaagatcaaaagagaaattaaaattcttcagaatctttatggaggccctaacattgtgaagctgcttgatattgttagagatcagcattcaaaaacaccaagcttgatctttgagtatgtcaacaacacagatttcaaagtgttgtacccgacactaacagattatgacattcgatattacatctatgagttactcaaggcattagattactgccattcacaaggtattatgcaccgagatgtgaagccccacaatgttatgatagatcatgagcttcggaaactccggctgatagactggggccttgctgaattctatcatcctggcaaggaatataatgtccgtgttgcctccaggtacttcaagggtcctgagcttcttgttgacttgcaagattatgattactctctggacatgtggagtctgggctgcatgtttgctggaatgatttttcgtaaggagccatttttttacggtcatgacaaccatgatcaacttgttaagatagccaaggtacttggaacagatgggctgaatgtctatttgaacaagtacagaattgagcttgaccctcagctcgaagcccttgttggaaggcatagcaggaaaccctggacaaagtttattaatgcagacaaccaacacctagtgtctcatgaggccatagatttcctcgacaagcttttgcgttatgatcatcaggacaggcttactgcacgtgaagctatgacacacccatacttccaacaagtgagggctgcagagaacagcaggacgcgggcatgagaggccaaagaccaaagaggcaaagactggtgctaaccgtggatcagatcatctgctcttggtggagccatgctcttaccagtgatgaatagtggtttgggggtttacttggcaaaaacaaacagtagctatggcgcctgttgtacccttaaccgcgtcgagacgtgactgaattactcaggtcatcggcttgtgggacgtgattgcgaacgagattattcatgtaagatgtttgtcataaaaggtcgtcgttggctgattgtgctgtttgtattgttgagctagtaaagaatatccaaaatttgtttggacttc

SEQ ID NO: 757 - DNA, 1620 bp, Zea mays
  Clone ID: PAT_MRT4577_11789C.1
ttgggtacctcgaggccggccgggggatctatccccccacgtagcacatcaactcggagtcggagattcccctcccagccgtcgaaagtcgaaaccctagccccgcctcaccgccggcggtggtggcagcctcagcaccggcacacagcccgccgtacctctcctcgtacgctccctcccggtgtgccgtcgccccctcgaccggtccatcgttcgtcggctcggtagccgccggatcgggatcggccggcgccatgtccaaggccagggtctacaccgacgtcaacgtgctgcgccccaaggagtactgggactacgaggcgctcaccgttcaatggggtgagcaggataactatgaagttgttaggaaagttgggagagggaaatacagtgaagtctttgagggtattaatgttaacaataatgagaaatgcatcattaagatcctcaagcctgtgaagaaaaagaagatcaaaagagaaattaaaattcttcagaatctttatggaggccctaacattgtgaagctgcttgatattgttagagatcagcattcaaaaacaccaagcttgatctttgagtatgtcaacaacacagatttcaaagtgttgtacccgacactaacagattatgacattcgatattacatctacgagttactgaaggcattagattactgccattcacaaggtattatgcaccgagatgtgaagccccacaatgttatgatagatcacgagcttcggaaactccggctgatagactggggccttgctgaattctatcatcctggcaaggaatataatgtccgtgttgcctccaggtacttcaagggtcctgagcttcttgttgacttgcaagattatgattactctctggacatgtggagtctgggctgcatgtttgctggaatgatttttcgtaaggagccatttttttacggtcatgacaaccatgatcaacttgttaagatagccaaggtacttggaacagatgggctgaatgtctatttgaacaagtacagaattgagcttgaccctcagctcgaagcccttgttggaaggcatagcaggaaaccctggacaaagtttattaatgcagacaaccaacacctagtgtctcatgaggccatagatttcctcgacaagcttttgcgttatgatcatcaggacaggcttactgcacgtgaagctatgacacacccatacttccaacaagtgagggctgcagagaacagcaggacgcgggcatgagaggccaaagaccaaagaccaaagaccaaagactggcgctaaccctggatcagatcatctgctcttggtggagccatgctcttaccagtgacttgcttcagtcgtatgtgatgaatagtggtttgggggtttacttggcaaaaacaaacagtagctatggcgcctgttgtgcccttaaccgcgtcgagacgtgactgaattactcaggtcatcggcttgtgggacgtgattgcgaacgagattattcatgtaagatgtttgtcataaaaggttgtcgttggctgattgttctgcttgtattgttgagcttgtaaagaatatccaacatttgtttggacttcatcgagctctccaggtttttttctcg

SEQ ID NO: 758 - DNA, 298 bp, Zea mays
  Clone ID: PAT_MRT4577_117985C.1
cgcgttagacgttacaacaccctaaagtgagtcgtattaaccgcggctacggccattccatcttcgagtgccccgcgatcgtcgctgaggcgtgaccggcagacagacatccgcggcgccatcaacgagcaggtgcggcaggaagatgacagcatcggcgtcgccgtcctcaaggggaatgtataatgtgtcgaggaagtatagccgtgactcgtcacagcgccggacgcgcacgtcatcatcgctgtgaccggagtctccagcacgatccagacggccggcggggcagcgatacgcc

SEQ ID NO: 759 - DNA, 1977 bp, Zea mays
  Clone ID: PAT_MRT4577_118142C.1
ccatcaaacaagctcttgggggttcaccacaaattgtttgcaaaaggggttcaatcaaagaacttaggtaatgcttcgccaaaaaattgagtccgagaaactgcgtacccaggttgatcccccccacggccatcgccccaggagaggcaggcgatgacgatggcgacgaaggcggcgtgcgtctggcggtgtgggtgctcgtcgccttgggcctgtgcgacctgggctcaacgcgcgcgcccctgggcagcccgccgcagccggagctcgacgacttcgcgctctccctccagtcgcccgccaccgtctccgcccccacccgcctcccccccgccaccgacggctgcgctcaggcggcgtccctgcggagcctagcgagcgctggccatggcgccggccacgagcgggcggtgccggccggcgctgtgtgtccccgttgccccggccccatccgccccgcgacccgccactgctgcgccaccaacggctcctgccgctcggagcctctccagacgttcacgatccacgggctatggccggactacgacgacgggacctggccgtcgtgctgccgccgcacccaattcgagatggacaagatattgccactgaaggaggtgcttgacaagtactgcccgtccctctactgctccaaatatgccgcccggtgcatggatagagggtcgggggtggaaagggtggtggtacagttgtactgagctgagctgccggaggcagaataggagaggcaggcgatgacgatggcgacgaaggcggcgtgcgtgctggcggtgtgggtgctcgtcgcctcgggcctgtgcgacctgggctcagcgcgcgcgcccctgggcagcaagccgcagcgggagttcgactacttcgcgctctccctccagtggcccggcaccatctgcgcctccacccgccactgctgcgccaccaacggctgctgccgctcggagccgctccagacgttcacgatccacgggctatggccggactacgacgacgggacctggccgtcgtgctgccgccgcacccaattcgagatggacaagatattgccactgaaggaggtgcttgacaagtactggccgtccctctactgctccaaatctggaacatgcttcagcggcaagggactcttctgggctcacgagtgggagaaacatggaacctgctctgcccctgtggttcaggatgaattacagtatttcacccttgcccttgacctctactccaagtataacgttacggaaatgctgtcaagtggagggatacaggtttcaaatggtaaggaatatgcactgagcgatgtcatcgataccatcaaacatgcttttgggggatcaccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccaacatatgatccccttgtgcttgccaattcaactgtagagatcatgacacagttcgatgaatttgaggtgcctgcagctctttatacagcttaaaatgcaattgttgcaatagcagaaggtgctcgcgtgagcacctagaaccaggcacatttatcctgggatattcaatcatttgtacatgtacacttgaaagagaactgacatcttttcaacctgaaaatttataagctttatgtaaccgtgaaggtcggatattgcacatgtaattcgctaaatcaaaactgtatcttgaggtagaattttcaagtagtaataatagagatataagaaacttatcgcccaaaaaaaaaaaaaacgtgtattcttgaaaacaaacttgaatctttcaaaaaaatttccaaatgacctttatgtacccttcaaggtcggatattgcacatgtaatctcgttaaaccgtaagtgttcgttgaggtaggt

SEQ ID NO: 760 - DNA, 382 bp, Zea mays
  Clone ID: PAT_MRT4577_118357C.1
cgacccacgcgtacgcgagaagacgagtgttaagtgaacctgttactttcggtgccactggctgcgtacctgagtgtgagcgagtgatcgagctagctgagctccgatcctggctagctaggatacgcggcatacctcaagtacctttcacaagtttacgagtgacagcaacaagagatcgatggcctctgccaccgtgctcaagtcctccttccttcccaagaagtccgaatggggcgccaccagtgcatgccgccgctcccaggccgaccaccgtctccatggtcgcacgcgcctgcgtctacgccgatgagctcgagaagaccgctaaaacgatcgcgtcgtcatcgcggggcattctggccatggacgagtcgaacgc

SEQ ID NO: 761 - DNA, 1477 bp, Zea mays
  Clone ID: PAT_MRT4577_118397C.1
ttgggtacctcgggccgggccggaggcacatatatatacacgcggcggcggccagatccatcttggtatacacgtaatatatatacacgcacgatgggcagcgccggcggcggtggcgagagcaagctggagagcccgctgctgggcgcgtcgtcgacgggcctcgctcggcaacaccggcatccaggtcttcgcctacggcctcatgctgggcatggggagcgcggtggagacgctgtgcgggcaggcgtacggggcgcacaagtacgacatgctgggcatctacctgcagcgctccaccgtcctgctgatggccacgggggtgccgctggcggcgctgtacgccttctcccgccccgtcctgctcctgctgggggagtcccccgagatcgcgtcggccgccgccgtcttcgtgtacggcctggtcccgcagatcttcgcctacgccgccaacttccccatccagaagttcatgcaggcgcagagcatcatggggcccagcgcctacatctccgccgccgcgctcgccgcccacctcgccctcagctacctcgtcgtctaccgcctcggcctcggcctcctcggcgcctcgctcacgctcagcgccagctggtgggccatcgtcgccgcccagttcgcatacatcgtcaccagcagccgctgccgcctcacctggaggggcttctcgtggcaggccttctccggcctgcccagcttcttcaggctctccctcgcatccgccgtcatgctctgcctcgagacctggtacttccagattctcgtgctcatcgccggcctcctcaaggaccccgagcttgccttggcctcactctctgtctgcatgacaatttcagggtgggtgttcatgatctccgttgggttcaatgcagcagccagcgtaagagtgagcaacgagctaggcgccggcaacccaagggcggcggcgttctccgtggtggtagtgacgctgctctccttcgtcctgtcggtcataatctccgtcgtcatcctgctgtgccgggactacatcagctacatcttcaccgagggcgacgacgtgtcgcgggcggtcgcccagctcagcccgctgctggcggtcaccctcatcctcaacggcatccagcccgtcctctctggggtagctgtggggtgtggatggcaagcgttggtcgcatacgtcaatgtcggctgctactacatcgtcggcatcccccttgggtgcctcctgggattctacttcgacctaggagcagcgggtatctggagcggtatgatcgggggcaccctgatgcagaccatgatcctggtgtgggttacattcaggacgaactggaacaaggagattcggaaattgatgcaaggttgcaattcagtgtcctgaaatgtctacgaggagaggagaggagaggagatgagatggctggaattttaaatactactcttgcatcacccaaaaaaaaaaaaaaaaaaagcggcc

SEQ ID NO: 762 - DNA, 408 bp, Zea mays
  Clone ID: PAT_MRT4577_118552C.1
gcgacccgcaccttttggacatgcgcgacatgctcattgggccctacaacccgggcgcagtcttgaccggcgggacgcgcgtcgtcttgtccctcgacacgcaagtggaggagcacgcacgcgtcaagaccttaatcatggacctactccaccgctccgtccgtacctgttccgccgactttcgcgcgagcgtcggtgccatgctggacgccgaggacgctgatttctgaaaggacgactgcagtgtcaagaagccctccgccagctacctattacccctgcatcagtgcatgttccaggttactctgcaaggcgttcgtgggcgccaacccgttcaccgactggctggtggacaacttccgcttcaccattctggacatatagctggcactatagatcctgcccacg

SEQ ID NO: 763 - DNA, 1527 bp, Zea mays
  Clone ID: PAT_MRT4577_118564C.1
atgtaatgggtggtatttcaagatgaacagcaaaacttgtatacagtcttggagccctagtagtacatgcaccaagacagcacattgcaacgattaacaaagggaaaaagactgcaaaacggcatgaatcctgttcgccgcaccaaacggatctattcgtcgtttagctgtagacattgttgaggtagaagtacaggccagccaaggcaatgatcccgacgacgatggcaataggcaagggtttccccatgctctcctccttcttcagctcctccttcctcgcctttctggcatcggtggcgttcgcgttcttggagactgctggctcgtagggtctgaacctttttttcattgctgtacaaacagggcaaggccggttgtcctacagcttgtgtgagccgccgtcgcgcacttcgagctccgccccgacgcgcagtcgccacgggagctcgttcctctccggcggcagcaccctccacccctcatcaacccaacccgcaagaaaaaacccgcagcagagaagaggagtcgccgcgaccgagagctccagagcacgcccccgccacagcctccgacgatggatccaaagatgacagaggtgacccagatgttcgcccgcttcaaggcggcctacgcccgcaacgacctcaacacctgcgtcaccctcctctcgcagctcaaggtccatctcacccaattccccagccttccgcccttgtttcagcagacaccgaacattgtggaggagctcaaacttgcaagggacatttatgagcatgctgttgttttgagtgtgaaacttgaggaccaagatgcgtttgaacgcgatttctgccagctgaagccttattacatggatacatgtggcataattcccgcctcgccagaggagtacccaattttgggactcaatcttctgaggctgttggttcagaatagaattgccgaattccacactgagctggagcttttacctgccaaggcactcgagcatccttgcatcaagcatgctgtagagcttgagcaatccttcatggagggtgcctacaaccgagtgttaagcgctcggcaggctgtgccacatgagacctacgtttacttcatcgaccttctcgccaaaacagttagaggtgagatcgctgggtgcagcgaaaaggggtatgattctctatctgtgagtgatgcaaagcaaatgcttatgttcagttctgaccaagatctgcacgagtacatcactgaggagcacccggaatgggagattaagaacggtgctgtcttcttccagaaggcgaaggaatcacagccctgcaaggagatcccatccttgcagcttatcaaccagacgctcagctacgccagggagctggagcgtattgtatgatttaaaccaatccctggtggttctttccccccctgtggccgcttggcatggcttgtactgtcctttgcatttgggatgatctttgatcgcagctctcatctgactgaaacatcatgtgaatctctgaagggctcagtctctccggc

SEQ ID NO: 764 - DNA, 2569 bp, Zea mays
  UNSURE (1)..(2569): unsure at all n locations
  Clone ID: PAT_MRT4577_118567C.1
  unsure (1)..(2569): unsure at all n locations
tttttgtttttttttttttttttttttttttttttttttttttttttttgctggttatgtaatggggggtttttcaagatgaacagcaaaacttgtatacagtcttggagccctagtagtacatgcaccaagacagcacattgcaacgattaacaaagggaaaaagactgcaaaacggcatgaatcctgttcgccgcaccaaacggatctattcgtcgtttagctgtaaacattggtgaggtaaaagtacaggccagccaaggcaatgatcccgacgaccatggcaataggcaagggtttccccatgctctcctcctttttaagctcctccttcctcgcctttttggcatcgggggggttcgcgttcttggaaactgctggctcgtagggactgaacctttttttccgttcccaccaaacacaaagcattttcagccgccccaccgcagcagcagagaagaggccgccgccgccgcgaccaagagccgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagctaatgggagcttaagaacggtgccgtcttcttccagaaggcaaaggagtcacagccctacaaggagatcccatccttgcagctcatcaaccagacgctcagctatgcgagggagctggagcgtattgtatgatttaatttcacagtaatccctggttgatgtttatttctgtggtcacttggcatggcatgtactgtcctttacatttgagatcagctctgatcgcagctcatgtcagctctgatcaatctctgaagggcttgatctctgcggcattgtttcaccacattaactgcattgcttgaaagatgcctgtcatccattgctgctgttaacttttgatgggcttaatattgaattattacatcgaaattgcactgattgtctttttttatttaaaaaaagacaaattatgttgacaagattagtcatactggaaaacagagattgctcattcaagtatgcttgagcgaaacatgagactacgcatacccctttttgtagggaagtcttatttaaaatcacggtactacttcgctatcggtcacccagggagtatttagccttgcaaggtggtccttgctgattcacacgggattccacgtgccccatgctactcgggtcagagcgtaagctagtgatgctttcggctactggactttagccatctagggtgcggcactcaaccgcttcgcctagcagcacaacgcttgtccgggttctcccccaaccccgttttcacggtttaggctgctcccatttcgctcgccgctactacgggaatcgcttttgctttcttttcctctggctactaagatgtttcagttcgccaggttgtctcttgcctgctcatggattcagcaggcagttcaaaaggttgacctatttgggaatctccggatctatgcttattttcaactccccgaagcatttcgtcgcttgctacgcccttcctcgtctctgggtgcctaggtatccaccgcaagcctctcgtgccgaattcctcgccattaacgttaaggctatgccatcctaaggtgctactaaatggaaggatcttatcaacgtccatgaacccgcgtgcgctacactccgcaaccgaccctcgacgtcctgcgtcanccctcctctcacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatntgaacgtgatttctgtcagctaaagccttattacatggatacatgtggcataattcccccctcaccagaggagtacccaattttgggactcaatcttctgaggctgttggttcagaatag

SEQ ID NO: 765 - DNA, 181 bp, Zea mays
  Clone ID: PAT_MRT4577_118732C.1
accacaggtaccttgctgagttcaagtcaggtgcatagaggaaggatgcttcggggaggaccctgaatgcctacaaagctgccaggatattgctcttgctgatctagcttcaacccaccccatcaggctggggcttgctcttaactgctcaatattctactactagatcctgaacttccct

SEQ ID NO: 766 - DNA, 261 bp, Zea mays
  Clone ID: PAT_MRT4577_118915C.1
tatggacaaggacaggaagaaggcccccgtgtcgcgctcctcccgcgccggcctccagttcccggtgggtcgcatccaccgccagctcaagtcgcgtgcctccgcgcacggccgcgtcggcgccaccgccgccgtctattccgccgccatcctcgagtacctcaccgccgaggtcctttagctgaccgacaactccagcaaggaccttaggggcaagctcatcacccctcgccacttgtgtctcggcatccatgattacaa

SEQ ID NO: 767 - DNA, 425 bp, Zea mays
  Clone ID: PAT_MRT4577_119034C.1
ggcagcaccaaggggcaccgggttttccttaagattaacttaaaataaagcctgtcgggggtaacagcatccatcgatccccagtccatgctgtttgttgcatgggcctcttttaaaccgaggatgaacacagttctaacaactgacacaaagcgaccttgcaatcaaaaacacagatgggcaacaacaaacacgacacgaacgaagattaaccctctggactagggtaaacatcacgggagcgaacaggataacttggccgcgcgggccccaccgtttaattcctccagttcccgtcggagttgccgtatccgccgccacggttgccaccgccgtagccgtcgccaccaccaccgttgccgccgccgtcaccgtagtcgtcgtcaccgtcgtttccgtcaccgtcatcacggtgcccgccaccg

SEQ ID NO: 768 - DNA, 208 bp, Zea mays
  Clone ID: PAT_MRT4577_11925C.1
tcgcaggcggacttcggtcgcctcgatattgatctggcctttgtcgaaatgcccggcctgggggggtgccttgccgagttcggcccgtccaatcccttcgtcggcgctaggatcttggggtctatttacatgaaccatccagactcgccgtcctcattgagacctttaccccgctcggcgccgaagtccgctggtgcttcttgcaaca

SEQ ID NO: 769 - DNA, 126 bp, Zea mays
  Clone ID: PAT_MRT4577_119501C.1
gtcgtcgtggagacgctccctatggtgctggatccgtcggaggccaaaaataacgctgcggtggaggcgacaggcgaggaggctgccaacgggaggagggagtacgtgatgtggaggaacgtcaca

SEQ ID NO: 770 - DNA, 283 bp, Zea mays
  Clone ID: PAT_MRT4577_119533C.1
cacacgcgtccggttggattctcctccccctccggttcgggttcgggctcgtgatgatctccggtgttcggtttcgtggttgggcggatcgatatttctgcgtcgtatgttgagtaccgctgcttcgtagtcagcgtctcctggaccacggacgatcactccctgcagaacgccttcatcaactactgcgacgtcctcgagttcaagatcatccgcgatcttgagacgcagatgtcccgcggcttcgtcttcgtcaccttctccactgaggatgcgatgctgg

SEQ ID NO: 771 - DNA, 2173 bp, Zea mays
  Clone ID: PAT_MRT4577_119594C.1
tttgggtccctcgggccggccgggctcgcgcacacgagctgtgcggtactgctcgctcatgcagcgactgccacgctaccaccgcttcctttcctcttcggctgctccgcctcgcctcccagttcacagcccctcccaggctccgaatcggcggccacttctcattcctcacttccgtcctcgcgcaccaccccctccatccgttccggatggtgccttcgaaatcccgtccggcgccctagcgtagctcgggctcggccaggctccgggcccgccgcgccgttccgcagtccagctccacctccagatcttttcttgagtttaaggaagatgcttgcctttatttagaaggccctttttggtacgtcagcagtgttctttcctataggagtaaatgccattccgtagcatcgtgcgtgatgtaagggatggtttcgggagcttgtctaggaggggatttgaggtcaggtttctgagtcatcgcagagggaaatctcatggtgctgtccatgagctgcacgacccagtgcttgtggtacagagtagctgctgggctagcttgcctcctgaattacttcgagatgtgattgagaggttggagaccagtgaggatacatggccttctaggaaacatgtagttgcttgtgcagctgtctgcagaacatggagagagatgtgtagagagattgtcaagagcccagagttttctggaaaaatcacttttcctgtttccttgaagcagcctgggcctcgagatggaactattcagtgttttattaagagggataaatctacccaaatctacagtctgtaccttagttttagctctgccgtgcctgtcgaaaatggcaaattccttctatccgcaaaaaggaactgccgtgcaacatatacagaatatataatatcaataaattctggtgatacatctaggtgtacaagtaacaacacatacattgggaaattaaggtcaaatttccttggcacaaaatttgtaatatacgatactcatccgccatacaatggaactagtcaaacagtggcagggaaaacaagtcagagattctactccaagaagggatcaaccaaggtttcttgcaggtggtacagtattgcacaaatctcatacgagctgaatgtcttgggaactcgaggcccaaggcggatgaactgtgtaatgcactccatcccagcttcatgccttgaggctggtggcagtgtcccttgccagccggacagcattgcagcccactctgttggcggatcattcagcagtgtgtccttgtcaaagtcatcgactatggaccactctatgcatttcaccagttcccggctctctgatgccataacaggagatggcattgtgaacagaggccaggcattgaatgatgctgacgatgaagagtgcaaggacatgcctttgatcctccgcaacaaggccccaaggtggcacgagcagcttcagtgctggtgcctcaacttccggggccgggtgactgtcgcctcggtcaagaacttccagctagtcgcggcgacacagcctgccgccggagccctgaccccatcacaggcagccccgcagccagctccgcctcctccgccggaccaagagaaggtcatactgcagtttgggaaggtcggcaaggacatcttcaccatggactactgctacccgctgtcagccttccaggccttcgccatctgcctgagcagcttcgacaccaagttggcctgcgaataaatcctacctacaattctggtacctaccaaataatcaaaaacactgattgtcgtggtgttcgtccaagaaccgagtttagctgagacgccattgggcaccatgtgctggtgccttgttaactcagaaacgcgtgggggctgaatctgtttcagcagcttccttgtgataatctgtagctgctgcttcgctgctgttgtatcctatgctttcatttctttccggttccgctgtagcttcttaccccccggtgacattagttcggtacccgtatctggatatttttttagccttcttcgttggattgttcaccggtgatggcatgtattaacagagatagttacatacagatgtaatgaattcaggtctggataattttgctttcggaaactaaaaaaaaaaaaggccacgacggccgtcatcttcagcagggtt

SEQ ID NO: 772 - DNA, 836 bp, Zea mays
  Clone ID: PAT_MRT4577_119602C.1
taggggccttttttttttttttttttggtcaaagaaagctcaggcttcacttggttagttgtttactccaaatctacagcaaacatgcggttcagcgcctcaagtttcttgaccattggctcaagacaaaaaaagaaaaatgttacacgagtgagttgacaccacactagctgttggtcaaagagacacaattatgctgccgatcttgttttgaggaccctgcacttgagcactctatcttgcacgtaaaaccccggcgtcaccatgatcttcacttgacaaggactctgcaccggctgcctgtcatgcaggatgtcttccatgtacagctcatcaaatgcacggccgtcttggacgcgcaggatcgtcagcggcgggccgaaggagaaggccagcaggtggagcagccagacgcacttggcggcgacgaagaagcactgaagcagctgctcgggccacggccgggaccaggcaagcgtcgccacgacgacgctcatcttccggtcgcagaaacggctgaagtcctcgctgtagtacttggtgcccttccgcagaacctcgttccagctaaggttgcgcagcgccacgaaggctgcgaagctctgccggctgtcttccgccgggtcgaggcacctcggcgagccgttccgctggaacgcggggttctcgaagtcctggaacatgacctggttcatgatcgcctcaagatggtacagcacggccttcgagcagtgtttgtgacgctgccgctgctgagcgcgagctggtacgggcgaaggagcaggttcagcttgtcggacaggccgtcactgcggacgcgtgggcggacgcgtggg

SEQ ID NO: 773 - DNA, 398 bp, Zea mays
  UNSURE (1)..(398): unsure at all n locations
  Clone ID: PAT_MRT4577_119628C.1
  unsure (1)..(398): unsure at all n locations
taatggaggctaagggnggcagagggtctagcagtcgtcgttccatgatgtatgaagctccccttggctacagcattgaggacgttcgacctgccggaggcgtgaagaagttccagtctgttgcttactccaactgcgcgaagagggggggctggtatcccttttggcttcctcattctagtcgtttaggatttcttttctggccctttgattctgaccaatctctctggcctgctgcttcctgctgttcgtcccgttccccagtgcttgctccttgcgctccttcctccgtctcctagcttgtgttctgattcacctgctccccgggctgttctttctgttgctgttgcttccccggccccggccctcgggtttgggggctctgagatgcgccttgg

SEQ ID NO: 774 - DNA, 413 bp, Zea mays
  Clone ID: PAT_MRT4577_119804C.1
accacgcgtgcgtccacgcgtgcgcccacgcgtgcgaccacgcgtacggcagaggatcccgcggcttttgcttcggcaccttctccacggaggaggcgacgcgcaacgccatcaagggcatgaacggcaaggagctggacggtcgcaacatcaccgacaacgaggcccagtcccacagcagccggggaggcggcggccgtgggtacagtggcggccggggaggctgcggctactgcggcagcgggcgccgtgatggcggaggcagatacggaggtggcggcagatacggtggccgccgccgatacggtggaggcggcggcggctacggaactagcaaccgaaggggatgctacagcaactgcgacgggaactggaagaactgagctgtggggctcgcgcggacaagttatgct

SEQ ID NO: 775 - DNA, 1988 bp, Zea mays
  Clone ID: PAT_MRT4577_119841C.1
gctataaacatggtttgtatttttgtatcttcatataaatccgaccgaagctacaaaagctgagcagctgaacttaagaatacaagttaaattagaagggagggagcgccaccggccaccctatgggtgtcggtgagcttactaatcagacagaaacagttcactaatcggagccggtaattagaccgagtcactgaactgaagtttgtacaaagtaacaaagacaggcaaccaaaaaaaaagaaagacgatcccgtatcacgttcctaaacacaaagctggcagtgagtggagttccccgatatctcaactaaacgggagctacagctagacttcaaaagagatcccgaagacgagaccaacgcacgccgactacagtctacagctcgtccttgtcgaaggacggctccgacccctccttggccgccggctccttctcttccacctccggctgctcctcggcctcgtcctcctcctccacggccgcgtcggggctcaggtccaggctcttgtgcaccgacttgtagatgctggacgcgaactccttggggtcggggaggttgaacccgctctccataagggccgtctggtacaccagcctcgccgtctgcttcagctcctcgctctcgttgtcctgggcgaccttgtcgcggagctccttgatgatggggtgcctggggttgatctccagcaccctcttgccgcgcatgtacgcctgcttgctcgagtccgacagcgtctgcgcctgcatgatcttctccatgttggcgctccacccgtacttggaggtgacgacgacgcagggggtgtcgtgcagccggctgctgaccttcaccgagtccacgctctcgctctccagggccttcttccaccactccgtcagctccttgaacgactccttgaggtccttgagcctcgagtccttgcccagcttcaggccctccttggacacgttctggaacttcctgtcctcgtagtccatcaggtactgcatcaggtactcgtccatagggtcggtgaagaagatgacctcgtagttcttcttggttagcctctccaggaacggagacttctccagctgatctttgctgcttcccgtgaggtagaagatgtctttctgccctggcttcatccttgaaatgtactcgtcaagggaggcaagtttgccatccgacttggtactttcaaatctaagaagcttcgcaaggcggttcctgttagttgcgtcttcaatgatacccagcttgattgatttgccaaactcattccagaacttggcgtactggcccttcttctcctccatctcatttttctcttcatctgtcttatccttgttgctgtactcatcagggtcttcttcagcaagtttcctaatcatgtcaagagctttgcggatcagcttcttcttgatagtcttcagactgctatgttgttggagcatttctcgtgacacattcagcggcagtgtgtctgagtcaacaatacccctcaaaaagctgagatacttcggaagaaggtcatcaaattcatcagagatgaacactcttctaacatacaacttgaggtttgacttgttgctgttgtagtaactctcatagagatcatgcggagccttcggtggaatgaagagcaaagctttgaactcaacatctccttcagcagtgaagtggctccaacccataggcttgtcatcaccgaagtccttggctagtgagtggtaaaactttgagtattcttcgtcagtaacctcctttgggctgcgaagccatacagccttcatatcattcagaagttcccattcagaagtagtctcctttatcgtcttcgtcttaggctttttctctttctcttcgtcttcgtcttcttctgtctcttcctctgtagtttctggagttgaatcctcttcttcacttgtctcatcctcatcagttggcacttcaacatcaacctcccggacgcgtggacggacgcgtgggcggacgcgtggg

SEQ ID NO: 776 - DNA, 2870 bp, Zea mays
  Clone ID: PAT_MRT4577_119850C.1
gtatcttcataaaaatccgaccgaagctacaaaagctgagcagctgaacttaagaatacaagttaaattagaagggagggagcgccaccctatggatgtcggtgagctcactaatcagacagaaacagttcactaatcggagccggtaattagaccgagtcactgaactgaggtttgtacaaagtaacaaagacaggcaaccaaaaaaaaagaaagacgatcccgtatcacgttcctaaacacaaagctggcagtgagtggagttccccgatatctcaactaaacgggagctacagctagacttcaaaagagatcccgaagacgagacgagaccaacgcacgccgactacagctcgtccttgtcgaaggacggctccgacccctccttggccgccggctccttctcttccacctccggctgctcctcggcctcgtcctcctcctccacggccgcgtcggggctcaggtccaggctcttgtgcaccgacttgtagatgctggacgcgaactccttggggtcggggaggttgaacccgctctccatcagggccgtctggtacaccagcctcgccgtctgcttcagctcctcgctctcattgtcctgggcgaccttgtcgcggagctccttgatgatggggtgcctggggttgatctccagcaccctcttgccgcgcatgtacgcctgcttgctcgagtccgacagggtctgcgcctgcatgatcttctccatgttggcgctccacccgtacttggaggtgacgacgacgcagggggtgtcgtgcagccggttgctgatcttcaccgagtccacgttctcgctctccagggccttcttccaccagtcagtcagctccttgaacgactccttgagctccttgagcttcgagtccttgcccagcttcagtccctccttggacacgttctggaacttcttgtcctcgtagtccatcaggtactgcatcaggtactcgtccacggggtcggtgaagaagatgacctcgtagttcttcttggttagcctctcgaggaatggagacttctccagctgctctttgctgcttcccgtgatgtagaagatgtctttctgccctgacttcatccgtgagatgtactcgtcaagggaggcaagtttgccatccgacttggtactctcaaatctaagaagcttcgcaaggcggtttctgttagtcgcgtcttcgatgatacccagcttgattgatttgccaaactcattccagaacttggcgtactggcccttcttctcctccatctcgcttttctcttcatctgtcttatccttgttgctgtactcatcagggtcttcttcagcaagtttcctgatcatgtcaagggctttgcggatcagcttcttcttgatggtcttgagactgctatgttgttgaagcatttctcgtgacacgttcaggggcagcgtgtccgagtcaacaatacccttcaaaaagctcaggtacttgggaagaagatcatcaaattcgtcagagatgaaaactctcctaacatacaacttgaggtttgacttgttactgttgtagtaactctcatagagatcatgtggagccttcggggggataaagagcaaagctttgaactcaacatctccttcggcagtgaagtggctccaacccataggcttgtcatcaccgaagtccttggctagtgaatggtaaaacttcgagtattcttcatcggtaacctcctttgggctgcgaagccatacagccttcacatcattcagaagttcccactcagaagtagtctcctttattgtcttggtcttgggctttttctctttctcttcgtcttcttctgtctcttcctctgtagtttctggagttgaatcctcttcttcacttgtctcatcctcatcagttggcacttcaacatcaacctccttggtcgaccacaaatagatagggaagttgatgaactcagagtacttcttcaccaaatcctttagcttatcctcttccaagtactccttggcctcatctcgcagatgcaatcttatctcagttccacggccaaggggctcattccatgtatcctcagagatggcaaatgatccatcagcttttgattcccacacatactgtttatcatcattgtgcttgctgaccacttcaacatagtcagcaaccaagtacacagagtagaagccaacaccaaactgtccaataagattgaggtcacctccagactgcatcttttccacaaaagctgaagtgccagatttagcaatcgttccaaggttattaataagatcctccttggtcataccaatacccctatcccgaatggagaggattttcttctctttgtccaacttaatctgaatctcaagctttgcagtgtcaccttcacccagaacttccttatcagtaagggaaaggaacctgatcttatccaatgcatcagaggcattggatatgagctccctcaggaagatatccttgttgctgtagagtgagttgatgatgatgtccatgagtctggaaacctcagcctggaactcaaacttctcggctgagctcctgagagtcttcctagagatagactcagcttccctctgggcaacctcagagtcggtggacaggccatgagggacagcaccaagcttctcctctaccttgggtgggttagctaagtcatcgctgctctcctcggcattcacctgtagcttcttagctgggtcggggagggtggtgaggaggaagaggaggaggaggagcgcggaggagagcgcccacttgcgcatcgtcgtttcgtctcgcttcactctgcggcgtacagccacggcccacaccagtgacgagcggacgcgtgggcggacgcgtgggcggacgcgtggg

SEQ ID NO: 777 - DNA, 770 bp, Zea mays
  Clone ID: PAT_MRT4577_119851C.1
agacagaaacagttcactaatcggagccggtaattagaccgagtcactgaactgaagtttgtacaagtacaaagacaggcaaaaaaaaaaagatcccgtatcacgttcctaaacacaaagctggcacctggcagtgagtggagctccccgatatctcaactaaacgggagctacagctagacttcaaaacagatcccgaagacgagaccaacgcacgccgactacagctcgtccttgtcgaaggacggctccgacccctccttggccgccggctccttctcttccacctccggctgctcctcggcctcgtcctcctcctccacggccgcgtcggggctcaggtccaggctcttgtgcaccgacttgtagatgctggacgcgaactccttggggtcggggaggttgaacccgctctccatcagggccgtctggtacaccagcctcgccgtctgcttcagctcctcgctctcgttgtcctgggcgaccttgtcgcggagctccttgatgatggggtgcctggggttgatctccagcaccctcttgccgcgcatgtacgcctgcttgctcgagtccgacagcgtctgcgcctgcatgatcttctccatgttggcgctccacccgtacttggaggtgacgacgacgcagggggtgtcgtgcagccggctgctgaccttcaccgagtccacgctctcgctctccagggccttcttccaccactccgtcagctccttgaaaaactaattgaggtccttgagcctcgagtccatgca

SEQ ID NO: 778 - DNA, 2588 bp, Zea mays
  Clone ID: PAT_MRT4577_119950C.1
ccggccgggaaaaaaaaaaaaaaaaaaaaaaaaaaaaaaaaaaaaaaaaaaaaaaaaaaaaaaaaaaaaaaaaaaaaaggacttttgacaccacacgtgcagtactcatatggtacaaatacccaaagtctcacggttgcgggggttcgggctcctcctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccatcggactccaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgagaatgtttggacaccgtcgaaggtgatagcgcgccttggcaaagaaataaatgatgaaagctcctatctttattgggcatacaagaataacatccctgtatactgcccagcattgactgatggatcacttggagacatgctgttttgtcatgcagttcgtaatcctggccttattattgacattgtacaagatatacgtctgatgaatggggaagccatccatgcaacaccaaggaagacagggattatagttcttggtggaggccttccaaagcatcatatatgcaatgccaatatgttccgcaatggtgcagattatgctgtgtatattaacacggctcaagagtttgatggtagcgattctggagcacaccccgatgaagcagtctcatggggcaagattaagggttcagcaaaacctgtaaaggtgcattgcgatgcaagtatcgctttcccgcttcttgttgcagcaacatttgcacgtaaggttcataactccaaatgaacagactgaatgggattcggtggagtgaatgggcaacagaattttgttgaactctccaaatgaccttttggagcacgaggtctacttcacttgcacagggatcatgtgcaaattttttcggtgactcgcggcaaccacatgccatcattcttcgatgttcacttgatgctgtactagctggttgatagcatttttgttacaacagataatttattgaaatacagacatacgattgtccatccgagtcgtctgcttacgatttttttgtagacgaaacatctgcttacgaaatcgacaaatggcctgttttatgaacacgttttttttttcctcagctagtacctaccggccagtagtcgtcgcgtctgcaggcagatctgagttagccggcggatccgatccgtgcgcgtgctgctgtgtgtgtgtcggtggagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgacccgttcatcggcagcctggagacgccggtcacctccagcccgctcgtggcgtggtacctctccaacctcccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgtccacggcgcccacgctcacgctcaccggcaggaagaaggaggccgacaagctgcagaccgccgacggctgggccaagttcaccggggggttcttcttcggcggcatctccggcgtgctctgggcctactttctcctctacgtgctcgacctcccctacttcttcaagtagaaatcatcaaagatgcgtatatatatagctccggccgatcctcctctctagctgcatggtatgtaggtggtgtggtccttgtttcatttcactccagcggtgatcagcgccgtgtataaatgtaattcctctgctttgcacatggatggattgggatgtaacctgttcaacttttttttaccttattggatgcatcattcagagccaaaaaaaaaaaaaaaaaatttgcggcc

SEQ ID NO: 779 - DNA, 1430 bp, Zea mays
  Clone ID: PAT_MRT4577_119971C.1
actttcttcttttttttcaagctaaaccacgagcgggcgcggggcgactgggcgaggcgagctgccaaggattcgaccgttgcgttctccgcccaaatcttagaaatcccaatccccgagcggcgtccggccggaaacttcgcctcgccgctccccctccctacgcaagcttcctccccctccgcgccgctcctccaggttccagccatggcgatcgccaccgagtcgcgcggcagcgaggacagggcttcagcccatgcaaacgaggagaagcggtgggtgctgtctgatttcgaggttgggaagcctcttgggaggggcaaattcggccacgtatatcttgccagagaaaagaggagcaatcaaattgtggctttgaaagttcttttcaagagccagcttaagcaatcacaggtcgagcatcagctgcgacgcgaagtggagattcagagtcatcttcgtcatcctaatattcttcgcctgtatgggtacttctatgatcagacccgggtttacctaatcctggaatatgctgccaagggtgagctgtataaggaactgacaaggtgtaaacatttttctgagagacgttcagcaacttatattgcatcattggctagagctctgatctacctgcatgggaagcatgttatccatcgggacattaaaccagaaaatcttttggttggagcccagggtgagatcaaaattgccgactttggctggtctgtgcataccttcaacagaagaaggactatgtgcggaaccctggattacctgccacctgaaatggttgagaagacagaacatgattaccatgttgacatatggagcctgggtattctgtgttatgagttcctttatggggtcccaccttttgaagctaaggagcactcagaaacatacagaaggatagtaaaagtcgacttgaagttcccactgaaaccattcgtttcgcccgccgcaaaggatttgatttcccagatgctggtcaagaactcggcccagcggctgcctctccacaaggttcttgagcacccatggatcgtccagaacgccgacccttccggtgtgtgcagaggatagaaccaccaccaccggctgaagggagtgcgattctttccactctccccatttcgaggggagtgcgattctttcgactgtttatggcttctgtcgcccgaattgccccaccccgaactgtatcttgtagcaccgtgtactgtgtagttggggccgtgggcaaattgccctgtacccttgaacaaccttctttactcgtagtctcgtatgagagagccttgtagagtctcgtccgtccaattatgaactcgagggcaatgtgcaggaaaatgttgaaggtatcgtccataaccagcaaaacttatgtagcgagctcaatttagaatttaaaaaaaaaaaaaaaaaaa

SEQ ID NO: 780 - DNA, 1321 bp, Zea mays
  Clone ID: PAT_MRT4577_119972C.1
gggtacctcgaggccggccgggtgaagctgctaatcatcccaggtattcactacttccccattcctctgcgctgcgcttctgctccccccttctctctccctcctcgctcgttccctctcatcccacgcgcgtgcggcctgcggtgcctgcgccgctgtccgcgccgctcctccaggctccaaccatggcggtcgccaccgagtcgcgcggcagcgaggacagggcttcagcccatgcgaaccaggagaagcggtgggtgctgtctgatttcgaggttgggaaacctcttgggaggggcaagtttggccatgtttatcttgccagagaaaaaaggagtagtgagattgtggctttgaaagttcttttcaagagccagctcaagcaatcacaggttgagcatcagctgcgacgtgaagtggagattcagagtcatcttcgccatcctaatattcttcgcctgtatgggtacttctatgatcagaccagggtttacctaatcctggaatacgctgccaagggtgaactgtataaggaactgacaaggtgtaaacatttttcagagcgacgcacagcgacttatgtcgcttcgttggctagagctttgatctaccttcatggcaagcatgttatccatcgggacattaaaccagagaatcttttagttggagttcagggcgagatcaaaattgccgactttggctggtctgtgcacaccttcaacagaagacggactatgtgcggaactctggattacctgccacctgaaatggtggagaaggcagaacatgattaccatgttgatatatggagccttggtgttctgtgctatgagttcctttacggggtcccacctttcgaagctaaggagcactcagaaacctacagaaggatagtgaaagtcgacttgaagttcccactgaaaccattcgtttcacctgccgcaaaggacttgatttctcagatgctggtcaagagctcggcgcagcggctgcctctccacaaggttcttgaacacccgtggatcgtccagaacgccgacccttccggcgtgtacagagaaggtagatccatctaagcttctgtcgcagtgtcgcccgagctgccccaccccaaactgtttggattagcgtctgtttgatgggtgggccctgggacgtgacttgatacggcaaattgccctatactgatgtatcctaccctgttgaacaatcttcttgcctctctctatatatatgaatatgaatgtacatgttctaagcctctctgaagatttttgtaacatattcaatatgacagccaatattagccctaaaagagtct

SEQ ID NO: 781 - DNA, 339 bp, Zea mays
  Clone ID: PAT_MRT4577_120168C.1
ctatttttatatcgcgagctcctataggttgtcttctttcgaggtgggtgtgaccagcggagtcttctgtttgtgaaaacccaattcttcaaccctacagggtccaacaggcaatcacaggtggcatcgcacctatatcacccttgttcctccaacactcatcagccctattacatctgttacctttggtgcatttattggcacaaaacatgagggcgcagcaacttcaacaacttgtgctagcaaacactagctgcctactctcaacaaccgcggattcttacattcaacctactagctgcgttgaactctggttcttatttgcaacatcaacaacta

SEQ ID NO: 782 - DNA, 586 bp, Zea mays
  Clone ID: PAT_MRT4577_120187C.1
cttcttgttgccaaatattccctcccctagccgccgccgccgctcgtctccctgagagtgccgggaccgaggaactggccgagttctaggtagagaatcggttttgcttgtctcatgggcgtggtttgcgtgccctctccaggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggac

SEQ ID NO: 783 - DNA, 700 bp, Zea mays
  UNSURE (1)..(700): unsure at all n locations
  Clone ID: PAT_MRT4577_120189C.1
  unsure (1)..(700): unsure at all n locations
aagccgcacgcttcttgttgccaaagaattccctcccctagccgccgccgccgctcgtctccctgagaggtgccgggaccgaggaactggccgagttctaggtagagagtcggttttgcttactccaactgcgcgaagaagccatcctgatatcccttttggcttcctcattctagtagtttaggatttcttttctgacacttagattctgaccaatctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgntggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactgccaagctcctgctcaccattccaagaatccttgagcttgctgaagagctgtctatgccacttgctgctgtgaagtactcccgtgggacgttcatc

SEQ ID NO: 784 - DNA, 1967 bp, Zea mays
  Clone ID: PAT_MRT4577_120192C.1
gggtacctcgaggccggcccgggaggcccacgctttgttaacaaagaattccctcatagccgccgccgccgccgctcatctcgccgagaggtgacgggaccgaggaactcgccgagttctaagatagagaatcgcttttcacagcctgtggtctgctgcgtagggtggtgttgaaggggagaagtttgagatctgttccagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttaccaatccccctggcctgctgctttcctgataatcgaccagttccccagtcttgctccctgcagtcctccctcctccatctccagcgttgtgttctgactcacctgcaccaatggctgttctttctgctgctgatgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggaagattgtcatcaagacctgtggcactaccaagctcctgctcacaattccaaggaatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtatctctgaaattatccctgagatggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggtgccaatctgggacatggggaaaagaacttggggcggaggcttatgactgcaacaacatggtcgagcaggagctgcctggaggcgggctcctcatctaccagagcttctgtgctgctgaagacgccgttgctagctcgcccaaatccgttcttcgctgctttgatggcgagaatgcttcaccttttgtgaaggactgcaagctggctaatcttgtctgcttggaggaagttggatgctatcgaggagaggatggagtgcttgatgagtaagacgggtttctggtgtcgatttgcttctgagttttttctttttatgtcgttgcgatctcgtggttgtcgtttggttagcagccaagccaggctattagtacgaagaatgtcatctataaacatgtgttcctatgttgccacacgctgagtcaaatacatctagctctaggtggtcagctgcgtctaccacaatgagcatacatgtatggataaatcttctgtgaaagcattcgatgaataagggttgttttcgtgattcgttttg

SEQ ID NO: 785 - DNA, 2246 bp, Zea mays
  Clone ID: PAT_MRT4577_120193C.1
cctcgaggccggccggcgatatgatgaccctttcccagatgatcgacgctgaacatactgagcgctacattttctcgttcgagaaagccaagccggaactctgattctatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgtttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttaccaatccccctggcctgctgctttcctgacaatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaaggattttgactcctatgttctctccgagtcaagcttgttcatctatcctctgaagattgtcatcaagacctgtggcactaccaagctcctgctcacaattccaaggatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtatctctgaaattatccctgagatggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaacttggtgcggaggcttatgactgcaacaacatggtcgagcaggagctgcctggaggtgggatcctcatctaccagagcttctgtgctgctgaagacgccgttgctagctcgcccaaatccgttcttcgctgctttgatggcgagaatgcagcaccttttgcgaaggactgcaagctggctaatcttgtctgcttggaggaagttggatgctatcgaggagaaggatggagtgcttgatatgagtaagacgggtttctggtgtcgatttgcttctgagtttttttttctttttatatcgttgcgatctcgtggttgtcgtttggttagcagccaagccaggctattagtacgaagaatgtcgtctataaacatgtgttcctacgttgccacatgctgagtcaatctgtatacagctagctctaggtggtcagctgcgtctaccacaatgagcatacatgtatggataaatcttctgtgaaagcattcgatgaataagggttgttttcgtgattcaaaaaaaaaaaaaaaaaaaagaagaaataaaaaaaacaaggaaagaaaaaaaaaggaaagagaaaaaaagaacagatgaggacaagag

SEQ ID NO: 786 - DNA, 941 bp, Zea mays
  Clone ID: PAT_MRT4577_120194C.1
aattcggcacgagggccaaagagattacctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctgacctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtgaccctcatgggcggggggttttgcgtgccctctcagggccaagattgactctgttctggatcttgcacggggcacaattgtgtccgagctctccacaaggatttcgactcatatgtcctctctgagtcaagcttggttatctatcctctgaagattgtcatcatgacctgtggcactaccatgctcctgctcaccattccaagaatcctgagcttgctgaagactatctatgccattgctactgtgagtactccgtgggac

SEQ ID NO: 787 - DNA, 257 bp, Zea mays
  Clone ID: PAT_MRT4577_120207C.1
agaacaggggacacaccaaaacgacttttttggtcagggggatacacaggcccgaagggcagggaccacgagtttgatacaaagacgagcagagttgcaaaagccatggggatttgttcttcttggatccatccacccctgggggggctgaaatgaaagcttccgtccggccgatttttcctgaagttgtgttcttgcatttctccaagggccttggcgccaggccaatggcttttgatcctttcatgatccaaagg

SEQ ID NO: 788 - DNA, 1572 bp, Zea mays
  Clone ID: PAT_MRT4577_120229C.1
caactcatcgggcgcggagaccaccgcggggggaaaagcgagggaggggggagaggactgaagagaaatcatggagccgatttgctgtggagattcgggcgcgtgatccggtcggatcttgctttcccggggggcgatcgaggccacgccgctgctgccgcggtgccctccctctgcctctgggctctgcgtgtgacgtgccgtgccatggcgctcgccctcgcctatatccccagcctccctcgccccgccgccggcccccgcgtccggtaaaaagccacctaccctaccctcctgcgctggtactacttactacctagccaggccaaggagcccaacgagggggaacgctgcggtaggcgcgcgctgctcgtcccaccccacgccgccatgacggtgccagatgccgagtcgcgcttccatgtcctcgcggtggacgacagcctcgtcgacaggaaactcatcgagatgctgctcaagacctcgtcctaccaagtgaccacggtggattccgggagcaaggcgctggagctgctggggctgagggacgcgtcgtcgccgtctccgtcctcgcctgaccaccaggagatcgacgtgaatctcatcatcactgactactgcatgccaggcatgacaggatacgatctgctcaagagagtgaaggggtcctcctcgctcaaggacattcctgtggtgatcatgtcgtctgagaatgtgcctgcccggatcagcaggtgcttgcaagacggcgcggaggagttcttcctgaagcccgtgaagctggccgacatgaagaagctcaagtcgcacctgctgaaacggaagcagcccaaggaggcgcaggcgcaggcgcaggcgcaggcgcagcagggacaggcggtggagctggagcctgagcagcagctggacccgcgcacgcagccggcgcacgacgcggaggaaaccgcggcagagccgccgccggccgcatccaacggaaccaccgatggcggcaacaagaggaaggcggcagccatggaggaggaggggatgctggccgtgatgacggtggcggcgccggagagcagcaccaagccgaggctgtccaccaccaccagcagcctggcggtggaaacctgagctgagaatcggacggcgaccggatcacatactactacctacgtacattaatccaccattgcgggcagtcgagaggcaaccaaccaaccaagaaccaaccgaccaaacccaggccaccgccgagaaagagctcgtcctccttttctttcgctggttcttttggttctcggagctaattaatggaatgaaggtgtgagctcctggggatggaggggcggttacgggctctaagtgaagaacaattacgacgtaccttacctagcggctgctgcttcggccggcaaattttgttgtgctcgtggtcatggacacccttgtgttcgttaggagggggtcggggtggaacggtgaaaaggaagctgtagatagaaaaggcaggcgtctcatgctcttgttgtctagtctaatttttaattttactcggcttattaatcacggtactgactagctgcc

SEQ ID NO: 789 - DNA, 1923 bp, Zea mays
  Clone ID: PAT_MRT4577_120230C.1
cattgggtacctcgaggccggccgggaccatccatcgcatccaagaattgaccgactcccagtgacgccctgtgtgctggcttggctctgcctctgtgtgttggcctgttgggtagagagagactggtgaccgaagaagcaaggaaggcagctgtgctgtgcagtgagaggtccgtgcaggcaaagcctagctgcagtggctggcttgccatccacaccacacacccacagcaaagccacgaaccaactcatcgggcgcggagaccaccgcggggggaaaagcgagggaggggggagaggactgaagagaaatcatggagccgatttgctgtggagattcgggcgcgtgatccggtcggatcttgctttcccggggggcgatcgaggccacgccgctgctgccgcggtgccctccctctgcgctctggcctctgcgtgtgacgtgccgtgccatggcgctcgccctcgcctatatccccagcctccctcgccccgccgctggccgccgcattcagtaaaaagccacctaccctaccctcctgcgctggtactacttactacctagccaggccaaggagcccaacgagggggaacgctgcggtaggcgcgcgctgctcgtcccaccccacgccgccatgacggtgccagatgccgagtcgcgcttccatgtcctcgcggtggacgacagcctcgtcgacaggaaactcatcgagatgctgctcaagacctcgtcctaccaagtgaccacggtggattccgggagcaaggcgctggagctgctggggctgagggacgcgtcgtcgccgtctccgtcctcgcctgaccaccaggagatcgacgtgaatctcatcatcactgactactgcatgccaggcatgacaggatacgatctgctcaagagagtgaaggggtcctcctcgctcaaggacattcctgtggtgatcatgtcgtctgagaatgtgcctgcccggatcagcaggtgcttgcaagacggcgcggaggagttcttcctgaagcccgtgaagctggccgacatgaagaagctcaagtcgcacctgctgaaacggaagcagcccaaggaggcgcaggcgcaggcgcagcagggacaggcggtggagctggagcctgagcagcagctggacccgcgcgcgcagccggcgcacgacgcggaggaaaccgcggcagagccgccgccggccgcatccaacggaaccgccgacggcggcaacaagaggaaggcggcggccatggaggaggaggggatgctggccgtgatgacggtggcggcgccggagagcagcaccaagccgaggctgtccaccaccagcaacagcctggcggtggagacctgagctgagaatcggacggcgaccggatcacatactactacctacgtacattaatccaccattgcgggcagtcgagaaccaaccgaccaaacccaggccaccgccgagaaagagctcgtcctccttttctttcgctggttcttttggttctcggagctaattaatggaatgaaggtgtgagctcctggggatggaggggcggttaccggctctaagtgaagaacaattacgacgtaccttacctagcggctgctgcttcggccggcaaattttgttgtgctcgtggtcatggacacccttgtgttcgttaggagggggtcggggtggaacggtgaaaaggaagctgtagatagaaaaggcaggcgtctcatgctcttattgtctagtctaatttttaattttactcggcttattaatcacggtactgactagctgcctcaaaacctgtgatggatcagttggctgctgatgttgttttcgctcagttcttttcccacaaatatgtacactcaatattcaaataaactcttttccaatatctaagatttagaattccacaaaaaaaaaaaaaaaa

SEQ ID NO: 790 - DNA, 2008 bp, Zea mays
  Clone ID: PAT_MRT4577_120420C.1
aaaaaaaaaaaaaaaaaaaaacgctgcaactgcagcttgctcgctgacttgccgccggcgagccccgctccgagcatctccgctgctgcttctgccgaatcccagagctccttctcccgcttgccccctttccctcctgtcacattgattcgattttcgtcgcccatggagctacaaattaagtgtaggaaccaattaaaagcttgccaaaactaggtgcggcggcatcagcattcagcaataccctaggcgggctctcctcgccttcacagctccaagccgtttcatcagtgaaggagcagcacagcgtcgccccctctgtctctctccgcctcggaagcgtaggcggcgcctccctccacttataccaccagctccagcttctggagtctactgcagcgccgccctgccgctcctctgcctgctcttggtcacataaactgtaactgctgggtttggctgcaagggaaagacctgaggcgtggcgttctcttgatcctctatttgtccctttattacccgctgcttgatggacgcatggttgcaggcatgggataggccaaaaatctgccgcaactgtacaatacaaccctgtgtaacttgtaaacaagaggacttgtttggaagaaacactgtgcaacaatgtgtatagaagtactagctgattttgatacgcggcctttcttgaaacaattgaatgtgttaggccgctatgaaccaatcaagcggaatgtatattgcactaagagatacattgaagattatggcatttcttgtcactgtaagccttctcctggttcatcagttgtgtgtggcagagactgctattgtagcatgcttttctcttgctgttcatcacaatgtgaatgtgatattgcgtgcaccaataaatcattccagcacagacctcttacgaaaaccaaattgattaagacagagaaatgtggtcatggattggttgctgaggatgaaataaagaaaggagaatttgttattgagtatgttggagaagttattgatgacagaacatgtgagaataggctatggacaatgaaaaggctggatgacactgacttctacctttgtgaggtcagcagtaatatggtcattgatgcaacaaacaagggaaacctgtcccgatttataaaccatagctgtgaaccaaacacagcgatgcagaaatggactgttgatggagagaccagggttggaatttttgcacttcgtgacataaagataggggaggagctgacctatgactataacataatgtacagatttgtccagtttggagcagctcaagtttgtcattgtgggtcttcgaactgcagaaaaatgctaggcacgacgaagtattcaggaagctcacagaatcatcatgccaagaagaaaaagcggaaaacaagttgtgagaattgcatacagcagtttcttcggctgtggcatccacataaaaaaatgtatgttggttgttggataattgacttcgatcaagaaactaaaatgcatactctgaagttcaatgatctccatactgaaaagttcaatttgaaggaagaagaatggcacttcttagaggtcgattttgatgaagattgatcattgaaggtaactgcaagagttggctgccatggtttgtgacagggttgccatggtttgctgcaccgccggcctactagttgggggttcatttgcgatggcagcatagacagacggacggccatttttcttccattttggagtaatagtccaagcctgaactgtgacattcgtgcatgcttatacgtgaaagtgtacctgagagcagattatacgtgaaagtgtatcagcgttgcatatgcataaaaagttgggtcccccaccgttttttttaatataaaagaaatgcttgctccctcgacaaacaagcattttcccccccctgcagctaaagtggtggcctacaaccgcaaccccccttccgttaccatcttccttttactacagtacagtactgtttccccccccc

SEQ ID NO: 791 - DNA, 2258 bp, Zea mays
  UNSURE (1)..(2258): unsure at all n locations
  Clone ID: PAT_MRT4577_120422C.1
  unsure (1)..(2258): unsure at all n locations
cgaggccggccggggcttgtctaatctctggaactgcagcttccctcggtcacttgccgttggcaagccccgctccaagcatctccgcgcctgcttctgccgaatcgcagagcccctctcccgcttctcccctctcccctcttctctcatcgttgattcgattttcctcgcccctggagcttcaaattcaagtgaaggagccagttaaggcttgccaaaactagcggcggcatcggcaatgctctagttggcctttccttccctcccagctcgagcagcgcagcgcggccctctttatctctctcggcagtggaggcagcgtcacccttcgcctaaatcaccaccaccagctctggagcgctgcgtcgccgctcctctaccatttcctggtagattggaccggaacggactaacggagtggagttctgctattgatcattgtgagttcatccccactccaatccatctgtccatggtccgtatgagctcatcttcctcggcgtctggggtcaatctgacagagcaaatcgagaatgtttttgaccaactgatcagcaaaattgaacaagcggatccagattttgacccgcggccctttttgaaacaattgaatgtgttaggccgctatgaaccaatcaagcggaatgtatatttcactaagagatacattgaagattatggcatttcttgtcactgtaagccttctcctggttcatcagttgtgtgtggcagagactgctattgtagcatgcttttctcttgctgttcatcacaatgtgaatgtgatattgcgtgcaccaataaatcattccagcacagacctcttacgaaaaccaaattgattaagacagagaaatgtggtcatggattggttgctgaggatgaaataaagaaaggagaatttgttattgagtatgttggagaagttattgatgacagaacatgtgagaataggctatggacaatgaaaaggctggatgacactgacttctacctttgtgaggtcagcagtaatatggtcattgatgcaacaaacaagggaaacctgtcccgatttataaaccatagttgtgaaccaaacacagcgatgcagaaatggactgttgatggagagaccagggttggaatttttgcacttcgtgacataaagataggggaggagctgacatatgactataaatttgtccagtttggagcagctcaggtttgtcattgtggatcttcaaagtgcagaaaaatgctaggcacaacaaagtattcaggaagctcacagaatcatcgtaccaagaagaaaaagaggaaaacaagttgtgagaattgcatacagcagtttcttcgtctgtggcatccacgacaaaaaatgtatgttggatgttggatagttgacttcgatcaaggaactaaaatgcatactctccagttcattgatcaccatactgaaaagtttgatttgaaagaagaagaatggcacttcttggaggtcgactctgatgaagattgatcattgaagttttattgcatccttgtacaaggaatagtcgtgcaagatgatattggcatgaggtgtggttaagtctcaacttccaattatgttgtgcatctttggaaaatgtaatctggccagtaacctttggaggatgaccgacttcagccgctcttttctgtgtttggtaagttggaacggagcggctctgtttttngctaggctgcagagggaggcgcgtgagctgctgcgcacggatgggagagcgagctgtgggagcgggctgggaacggagcggctccgtcccattgattttttggagcgggatggttccggatctgaggagaatatttcctaattggagccactccgttctagttactttgtaaccaaacaataacaaaactggaacagaacgactctgttctacttggctcttcaaccaaacgctacctaagtgaatcctttagctacaagcctagctttatatctttctagtttctacgttctctttagagtcacgcttgcttttgttggtccacttgcagcctattgttttggctcctttagaaatgacctttaggtcacaaactttatttattctcatagactgcattttgattcaacaacacctgttataatgtgttgggtaatctgacaatgtacaatgagttaaatatgtgttattctaacttatataagtatgggtaatgagttttatggttggaccaataaacttattagtgctttaatatttaattcatcatgtgcctct

SEQ ID NO: 792 - DNA, 913 bp, Zea mays
  Clone ID: PAT_MRT4577_120660C.1
cggccgctcgaggcggcgggccgggttacattgtacttgtggcaagtaatgttttgaactcagagcttaagttcgaggtgttttgatctgcgtatggtggacatgatctgtttatcgcaccgtttatctgaagtgattcgatatattactgttgatctttgaaaaaaaaaaatacgaccaacacgcaccggatcttgaccgatcaaaccattcagtgctcgcgctcactcacgcatcatagccaaattaagcgggaaggaaggaagggagggaggaagccatgtctgccgcggagggagccgtcgtcttcagcgaggagaaggaggcgctggtgctcaagtcatgggccatcatgaagaaggattccgccaacctcgggctccgcttcttcctcaagatctttgagatcgcgccgtccgcgaggcagatgttcccgttcctgcgcgactccgacgtgccgctggaaaccaaccccaagctcaagacccacgccgtgtccgtcttcgtcatgacgtgtgaggcggcagcccagctgcggaaagccgggaagatcaccgtgagggagaccaccctgaagaggctgggcgggacgcacttgaaatacggcgtggcagatggccactttgaggtgacgcggttcgctctgctcgagacgatcaaggaggcgcttccggcggacatgtgggggcccgagatgaggaacgcgtggggcgaagcctacgaccaactggtcgcggccatcaagcaagagatgaagccctctgaatagctcatccattgtactcatatgccacaccacttccgtctattatccctccaacttttgttgcctggccggttcactcatgtcaccatattgtatttgtattgtgtgtttatgtgtactgacgcctatgtaaaatgagcattcaat

SEQ ID NO: 793 - DNA, 1292 bp, Zea mays
  UNSURE (1)..(1292): unsure at all n locations
  Clone ID: PAT_MRT4577_120664C.1
  unsure (1)..(1292): unsure at all n locations
ccggccgggaagtccctaacccgccctcgctttgtcgccgcggcacacggttttggccgtggacaggacagttgcaccctagccccattagccgattccgagctaggagtatatgcgtatcggtagtaaccgaggagcaacgcaacatgtccacagcccgcgcgctggtaacggatccatgcgtcttggctcatcaggtgctccaagggccaccctcgcccggcctgacccacctatataaagttataaacttgtgccccaacatcatcagttcgtatcacacccaacctcccactgtaaaaaagagcagcggaacgtgcgtgcatccatccatccaattccaatcccaatcccaatcccaccagtgtccagtgctcggggaaccgacacagctcctcagcagagaagccagcacgacaagcccgatcagcagacagcaggcatggcgctcgcggaggcagacgacggcgcggtggtcttcggcgaggagcaggaggcgctggtgctcaagtcgtgggccgtcatgaagaaggacgccgccaacctgggcctccgcttcttccttcaaggtcttcgagatncgcgccgtcggcgaangcagatgtntctcgttcctgcgcgaactccgacgtgccgcttggagaagaaccccaagctcaagacgcacgccatgtccgtcttcgtcatgacctgcgaggcggcggcgcagcttcgcaaggccgggaaggtcacggtgagggagaccacgctcaagaggctgggcgccacgcacttgaggtacggcgtcgcagatggacacttcgaggtgacggggttcgcgctgcttgagacgatcaaggaggcgctccccgctgacatgtggagcctcgagatgaagaaagcctgggccgaggcctacagccagctggtggcggccatcaagcgggagatgaagcccgatgcctagtagtggcgattgcgaccagtgtttaacccatgacgcagcgccgtcacagatgtcccgtgtggtcttgcgctttagcaatttctctctggagggagcgtgtattgttatcttgtgatcgagagcctgtgtgctgcctttgcttcttgtgattatatagctactgaataaagatgtagcgttcttcagcctgttacatcgaattcaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 794 - DNA, 1843 bp, Zea mays
  UNSURE (1)..(1843): unsure at all n locations
  Clone ID: PAT_MRT4577_120666C.1
  unsure (1)..(1843): unsure at all n locations
accatccccgactcaccagagcacacaagaagacacgacctccatcggaagcacaggacagagatgagctcgtcggcggccaagaagggggcgtcgatggtggtggcgacgagcatggcggccgtggaggcgctcaaggaccaggcggggctgtgccgctgggactacgcgctccgctcgctctaccaccgcgccgtcgtcaccggccgccgcgccgtcccggcgtccctcacctccacctcctcctcctcccaggccacgagcggcagtgtggccgtcgtcgggagggctgcccggcccaggcgatccgaggaggagaagctgcacatggcgtaccacatcgtctgctggggccccaactgattatagaactaatagtagcacatttttgttctgctgtctatcgattcttttccagcctctctctttctccgtttcggtctcttccccgagcatctgtgaatggcgtgtaaaccgcatatatgtttgcttccacgcagaaagaaagaaagtgagatatgtaaacggaagagttcctaaaaaaaaaaactcccgcccaactcgctccgctcccaacgtccaacagaacggaagagcagcggaacgtgctgtgcctccatccaattccaaccccagtcccaatcccaccagcgtccagggctcgcagaagccgacccagctcctcaacagaccagccagcccgatcagcagacagcaggcatggcgctcgcggaggccgacgacggcgcggtggacttcggggaggagcaggtggcgcaggcgctcgacgtcgtgggccgtcatgaagaagaacgccgccaacctgggcccccgcttcttcctgaaattcttcgagatcgcgccgtcggcgaagcagatgttctcgttcctgcgcgactccgacgtgccgctagagaagaaccccaagctcaagacgcacgccatgtccgtcttcgtcatgacccgcgaggcggcggcgcagctccgcgaggccgggagggtcaccgtgagggagaccacgctcaagaggctgggcgccacgcacttgagggccgccgccccggagggacacttcgaggttgacggggttcgcgtaccggatcttgaccgaccgaaccattcagtgctcgcgctcactcacgcatcatagccaagttaagcgggaaggaaggaaggaaggaagccatgtctgccgcggagggagccgtcgtgttcagcgaggagaaggaggcgctggtgctcaagtcatgggccatcatgaagaaggattccgccaaccttgggctccgcttcttcctcaagatcttcgagatcgcgccgtcggcgaggcagatgttcccgttcctgcgcgactccgacgtgccgctggagaccaaccccaagctcaagacccacgccgtgtccgtcttcgtcatgacgtgcgaggctgctgcgcagctgcggaaagccgggaagatcaccgtcagggagaccaccctgaagaggctgggcggcacgcacttgaaatacggcgtggcagatggccactttgaggtgacgcggttcgctctgctcgagacgatcaaggaggcgcttccggcggacatgtgggggccggagatgaggaacgcgtggggcgaggcctacgaccaactggtcgcggccatcaagcaagagatgaagccctctgagtagctcatccattgtactcatatcatatgccacgcaacttccgtccatatccgtccaactttcgttgcttgaccggttcactcatgtcaccatattgtgnttgtattggggtgtttacgtgtactaacgcatattgtaaaatgggcattcaataaaggaacaaattgtgcgc

SEQ ID NO: 795 - DNA, 802 bp, Zea mays
  Clone ID: PAT_MRT4577_120668C.1
cattgggaccctcgaagccggccgggatatcccatccatacagctagctagcgtacggacgaataatctctatcttcacctcactagataacaccagctagcagctcgatcgctctgtcctgcaataatggccgctcgctcctcctcccaacagctggccgcggcggcggacctggcagcggcgctgctgctgctggcggcgagagccgagacgacgtctgcggcggagagctgccgcgaggtgactgcgacggtggcgccgtgcctcgggtgacgcaaagggcagcgcggcgtagccctccgcgagcgtgctgcacgagggctgcgctcgctcaacagccgcgcgtcgtcgacggcgagaacgtatttcacctgcaactgcctcaacagcatgacgggccggatcagcggcggagacagcatgaccaacgccgccaacatccccgggaagtgcggcggctccgtcagcgcgaccatcagccccaccgacaactgcaccaagatcaactgatcgatggaaccatagcggaggtatctcgctcgttggatggcagcgcacgtggacatcaccacgatgcagtcgtcaacgaatcagagatgtcctagctacgtgtgtgtcatgcatcagactggcacataataaagagacagatcatgcacccactagtgatcacttcgtctagtgtccctccgtacaatgacgccgtcgtcgacgtgtaccttacgtgacatgctgtagcacgtacgctagcagagcagcacctcaatgtccttgggtttgctttgctgggtctctgttatc

SEQ ID NO: 796 - DNA, 393 bp, Zea mays
  Clone ID: PAT_MRT4577_120776C.1
gcgcgcgtgtccccacgcaccattattgagaccaactagcaacatagaaagcacaatagtgtaccaacaatggcagccaaaatattttgcctccttatgctccttgctgtttctgcaagtgctgctacggcgaccattttcccgtaatgctcacaagctcctatagcttcccttcttccctcgtacctctcaccagcgatgtcttcggcatgtgaaaacccaattcttcaaccctacaggatccaacaggcaatcgcacctgggatcctacctttataccccttgtacgtccaacaatcatcagccatattacagcagcacacgctttggggtatttattgcaacaaaacatcgggtcaccacaaataccaccacttgtgctagcaaaccctg

SEQ ID NO: 797 - DNA, 420 bp, Zea mays
  Clone ID: PAT_MRT4577_120809C.1
cctatgcgtgcggagaaatggctccaactctcggattagtaggacctacatctttggtgccgatgattgagacagcaattggaattgttgatagcactggtggttaatctcatgttcttgtgataagtcgccgatggacaggttaccctaagggtcgttgcacaatatggacagtggactccacaggagccggatactattggtgcagtagcaagagcaagccagtttcccctggcaatcgattttgtaggggttggggatggaccatgggacatgatgcaccaagttgaagacaatatacctgttaggtcatttcacagtttccagtaagtgaatttgacggagatcaatgacgagagctttaccactgatagaaaggaggcagaatttgcattgtctgcgcttgtggaaatgccttca

SEQ ID NO: 798 - DNA, 401 bp, Zea mays
  Clone ID: PAT_MRT4577_12083C.1
cattgggtacctcgaggccggccggggtgctttcttataggtgtgttggcttctcctccccctccggttcgggttcgggttcgtgaggttctccggcgttcggtttcgagggtgagcggatcgagatggagaagacagatggtgagtaccgctgattcatcggcggactctgctgggccaaggtacgaccactccctccagaacgccttcatgacctacttcgagggcctcaagtctgagatcatcctcgatcgttagacccataggtaccgcggcttcggtttcgacaccttctccacggaggaggcgatgtgaaacgccatagaatgcatgaacagtgaggagatgtacggacgcaacatcaccgacaacgaggtccagtcccgcggagatcgcggagg

SEQ ID NO: 799 - DNA, 539 bp, Zea mays
  Clone ID: PAT_MRT4577_120886C.1
atgggagcacgtcatgtgccagggacatgacgccgctctctggcgtctctgacatcatacctacgatggggatctgcgagtctgactgtgcaccctgtggctacttcatgaatgcgatccatggctctgcattctccacagtccatgcgacgcccgacgacggatataactatgccagtgatgaggttgtgggcttggatgccactggtctgacctatggtgaccttgtctagagggcccttgagtgcttcggccccctcgattatttcgatgccgggaccatattctgcgtgcgtggccttgccgggacatggggaaaggcacttggtgcatgaggactatgactgcaacaacatggtggagcaggagctgcctgtatgcggactcctccagaaccatatcttctgtgctgctgaaaacgctgttgctaccttctccaaatctgatgttcactgctttgaccgtgagaacgtggagagtgctcctactgctatgaagaaggactacacagtgcctaatcttctatgctgggaagagga

SEQ ID NO: 800 - DNA, 136 bp, Zea mays
  UNSURE (1)..(136): unsure at all n locations
  Clone ID: PAT_MRT4577_120955C.1
  unsure (1)..(136): unsure at all n locations
tngtagaggatgaccactgcgttgctggtgcccttgagaaagaggaggattccgggaagatgaagcggtccccgagccatagcagcgtcgccgcctcctccgccgccgtgctggctgaccccgccgagaagccgcg

SEQ ID NO: 801 - DNA, 207 bp, Zea mays
  Clone ID: PAT_MRT4577_121027C.1
cacagtcaaccagcaacactcttctcttatacatactacgtcgaaggtaactcacatgccaacttccatgggtggtctcgtgcttgatctgactactgtattctctccgtcccaatgccgtgcttgcccacccaggggggggcttcctcccacagctctatgaccattcgcgccccaaggccaaggagatcgtgcagcccatgggcg

SEQ ID NO: 802 - DNA, 1727 bp, Zea mays
  Clone ID: PAT_MRT4577_121045C.1
tcggccaaaaaaaaaaaaaaaaaaaaaaaaaaaaaaaaaaaaaccccaccctggtctggtctcctctccaagcgggcagcgccgctttataactcgtcctcgggagccgggaccccaacgccgcctactccgcgctcctccaaacactgaaccctatcctagcacgagtgcacgacggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagctggggcgaacattataatcacagcatcgtatcaggctactatccaagggtttgaatcaaagggcttttcaaaagaacaaagtgaaaacttgttaacaaagagtgttcagattgcactggaagcccgtgagatgttcttgaaggaacatttggagaaatccactcctatacagcatcctattctggttgcagcagctctagggagttatggggcttatcttgctgatggctctgagtacagtggggattatggtgaagctggtacgaaagagttcctgaaggactttcatcggcggaggcttcaggttcttgctgaagcaggcccggatttgattgcttttgaaacgatccccaacaaattggaagctcaggcatatgttgaactccttgaggaatgtaacattaatatcccttcatggctttccttcaactcaaaagatggagtgcatgttgtgagtggtgattcgttaattgaatgcgctactattgctgacaagtgtgcaaaggttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcagatggtgattttgtttcgtacgtaaatgaatggtgcaaagatggggctgcgcttatcgggggctgctgcaggacaactccaaacactatcagggccatacacagaactcttaaccaaggctgccacaagcatcagttacctgtaggctgtagcatagatctgtgctccactcctgatgctctcctcccagcagtaccttgagctgtatccccgagattccttaaccagcgcgaaccaatatactgttgcgtgttctcctgcaaatgagatgttctgcacctatgtttgtaatgttgtatttctgggtttttaagctatccaacttggagatacaaccggtgaggaagcagcaacaataggtagttctacttctgagtgaggaaaaacaacttgcggctgagttaatgaagcttagtagctaccaccgttgtatgacagttgctcagagatgttatcttcattaagtgcttatattaccgctagttccctgtgaaatttgttaaaccattatatgtaagttttgtttgacaagactgcatctcctgaaactaagatcttagtttcctgctatttccctgtgaactgtgttaaattgtatgcaagttttctttaacgcatctcctgaaacgaaggtcttaatatatttctgctacccgccgtgtattgtatt

SEQ ID NO: 803 - DNA, 2162 bp, Zea mays
  Clone ID: PAT_MRT4577_121053C.1
cccacgcgtccgcccacgcgtccgatacgtacgtgaagaaccaacaggagggccgggctctcgctcgccgcgcgcacccccctctctctatctctcccgccgccgttgatctatcaccgggccgccggtccgtgactgtcgccagcggctgctggttgttgcttggttgcgtcgccgcgggagccgtgtgacccgggcgcaatgccgggagccgtgatcgtgcaccaccacacgaggtacaagacgtaccccggcgaggtcaccggcatcgccatcttctcgtgcttcatcgcctccgtcgccggctgcatcttcggctatgacatcggcctcacatccgggctgacgtcgacggagccgttcctggtcaagttcttcccctccatctacgaggagatgaagaggcaggtggtcgtcaaccagtactgcaagttcgacagccaggtcctgacgctgttcagctcctccctcttcctcgccgcgacggtggccaccttcttcgccggcccgatgacccgcgccttcgggcgcaagtggaccctgttcgccgccgcgtccgcgtacgtggtcggcgcgtgcatcggcggcgtgtccgtgaacttcccgatgctgctcacgggccgcgtcctcgttggctccggcgtcggcatctccatccaggcggccccgctctacatctccgaggtggcgccggcgcagcagcgcgggatgctcaacatcctgttccagctcatgatcacggtgggcatcctgacggcgaacatgaccaactacctggcgtccaaggtctcgggcggctggggctggcgcacccccgtgacgttcggcgccatcccggccgccgtcatcgcgctgggcgcgctcgccatcccggacaccccggcgtcgctcgtcgagcgcggggacacggccacggcgcgcaagacgctgtcccagatccggggcgtcggcgacgtgcgcgaggagttcgacgacctggccgccgcgagcgaggacgccaaggccgtgcagtgcccctggcgggagctcttcttcggcggcaagtacaagccccagctcacgttcgcgctgctcatccccttcttccagcagctcaccggcatcaacgtcatcatgttctacgcgccggtgctcttcaagacagtcggcttcaagcagaacgccaccctcgtgtcctccgtcatcaccggcctcgtcaacgtcttctccaccttcgtcgccatcgccaccgccgacaagatcggacgccgcgcgctcttcctgcagggcggcacgcagatgatcatctcccagatccttgtggggacgttcatcgggctgcagttcggcatgagcgggacgggcgacatctcggagcagtacgccatgtgcatcgtgctgttcgtgtgcgtgtacgtggccggcttcgcgtggtcgtgggggcccatggggtggctggtccccagcgagatctacccgctggccgtgcggtcggcggcgatgagcgtcacggtggccgtcaacatgttcttcacggccttcatcgggcagatcttcctcacgctgctctgccacctccgcttcggcctcttctacttcttcggcgcctgggtgctgctcatgacactcttcatcgccatgctgctcccggagaccaagagcgtgcccgttgaggagatggcgcacgtctggaagaagcactggttctggcgcaagttcgtcatcgacaccggcaacgacgcccgcaacgccgagatgaggaagaggatagcgctagagatgagctgatcatcgtcgtccatgcatgcagtctccatcgcccatgcatcatatatatgcagtaggcaggcaggcagatgaaggaaattacgtacacaagcgccaactaaaactaaacccaagtcaattacttcatatatcactcaatagctgctagaacatatatgaatggttgttgtagactgatcgtaatcccagatagttatgatatacatctttcattttaactagctagcgtatatatgtattgtacgggtatctagatttttatctgtttattctaacattcgagatctacatattttgttttggccgttcaccgtatgagatcttttgacaattttaatgccaaattatgagaacttgagtcatacttttgggaattataaaatataaatataatt

SEQ ID NO: 804 - DNA, 392 bp, Zea mays
  Clone ID: PAT_MRT4577_121091C.1
gactttcttatttctgggaagccacatacatcaaacacaaaaactttattattcgaactgtaactcataagaaatctaaaaaaggcaccacctatgatgggttgttggtataacactgttgggtttgtcaaagcaagttggctgaatggcaacaattgttgcacttgtaagagggtgccagcgttaggcgcagcgtgctggtagaacggcaactactgtggttgtgtcaagaaggcagcaaggctcacaccatctagctggctaaatggcaacatatgttgctgctgtaaataagcaggaaagctcaatgctttcaggtggctgaatggaataaactgctggtggtaggcagctgctagctacgctaatggcattttacgactgtgccaata

SEQ ID NO: 805 - DNA, 514 bp, Zea mays
  Clone ID: PAT_MRT4577_121092C.1
tttcttatttctgggaagccacaaacatcaagacacaaaaactttattattcgaactgtacctcataagaaatctaaaagaaggcaccaccaatgatgggttgttggtataacactgttgggtttgccaaagcaagttggctgaatggcaacaattgttgcagttgtaagagggtgccagcgttaggcgcagcgtgctggtagaacggcaacaactgtggatgcgtcaagaaggcagcaaggctcacaccaactaactggctaaatggtagcagctgttgatgctgtaaataagcaggagagcctaatgctttcaggtggctgaatggaagaaactgctgctagtaggcagcagctagctacgttaatggcatttgacgatggtgcaaataagaagcatagatcaatgcagctagttgcgatgaatggaagaaactgatgttcctgaaagtatgcagcaaggcctgctagcacaagctgatgaagtacatgtgccttgatgatttgtgccaaca

SEQ ID NO: 806 - DNA, 2680 bp, Zea mays
  Clone ID: PAT_MRT4577_121097C.1
actccttggggtaccctcgaggtctgcggggtaaaccaaaaccctaaagcccgggtcgggctctcttttcccctcccttttccagcacggggagcgacctgcgccgccgccacgatgccgaagcactaccgccctgcgggtaagaagaaggaagggaatgcggcaaagtacatcacgaggaccaaggcggtcaactacctgcaagttagcctcgcaatctttaggaagctatgcattctaaagggtgtctttccacgtcagccaaagaagaaggtggaagggaaccacaagacctactaccacacaaaggatattgcattcctcgctcatgaccctttgatcgagaagttcagggagattaaggtccatcgaaggaaggttaaaaaggctgttgctaagaaaaacagggatcttgcagacaggctgttgaatcggccaccaacttacaagcttgataggcttgtccttgaaaggtatccaacattcgttgatgctcttcgtgacttggatgactgccttacaatggtgcatctgtttgcggcattacctgctgttgacggtgaacgtgttgaggtcaaacgaatccataactgccgcaggttaagccatgaatggcaagcatacatatcccgaacccattctctgaggaagacatttatttccgtgaagggcatatattatcaggctgaagttcaaggacaaaagatcacctggctaactccgcatgctcttcagcaagtattaactgatgatgttgatttcaatgtgatgctttcttttctagaattctatgagactcttctaggatttgtgaacttcaaactctatcattcaataaatgtaaattatcctcctattctggatccacgtctggaagctttagctgctgagctctatgcattgtgccgatacatgtctgctggttccagaagaatgattgggaattcacaaactgacgaagtaatggaagataaggatgagaaaagtaaagctgaggaagtaattaaggaagagaaggttgtgaagaataaagcaagctcaaaagcagatgaatctgagctcagattagcacagcttcaacatcagctcccaaccaatgaacctggtgcactgatgaatcttgtagaagaatcaactgccgatgatgcagatgatgatgatactaaagattgtaaaggtttatttaagaacttaaagttctacttgagtcgagaggtgcctagggagtccctgttatttataattccagcgtttggagggactgtttcatgggaaggagaaggagctccatttaaagaaatagacgaagatatcactcaccagattgttgataggccgacacaaagccatgttttcctctccagggattatgttcaaccacagtgggtctttgattgtgtaaatgctcgtatcatattgccaacagaaggttatcttgttggaagagtacctccaccacatttgtctccttttgtggacaatgatgccgagggctacatgcctgagtatgcagagacaataaagaggctccaagctgctgctcgcaatgaggtgttgcctcttccaggtattggtgatgaagatctagacaattcactggtagcagcaatgatggatcgaacagcttctaacgaagctgctgaaaagaagaggaagctggagatgctagagaagcaatacatcgatgaactgaagaaggaaattgatggcgttgctttctctagtttgtcaaacaaggaagcagataaatcaccgaatgcaaaagatgatactcagtcagatcgtgaggaggatgccagtaaacaagaggaggatgatgatgatgatattggtactgctctcatgtctcgcaagcagagaggcctttataaggctatgaagatgggcaaagaaaagaaaaaggagaaagttgagctactcaagaagagaaaaaagaacgcggattctggcgcttcttccaagaagcggcactgatgtgtcacaaatcttcatcgcattggtgtgtcatctctagtagaaatgttaccatgatcagctctgcgtgccaatcccccatgatgggtgggttgccttttgatatctgctatgtatgcttaagatgagttcaaggatatgtaacatgaaacttgaatagaaaagttttgatctgtcttacgaagcatttagactcgttattattgtgaaacttgaatagaaaagttttgacctgttttacgaagcatttatagttattattgagaagcctggatatattgcttgccccgttttataggaaagaattattttttgggtctggaaacattgtgaacaaaccaaacttcagcttgtcagcttcagatttgatagatatcccaagcttagccagaagcatcggaaatagattcatgacccagatctgggtaagtggcgggcggaaaatggtaggcgacgaagctcgaagccatcttaagccggatgacgaagctgaagattgacaatgctgatgtttaacaaaactgaaaacgaagccttagctgaagcttcccgttgcttataatgtgctttcctgcaaaaattcttggagaaactcttgtaatatagatatggaacaactcatgtaaatttgtacataccttgtaatatatcctgtctcccttatccgtaaaaaaaaaaaaaaaaaaaaaaaagttctagatcgcga

SEQ ID NO: 807 - DNA, 175 bp, Zea mays
  Clone ID: PAT_MRT4577_121167C.1
ggggggtcctaaccatttccaccccacccttccacttttgcgttccttcgatggaactcgcgagccctcggaataaaagaaagttttggatatatactaaggcttaacctcttctacttgttttgtaaatctaatgatacatatatttaaacccacgttgtttcccttgtctctc

SEQ ID NO: 808 - DNA, 259 bp, Zea mays
  Clone ID: PAT_MRT4577_121283C.1
gccttgagggcaatccccacggggacatggggcggagcgcaggaggccctctccctggtgggcacgatgggcgggcataaccgcgaggtgacggcgatcgccaccccgatcgacaactcgcctttcatcggctcctcctcccgggacaagtccgtgctggtgggggacgcgaccaactgggtccacttcaccccggaatccggcgcaaccgccgactacggcgtccccttccgtcgcctcaccgggcactcccacttcg

SEQ ID NO: 809 - DNA, 337 bp, Zea mays
  Clone ID: PAT_MRT4577_121297C.1
cttatcctccccctcttaccaagtccttctcgggttagggttccttagggttttatggaggggcgatggcggcagctgatgtggaataccattgattagtcagcgggcttgcctgggccaccagcaacgagtagatggagaatgccttcatcttctacggcgagatcctcgactgcaaggtcatgaccaaccgggagacggggaggtatggcggcatccgcttcattaccttgctcttcaagaactacatgctcgacgctatcgacaacaagaactgcatggagctcgactgcagaaacatcaccgttgacacgacccagtccccttgcagctgctg

SEQ ID NO: 810 - DNA, 268 bp, Zea mays
  Clone ID: PAT_MRT4577_121344C.1
gcaacttcagttagcttctgtattcttcacttttcatcttggaacaaagactcactactatggcaggacgatacttcatggtggagcaaagtatagagctactgggagagggtttgttgtgcgtcatgcaaagttcgctgagaattatcggatgtactcccggagtcactttgtcaaagcactggagctgcttattcttttggttgtctacctagcttatgggagttcatacagaagctcaagtttgtatttgtatgtcacagtttcg

SEQ ID NO: 811 - DNA, 233 bp, Zea mays
  Clone ID: PAT_MRT4577_121449C.1
acaaactcatccaacatattttgggtacgtatactcataaatctctctgcaaccgctactacgccaaccatttttccacaatgctcacaagctcctataactacccttcttcccccgatcctctcaccatcttcgtcttccatatgtcaaaacccaattcttcaaccctatagcatccatcaaccaatcgcaactcacatcttacctttatcacccttgctccttcaacaatc

SEQ ID NO: 812 - DNA, 939 bp, Zea mays
  Clone ID: PAT_MRT4577_121699C.1
tcattgggtccctcgaggccggccgggggtttcgttccctctccttggccttcgtctccgccttccgacttcctctagaattcgattccctttcccaagaaaccaagaacccagccccccaccatgacgagctcctcctctccttccagaaaggcgctgagcaagatcgcttgcaatcggctgcagaaagagctcgccgagtggcagcaaaacccccccgccgggttcaagcacaaggtctccgataacctccaaaggtgggtaattgaggtcaccggagcggcgggcaccctttacgccggcgaggcttaccagttgcaggttgacttccctgagcattatcctatggaggcacctcaggtcatttttctcaatccagcgccaatgcatccacacatttacagcaacgggcacatctgcttagatattctgtatgactcgtggtcaccagcgatgaccgtgagctctgtctgtatcagtatcctgtctatgttgtctagttcgccagcaaagcaacgcccggcggacaatgaccgctatgttaggaactgccgcaacgggaggtcgccaaaggagactagatggtggttccatgacgacacggtgtaatgatctccgtggcattgcctgtcagccttctgtactgtgaactgtgatatatctcttcaagggggagatgagatgatttaggcctatttctaagcagccctctattggattgcgaagcttaccttgctgtggtggtatgtaaatgagttgctcacatgtgtcagtctgggaatatgtgttatcaccatcaatgatataatatatagaataaagcaagattgtaccctgcctgagtcactgaaacgagctcaaaagtaatgtgcaggtttgactatgatttgttttggtcaatgtgcctttgtatcagtctgcagtctgcttatgcatttg

SEQ ID NO: 813 - DNA, 886 bp, Zea mays
  Clone ID: PAT_MRT4577_121701C.1
cgcccacgcgtccgcccaccccacgcgtccggtctccgccgtgggcggacgcgtgggcgattccctttcccaagaaaccaagaacccagcaacccagccccccaccatgacgagctcctcctctccttccagaaaggcgctgagcaagatcgcttgcaatcggctgcagaaagagctcgccgagtggcagcaaaacccccccgccgggttcaagcacaaggtctccgataacctccaaaggtgggtaattgaggtcaccggagcggcgggcaccctttacgccggcgagacctaccagttgcaggttgacttccctgagcattatcctatggaggcacctcaggtcatttttctcaatccagcgccaatgcatccacacatctacagcaacgggcacatctgcttagatattttgtatgactcgtggtctccagcgatgaccgtgagctctgtctgtatcagtatcctgtctatgttgtctagttcgccagcaaagcaacgtccagtggacaatgaccgctatgtcaggaactgccgcaacgggaggtcgccgaaggagaccagatggtggttccatgacgacacggtgtaattgagcgcctgacagccttccatgctgtggtatatctcgtcaaggggagattggggatgatttaggcctatttgtaagcatccctctatcggattgcgaagcttaccttgctgtggtggtgtgttaaatgagttgcacacatgtgtcgagtctgagaatacatattaccatcatcaatgatataagtaatatagaataagcatgagtgtaccctgcctgaatcactggaacgagctcaaaaggaattacctgtgcaggtttaactataaaaaaaaaaaaaaaaaagcggccgcc

SEQ ID NO: 814 - DNA, 1573 bp, Zea mays
  Clone ID: PAT_MRT4577_121705C.1
cccacgcgtccgtcaccttactattctacattagaaaatctatactgagtgtgaaaggaagcatataccctgttggacgttgttttcacaagttctttgttgaccttggtggatttttctcagtttgtgaatgagatgaaaataatgaccttggagccccgtcaaccatggtctacaatcgccttgtaaattgtataatagctaaagcctacatcaaagtatttataccctttacatttgcgtctggagaatttactctcttctgttttccattaatccactgtccacttactcatgagttctctgagatattgaatggaacgtaaacaatttttgtggagccttgatggatgtggattacagtttactgtatggtttgtgattaacaaattcctgctgttactcttggctcgggccgggccggggggaataaagaaaaaacggaagcatcaagtctgaaactgaaaagaagggcgaatagcggtttctctgattctctccctcccttgccttcgtctccgcctcccgtctttcctcaagaagtcgattcccttccccaagaacccaagcccccaccatgacaagctcctcctctccttcccgaaaggcgctgagcaagatcgcttgcaatcggctgcagaaggaactcgccgagtggcaactcagcccccctgctggattcaagcacaaggtctccgataacctacaaaggtgggtaattgaggtcactggagcggcgggcaccctttacgccggcgagacctaccagttgcaggttgacttccctgagcattatcctatggaggcacctcaggtcatttttctcaatccagcgccaatgcatccacacatctacagcaacgggcacatctgcttagatattttgtatgactcgtggtctccagcgatgaccgtgagctctgtctgtatcagtatcctgtctatgttgtctagttcgccagcaaagcaacgtccagtggacaatgaccgctatgtcaggaactgccgcaacgggaggtcgccgaaggagaccagatggtggttccatgacgacacggtgtaattgagcgcctgtcagccttccttgctgtggtatatctcgtcaaggggagattggggatgatttaggcctatttgtaagcatccctctatcggattgcgaagcttaccttgctgtggtggtgtgttaaatgagttgcacacatgtgtcgagtctgagaatacatattaccatcatcaatgatataagtaatatagaataagcatgagtgtaccctgcctgaatcactggaacgagctcaaaaggaattaactgtgcaggtttaactatgacttgctttgctcaatgtgcctttgtatcagtctgcagtctgcttatggatttgcctatgtaaatgagttgctcacatgtgtcagtctgggaatatgtgttatccccatcaatgatataatatatagaataaagcaagattgtaccctgcctgagtcactgaaactagctcaaaagtaatgtgcaggtttgactataaaaaaaaaaaaaaaaaaaaaaaaaaaaaaaaaaaaaaaaaaaaaa

SEQ ID NO: 815 - DNA, 278 bp, Zea mays
  UNSURE (1)..(278): unsure at all n locations
  Clone ID: PAT_MRT4577_121749C.1
  unsure (1)..(278): unsure at all n locations
gacgcgcagcccgagctcttcatccacatcatccccgacaaggcgaccaacacgctcacgatcgttgacagcggcattgggatgaccaagtccgacctcgtcaacaacctcgggaccatcgccaggtcggggaccaaggagttcatggaggccctcgccgccggcgccgacgtgtccatgattgggcagttcggtgtcggtttctactccgcctacctcgtcgccgagagggttgtcgtcnccaccaagcacaacgacgacgagcagtacgtgtggga

SEQ ID NO: 816 - DNA, 1776 bp, Zea mays
  Clone ID: PAT_MRT4577_121828C.1
cattgggtccctcgaggccggccgggaaagcctcgggggccaatcgtctctccaccaggcaactcctcctgcctgtgctctcctcctttttctccactccgcttttgcttggttccatcgggccggagagggagaagctagctagctagcagcagctctgttggtgtgtgtgtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtctatgtatttgtttattccctttgcctcaaagatccatcttcagggtagccatgccggcatgaagttattcatatgctcgggagcgaacccgatctgcagggttggctctgctgcagcttccaggggatgaaagaataatccctagttctagatcgcccaacatgtgatggggcctgctgttgaggagagtgcctctcgtagccgagtaagttggcaccgtgctcccacacttggccatgcacctggttgctggtctcctccagcttttttatttgcaaaacaatcacgtgaagaaaccacattaattttttatacgaaacaagaaacctcattgatctcagaaaccccccttaaaactcatttagttggtaaatactgttatcacatgcatactgtaatagcagtcaaatgtaacaatatgcacaatgcatattttgagaggttaatatatgaattacagttatgctgccacaactgaacaacagtattccttatgcaaaacatcctgtggcggatgtattaagacaaacaccatgcatatagaagtattatccacagcagattgtgtaaaatatagaatttgtctgtatattacacatttaataagcccgg

SEQ ID NO: 817 - DNA, 1626 bp, Zea mays
  Clone ID: PAT_MRT4577_121831C.1
gggtaccttcgagccggccgggaaaggccgcccactaccctctccggctctccgctaacaaaatctagaaccctctgaaccctccacattcctccagatcgaataataacctagctctgcacaccgcccagccaccagtggcagcaggagcaggggtcggaacaagatggtggggacggcggccggcagcgcggaggaggctgtgcggcggtgggtggacgccgccggaggacgcctcgtcctcgacggcgggctggccacggagctcgaggccaacggcgccgacctcaacgacccgctctggagcgctaagtgcctcctctcctccccgcacctcatccgcaaggtccacatggactatctggaagctggcgcaaacattataatcacagcatcgtatcaggccactattcaagggtttgaatcaaagggtttttcaaaagaacagagtgaaaacttactaacaaagagtgtcgagattgcactggaagctcgtgagatgttcttgaaggaacatctggagaagtccactcctatacagcacccggttctggtcgcagcgtctttagggagttatggagcttatcttgccgatggctccgagtacagtggggattatggtgaagctggtacgaaagagttcctgaaagatttccatcggcggaggctccaggttcttgcggaagcaggccccgatttgattgctttcgaaacgattcccaacaaactggaagctgaggcgtatgtcgaacttctcgaggagtgcaacatcaatatccctgcatggttttccttcaactcaaaagatggagtgcatattgtgagcggtgactcgttaatcgaatgcactactattgctgacaagtgtgcaaaggttggtgcggtcgggataaactgcacacctccaagatttatccatggactgatactctccattcgaaaggtcacggacaagcccattctgatatatcccaacagtggcgaaagatacgatggtgaaaaaaaggagtgggtggaatccactggtgtgtcagatggtgattttgtttcttatgtgaacgagtggtgcaaagacggggctgtgcttatcggtggctgctgcaggacaactccaaacactatcagggccatacacagaactctgaacaaaagccccaacaagcagcagttacctgctgtagaataagagctgtgctctactcctgatgcgcccgccttcctcctagcagtacctcgccttcctcctagcagtacctcgagggtatatccccatgattccttaaccgtacgtgtacgttctcttgcaaacgagatgtttgtaaataacgttgtatttctgggttctgagatatgcaacttggatggaggtacaaccggtgaaggggggtgaggaagcagcaacaatggtaagagttctactactgagtgggggaaaaacaacttgcggctgggttagtgaagcttagtagctaccactattcaagagttaaagggagttcgtatgacagttcctctggagatgttatcttcaaagtcttatatcactgctacttgtgagctgtgttaaaacctatatatataagttttgtttgacgtgactgcattaaagatagtacaaaaagaaaa

SEQ ID NO: 818 - DNA, 932 bp, Zea mays
  Clone ID: PAT_MRT4577_121923C.1
gtcaagcaccgccgaggtgtccggagatattttctcatatgcatgttttgccagcatgtaaaaagtcatcttcagaaatacagaacagctagatacagaccagagttatctgaaggctcttctgaaaagaaagtggcatcaaaagaagatataccatctattgacttgaaagggagttttgatctcactgaagcacttaggctccagttggaacttcaaaagcggcttcatgaacagcttgagatacaaagaagtttgcagctaagaatcgaggaacaagggaagtgtcttccagatgatgctagagcagcagtgcatacccgggggcagaaaaaggcgcaggatgccttcaaccgctggccagatggaatttgaggtcaccttctggagattcccagaatcttctaccgtcaaggaagtttccagaaaaccgtcaaaatgggatccacccagccaaccaaattagctaaggggccgatggaagttgcaagcaggaaatgtgtttcatgatccgattgggctgtttccaggcttaaatcaagttgtttttgtccttccgtgggaacagatgaacgctatagttaacttccttgcaaagcctggctaggtgcatgtaactaggagttagctgtatattacctaccctcacggtatcactgaatcccagtgttatgcggatgatgtagtcttcagaagacagcgcaagcacattgtcaggggtttgacttgttttgccccccattacttaggtatcaagtagcgtctcctaggcatttgattatgggctaattcaagtgtttacaataatgtttagcacctgttgtttaaaacatgtcatggtaccaaatatgacgaagatgtattgcatttatatgagagaatgagagatttgaactgctttagtttggtcaaaaaaaaaaaaaaaaaaaaaa

SEQ ID NO: 819 - DNA, 530 bp, Zea mays
  Clone ID: PAT_MRT4577_121990C.1
gggttcgtgaggttctccgtggttcggtttcgcgggtgggcggatcgagatggcggggtctgatgttgagtaccgctgcttcgacggaggactcaactgggccacggacgaccactccgtccacaacgccttgcacaacctacggctaggtgctctcattccaagatcatagcttgatcgggagacggataggtcccgcgggttacgcttcgtcacacttctccacgggaggaggcgataccggaacgccatttgagggcactgaacgggaaggagctggactgcctcaacatcaccatcaacgagggccaatcccgcggcggccgttgaggcggatgaggcggatacggtggtggtcgtggatgcggaggctaccgaggtggccggcgccgtgatggcggaggcgactactgcggcggcgatggcggctacggcggcggcggtggctacggctgtggtggcggtggctaccgcggtggcaaccgcggcggcggctacggcaactccgacgggaactggaggaactgaac

SEQ ID NO: 820 - DNA, 300 bp, Zea mays
  Clone ID: PAT_MRT4577_122082C.1
gcgctggggaaagcgaacagcttgattcacagttgtgaatgtccgagtgaggcgtgcttaatgggctcaatgaacctgagctggataatatagcacggaacattcatgagctggagaggggacgcatagatgaagggaactcgactcaagttagcgaccaatcagagctgaacgacaacttgtgatccgagctcttaggggaagactttggagacacggcaagacagccatgagttggaaggaagaactgaagacgagaatgacctcgctcaacaactggggtatctgagttgtaacagc

SEQ ID NO: 821 - DNA, 455 bp, Zea mays
  Clone ID: PAT_MRT4577_12220C.1
gagttggcttctcctccccctccgggtcggtttcgtgttcgtgaggttctccggggttatgtttcgagggtgagcgtatccagatggcggcgtcctatgttgagtaccgctgcttcgtcggcggcctctcctgggccacgtacgaccactccctccacaacgccttcatcacctacggtgaggtcctggagttctagattattctcgatcgtgagacgcagaggtcccgcgggttcggcttggtaaccttctccacggaggaggcgatgccgaacgccatcgatggcatgaacggcaaggatctggacggtcgtaacatcaccgtcaacgaggcccattcctgctgaggacgtggaggcggctgcggtggctacggtggtggtcgtgcatgcggcggctaccgcggtggcggtcgccgtgatggcagcggcagctactgcggtggcggctgctgc

SEQ ID NO: 822 - DNA, 848 bp, Zea mays
  Clone ID: PAT_MRT4577_122249C.1
cccggataaaaagctttgggtacctcgaggccggccgggacttctagagtttagctatagcctcactgctagagcgccgccatggctcaggtaaggggcagtgctcgtggcactggcagtggcagcagcgccgccgcgctggcgctggtcctcctgtgcgcgctcctccgcggcgagttcgccgagtcggcggtgtacacggtcggcgaccgcggcgggtggagcttcaacaccgccagctggcccaacggcaagcgtttccgcgccggcgacgtcctcgtgttcaggtacgacgccagggcgcacaacgtggtgcccgtgagcgcggcggggtacagctcgtgcagcgcgcccgagggcgccagggcgctcgccaccgggaacgaccgcgtcacgctgaggcgcggcgccaactacttcatctgcagcttcccaggccactgccaggccggcatgaaggtcgccgtcaccgccgcctaggcactgcagggcggccaatcagccggcggagagcgccgcgctcacggagtagtaaagcacgtagctaattagacggtgctgcccttgttgttcaataatatcgtctgtcgtcccgtacttcataacctgcgcggcgtgttagtagttgtttggtggtgtttggcgactggcactataaagaagggtcagatcgagtgatgtacttgctaccaacaataaaggtatacggtttgtgtgttcaaaaaaaaaaaaaaaaaagcggccctattccaaacctatagagagctaatgaaaaaaaaaaaaaaaagttagggttgagaaagtatattaaataattagctagcctaaaaaaaaaaaaaaaagcgggc

SEQ ID NO: 823 - DNA, 384 bp, Zea mays
  Clone ID: PAT_MRT4577_122255C.1
gcaacatagaaagcacaagattgttccaataatggcagccaaaatattatgcctgatgtatgcttcttggactttttggaagcgctgctactgcgagcattttgccgcaatgctcacaagctcctatagcttacattcttccatcatacctcttaccagcgatgacttcagaatgagaaaatccaattcttgtaccctacaagatccaacacgctatcggagcaagcatgttacctttatcacccttgttccttcaacaatcatgagccctattacagcagctacctttggtgcattgattggcacaaaacataagggcacaacacctacaacaactcgtgctaagctaccttggtgcctactatcagcaacagcaaatacctt

SEQ ID NO: 824 - DNA, 1450 bp, Zea mays
  Clone ID: PAT_MRT4577_122271C.1
cattggggacctcgaggccggccggggttgttttttcttcttccgttacctctccaggcagctcctctccctctctgtcgccgacgactacgccaggtcttcttcggggcccaggtcgctgccgcctacatcaggggccccaagttttcctaggacccctcgccggcgacgagcaccaccagcttggttcactcccaacaaaatgtcagccaatgtgggtgaatcaactagcggtgtcagcagcagcgatgcagctggggggagctttgagtgcaacatatgcttcgagctgcctcaggagccaatagtgactctctgtggccacctcttctgctggccgtgcctttaccggtggctgcacattcacgcacactcgccagagtgcccagtgtgcaaggccctcgtggaggaggacaagctcgtccccctttatgggcgtggcaaggatcgcgtcgacccgaggtcgaagaacatgcccgagggcgagattcctcaccgcccaacgggccagaggcctgccacagccccccgggcccatgctaacagcaactttgccaatgccaatgccaatccatggttcccgggcgcaggagtccctctggcaaatgcgcgatgggggaactacgcattctcagctgctttcgggggactgttccctatgcttagcttccaagttcatgggtttccagatgccgccgcttacgcgcagcctgctgggttccactatggatacgggcatgggcatgggcatgggttccaccatggcgggcatatgggacaagcacaagcccatggcgtccaccgacaggcaccgttggggcaacaacagcagcaggcagatatttatctgaaggccctgctcttcatgattgtaattctagtgctcgcaagcctcctcgcgttttaaagcttgtttggcaacgtctcctcgtcatggtttggaaattgtaattctggggagtgctcctcctggcatttcagtgctgttggcatggcagtttgacattgtgatggcgtattggcctatgagaatcgccagaatatttcactgttggatctgtactatagcctggtgctgaatgtcgtataagggctagttttgcaacaccattttctaagagatctctattttctcaaagaaaattgaactggttttcttttagaaaaatggaaatcacttgacaaactagtcctaagtattgtatttgcatggactgtccatagaatatgcatctgcgtctagctaagtatctgagtttcacaacacaataaaaaagtgtgaatagaatcccgtctaaacaaggctaggctctattgggtcgtattatacaaacacataatcaattaaatacactatttctcatcgagatctgtagaatctactggaatgtaaacaacatcttaggccttgtttgggaacacagtttttccgaactacagttttttaaat

SEQ ID NO: 825 - DNA, 2586 bp, Zea mays
  Clone ID: PAT_MRT4577_122410C.1
gtcagaagaaaatacggatgacattaacattcgtggatgttatctgactgtggttgacttgtttggggcatgcttgtcacgtgactgaaagtgcccaagtgcacaagagacttcacgatattctccaaacactttcactcggttaataattgatctcttcccgcattttggcgttgtgcacatggcgaatgctgcgatgagcagctggcatatataaaactgaccgagcaagcagagatgggcagcaggagcactattatacccacaataataaacgtaagaagtttgcaggctagcagaagtaaaaaaaaacacacgcacacacacaaattaagacacgatagccagactagtccacctcctccatcttgctctcgccagcgtcatcctccagaggaggcatgtcggtgtcggcctccggagcctcgtcctcgtcgatgctgaggcccagcttgagcatgcggtggatgcggctgccgaaggtgttggggtcgtcaaggctgaagcccgaggtgagcagcgccgtctcgaacagaagcatgacaaggtccttgacagacttgtcgttcttgtcggcctccgcgcgcttgcgcagctcctccatgatggcgttctccgggttgatctccatggtcttcttggaggacatgtacccagacatgctcgagtccctgagcgcctgtgccttcatgatcctctccatgttggccgtccagccgtactcgcccgtcaccaggcagcagggggagtccaccacgcggtcagagaccacaaccttctccaccttgtcgcccagcacctccttgatcaccttgcacaggccctcgaacttctccttgagctcctccttccgcttcttctcatcctcactctcgtcgagcttcaggccctccttggtggccgagacgagcttcttgccctcgaactccttgagctggccaatagcatactcatcgatggcgtccaccatgtacaggacttcatagcccttcttcttcagcttctcgaggaagggggagttctccacggccttcttgctctcgccagtgatgtagtagatgtcattctggccctccttcatcctcgtcacatagtccttgaggcttgtcagctcatctccgctcttggtggagtggtacctcagcagctccgcaatcttgttcctgttcgtggagtcctcatggatgccaagcttcaggttcttcgagaaggactcgtagaacttgttgtagtcctccttgttctcagcaatctcaaagaacagctcaatgcacttcttcaccaggttcttccggatgaccttgaggatcttgttctgctggagggtctcacgggagatgttgaggggaaggtcctcagagtcaacaatgcccttgacaaagctcagccactctgggatcagctcctcacagttgtccatgatgaagacacggcgcacatagagcttgatgttgttcggcttcttcctggtgtcaaagaggtcaaagggggccctcttcggcacaaacaggacagccttgaactcaagctgaccctcaacagagaagtgcttcacggcgagatgctcctcccagtcgttggtcaagctcttgtagaaagcagcatactcttccttggtaatatcctcaggcttcctcatccagataggcttctgcttgttaaccaattgccactcatgagaaacctccttgatcttcttcttcttcttttccttttcttccttctcatcaacatcctcaaccttgccctcctcgtccttcttatcttcctcatcctcatcatcagaaatttccttctcagtggtcttctcagtccagagagagattgggtagctaatgaactctgagtgcttcttgatcagatccttcaggcggcgctcctcaagatactccaactgatcatccttgaggtacagggtcatctttgtacccctgccaagttgctccccagaggtatcacgtgtgacagtgaaggagccaccggcctgagactcccatacatactgctcatcatcgttgtgcttggtggtcacgacaaccctctcagcaacaaggtatgccgagtagaaaccgacaccaaactgaccaatcatggacacatcggcaccagcagccagtgcctccatgaactcttttgtgccagatcgtgcaatggtaccaaggttgttcacaaggtccgacttggtcataccaatgccactgtcaatgattgtcagagtattgttggccttgtcagggacgatgtggatgaacagctccggctgggcatccagcttgctcttgtccgtcaaactctcgaacctgatcttatccaaggcatcggaggagtttgaaatgagctccctaaggaagatctccttgttggagtagaaggtgttgatgatgagcgatagcagctggttgatctccgcctggaaggcgaacgtctccgtctcggaggccatggcgagacgaccttccacggacgcgaggatgagagcgcagagcgctagcaagcggttgcggcggcggctagaagagaagagcaccggaggagggtttgtggtgggaggcagtgtgggaccccggccggctccgagggtacccc

SEQ ID NO: 826 - DNA, 2449 bp, Zea mays
  Clone ID: PAT_MRT4577_122412C.1
ctctaaacacttttcactcggttaataattgatctcttcccgcattttggagttgtgcacagggagaatgctgcgatgagcagctggcatatataaaactgaccgagcaagcagagatgggcagccggagcactattataccgacaataataaacgtacgaagtttgcaggctagcaaaagtaaaaaaacacacgcacacacaccaattaagacacgatagccagactagtcgacctcctccatcttgctctcgccagcgtcatcctccagaggaggcatgtcggtgtcggcctccggagcctcgtcctcgtcgatgctgaggcccagcttgagcatgcggtggatgcggccgccgaaggtgttggggtcgtcaaggctgaagcccgaggtgagcagcgccgtctcgaacagaagcatgacaaggtccttgacagacttgtcgttcttgtcggcctccgcgcgcttgcgcagctcctccatgatggcgttgtccgggttgatctccatggtcttcttggaggacatgtacccagacatgctcgagtccctgagcgcctgtgccttcatgatcctctccatgttggccgtccagccgtactcgcccgtcaccaggcagcagggggagtccaccacgcggtcagagaccacaaccttctccaccttgtcgcccagcacctccttgatcaccttgcacaggccctcgaacttctccttaagctcctccttccgcttcttctcatcctcactctcatcgagcttcaggccctccttggtggccgagacgagcttcttgccctcgaactccttgagctgaccaatagcatactcgtcgatggcgtccaccatgtacaggacttcatagcccttcttcttcagcttctcaaggaagggggagttctccacggccttcttgctctcgccagtgatgtagtagatgtcattctggccctccttcatcctagtcacatagtccttgaggcttgtcagctcatctccgctcttggtggagtgatacctcagcagctccgcaatcttgttcctgttcgtggagtcctcgtggatgccaagcttgaggttcttggagaaggcctcatagaacttgttgtagtcctccttgttctcagcaatctcaaagaacagctcaatgcacttcttcaccaggttcttccggatgaccttgaggatcttgttctgctggagggtctcacgggagatgttgaggggaaggtcctcagagtcaacaatgcccttgacaaagctcagccactctgggatcagctcctcacagttgtccatgatgaagacacggcgcacatagagcttgatgttgttcagtttcttcctggtgtcgaagaggtcaaagggggccctcttcggcacaaacaggacagccttgaactcaagctgaccctcaacagagaagtgcttaacggcgagatgctcctcccagtcgttggtcaagctcttgtagaaagcagcatactcttctttggtaatctcctcaggctttctcatccagataggcttctgcttgttaaccaattgccactcatgagaaacctccttgatcttcttcttcttcttttccttttcttccttctcatcaacatcctcaaccttgccctcctcgtccttcttatcttcctcgtcctcatcatcagatatttccttctcagtggtcttctcgatccagagagagattgggtagctgatgaactctgagtgcttcttgatcagatccttcagccggcgctcctcaagatactctaactgatcatccttgaggtaaagggtcatctttgtacccctggccaagttgctccccagaggtatcacgtgtgacagtgaaggagccaccggcctgagactcccatacatactgctcatcatcgttgtgcttggtggtcacgacaaccctctcagcaacaaggtatgccgagtagaaaccgacaccaaactgaccaatcatggacacgtcggcaccagcagccagtgcctccatgaactcttttgtgccagatcgtgcaatggtaccaaggttgttcacaaggtctgacttggtcataccaatgccactgtcaatgattgtcagagtattgttggccttgtcagggacgatgtggatgaacagctccggctgggcatccagcttgctcttgtccgtcaaactctcgaacctgatcttatccaaggcatcggaggagtttgaaatgagctccctaaggaagatctccttgttggagtagaaggtgttgatgatgagcgatagcagctggttgatctccgcctggaaggcgaacgtctccgtctcggaggccatgtcgagacgaccttccacggacgcgaggatgagagcgcagagcgctagcaagcggttgcggcggcggctagaagaaaagagcactggaggagggtttgtggtgggaggctgtgtctgtgtcccggccg

SEQ ID NO: 827 - DNA, 145 bp, Zea mays
  Clone ID: PAT_MRT4577_12247C.1
acgcctttctttctcaacgccgtcatagaggagcaggaggagatcgcgcggtccaaaggctcctccggtgagcccctgacgtgggctggcaccaggcggatgcgcacgactagccgtgtgatccacgagactatgcgggtggcgt

SEQ ID NO: 828 - DNA, 439 bp, Zea mays
  Clone ID: PAT_MRT4577_122615C.1
gaaagcacaatattgttccatctatgggagccataatatcctgtcttgctatgctacctggtctttctgcaagtgctgttgcgagcgccattttcccacaatgctaagacgctcctatagacttacctttcttcccccgtacactctcaccagcggtgcttgtggtgtgggaaaacccgaccttttaaccctatatgatccaacaggcaatcgaagctggcatcttacctttatcacgcttgtttctccaacaatcatcagccgtattacagcaattacctctggtgcatgtattggcacaaaacatcaaggcgcaacaactacaacaacttgtgcttgcataccttgctgcctactctaagaaacaacagagtcttccattgaatcaacttgctgtattgaactctgcttcttatttgcaacaacagcaactaccatt

SEQ ID NO: 829 - DNA, 580 bp, Zea mays
  Clone ID: PAT_MRT4577_122667C.1
gatgctagagaagcaatacatcgatgaactgaagatggaaattgatggcgttgctttctctagtttgtcaaacaaagaaagcagataaatcaccgggatgccaaaggtgatactcagtcagatcgtgaggaggatgagagtaaacaagaggatgatgatgatgatattggtactgctctcatgtctcgcaagcagagaggcctttataaggctatgaagatgggcaaagaaaagaaaaaggagaaagttgagctactcaagaagagaaaaaagaacgcggattctggcgcttcttccaagaagcggcactgatgtgtcacaaatcttcatcgcattggtgtggcatctctagtagaaatgttaccatgatcagctcatctgcgtgccaatcccccatgatgggtgggttgccttttgatatctgctatgtatgcttaagatgagttcaaggatatgtaacatgaaacttgaatagaaaagttttgatctgtcttacgaagcatttagactcgttattattgtgaaacttgaatagaaaagttttgacctgttttacgaagcatttatagttattattgag

SEQ ID NO: 830 - DNA, 1458 bp, Zea mays
  UNSURE (1)..(1458): unsure at all n locations
  Clone ID: PAT_MRT4577_122922C.1
  unsure (1)..(1458): unsure at all n locations
cttgtcactcatcagcacggttagtatagctagccaccatgaaggtagagcgcgatctccacatgagccggggcgacggcgaggacagctacgcctccaactcaaggcttcaggagaagtccatactgaagacgaggccggtgctgcacaaggccgtggcggcggcgcacgccttgtcgctctcctcaggaggacccggcggcggcgccatggtcgtcgcggacctcggctgctcgtcggggcccaacacactgctcgtcgtctcggaggtgctagcagcggtggcgatggtggccggcggcagcgcccaaccgcagcacgtgcagttcttcctgaacgacctccccgggaacgactttaacctcgtcttccggtcgctggacctgttgaagaacaagaagctggccgccaaggacaggcgggaggagtcgctgctaccgccgtactacgtggccgggctgccgggctccttctacacccggctgttcccggaccactgcgtccacctcttccactcctcctactgcctcatgtggcgctccaaggtccccgacgagctcgccggtggcgcggtcctcaacgagggccacatgtacatctgggaaaccacgccgcaggcggtggtggccctgtacaggaggcagttccaggaggacatgtcgctgttcctcaggcttcgccacagggagctcgtgcccggtggccacatggtgctggcgttcctgggcaggaagaagagcaaggacgtgcttcgtggcgaggtcagctacacgtgggggctcctcgcgcaggctctccagtccctcgtcaaacagggccgtgtgaagaaggataagctggactccttcaacctgccgttctacgcaccttcgatggacgaggtgagggacgtgatcacgcggagccaggcgttcgacatcacccacatccagctcttcgagtccaactgggatccacacgacgacgacgacgtggagatgaagatggaagaagacgtcgccgccgtccagagcggcgtcaacgtcgccaggtccatcagggccgtgatcgggcccctcatcgcccgccactttggcgagcacatactcgacgatctcttcgagctgcatgccaaaaatgtcgcagtgcacctgcagaaagtgaagaccaagtaccctgtcatcgtcgtttccctccaggcgaaatgagccgcgcgccaaataaaggaccaagctagctgatgcaaaatctggcgtcaagttagctattagtaccgctactattatatgcatgcagaataattagtcaaacaatcagaaaaataaagtgcctcagagactgttagtggcagatccaatgtttcgttaattatatgtagtgtaatggtaatggtaatggtaatggtagacatcaggtttcatcgtccnnnnnnnnnnnnnnnnnnnnnnnnnnnnnnnnnnnnnnnnnnnnnnnnnnnnn

SEQ ID NO: 831 - DNA, 318 bp, Zea mays
  Clone ID: PAT_MRT4577_122969C.1
tctccttactaaaatcctgccttcgtattagacggatttttggcataattagcccaaatactccacttccatcaaagaaatctgaaatattgccagctcctgcctgccaacaccccatggcccgcctgaaatcaagccactagacccaataaaaacaccagttcatcgaatggcgcaggccttaaccaaggtctgtcctacagcgaagcactctagataaacacccagaaaacgtggatcctcctcgctttgggacactgttacagaaccttctataatttggaactgcttcacctctataggaaccgggaaatacaa

SEQ ID NO: 832 - DNA, 1866 bp, Zea mays
  Clone ID: PAT_MRT4577_122972C.1
aattcggcccgaggcttcagcgtatggcccgtaccccctatatggcaaccaccagctagtgagctagagagctcccctccgacgtgtcccctttgacggggagcaaaggttggggtccggtgagcatagtagcgtcaggtgagaaggtgcctttataaggctgtcctaagaagtgggcgagatatgttgttgcatcgttatcgttatggtgcctgtaactgttgtgtgtgccgtgtgcgtccggaagaattggatggaatggaactcgtggcttgttgtagtacatcagagagtcatgttattctttcaagaaattttgacttggtaataaattaaactattgtttgtgcgtcaaaaaaaaaaaaaaaaaaaaaaaaaaaaaaaaaaaaaaaaaaaaaaaaaaaaagaccatcaaacaagtgccagcgccctgctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgccaaaaaaaaaaaaaaagtcagccgccatcaccgctgttaggttctaccaggagaccttcggcgtccctccggccacgcgagctcgccgaaatggtcgcccacaggttccatcagtaccaggtggtgggtcgcgcgctgccgaccccaaccgatgagcaccccaagatctaccgcatgaagctctgggccaccaacgaggttcgcgccaagtccaagttctggtacttcctgagaaagctcaagaaggtgaagaagagcaatggccagatgcttgccatcaacgagatctttgagcgcaacccgaccaccatcaagaactatggcatctggctgcgctaccagagcaggactggttaccacaacatgtacaaggagtaccgcgacaccaccctgaacggcgcagtggagcagatgtacaacgagatggcctcccgccaccgcgtgaggtccccctgcatacagatcatcaagacagcgacggtccacttcaagctgtgcaagagggacaacaccaagcagttccacaactccgagatcaagttcccgcttgtgtaccgcaaggtcaggccgcctaccaggaagctccggaccactttcaaggcttccaggcccaaccttttcatgtgagaggtatatcgtacccgtgttctgtgtcttgagcgcccgagagataaggattcttcctgtgcaagtttttggtgccctgttcgttgagcactttgtttgattccagttaaggatttgaatgatgctgtgtaaaacaatgacttgtctgcaattagttatcaactactgctatttacctgccctgaaaaaaaaaaaaaaaaaagcggcc

SEQ ID NO: 833 - DNA, 1594 bp, Zea mays
  Clone ID: PAT_MRT4577_12310C.1
aatccaccaccgaaccatccagaagcggccgggagccgcctcctgctcttaaaaaactctcgtctctggtccggcccggcacacacccaacatcacgaaaccacgcgcagatccaaacgaacccgagcccttccaaaccctaagctcgcctcccctcccccccaaacaccaccgcgcacctatggcgaagtacggcgagggcgacaagcggtggatcgtggaggagcgcgccgacggcaccaacgtccacaactggcactgggcggagcgcgactgcctggagtggtcccgcgcgcggctctcttccctgctcgcgggcctcaccatcctcgacggcgagggcggcctcagtctccgcaccgtcgcgctcgacaagcttgatggcgaggcctacgtcaacatccgcaagggcaaggtcatcccggggtacgagctctcgctcaccctctcctgggaggccgaggccgcctcggagtccggagctgcgaaggtcaccggcaccgctgaggttccctacctcgccgacgagaacgccgacgaggaccccgacctccgcgtcaccgtgcgcggcgacgagacgcccctcgcgctccgcgccaaggacgccttcctctcccgcgggaaacccatggtgctcgagaagatccgggagttcgtcgctgccatggccaagggtggaccggccaaggacgagctggactccaagaaaactcccacgaaggtcgccggctccgcaccggcgaaggaggcggtactggctcctgcgccggctgtggagaagaaaaaggccaaggggaaggacaaggagggcttcaagaccattgagatgacggagaagttctactgccgctcaaaggacatatatgagatcttgatggatgagaacagatggaaagggtttacgcagagcaatgcgaggatcagcagagaggttggaggggaatttagcctcttcgacgggtccatcactggcgtcaacgaggagctgcaggaagggaagctgattgcacaaaagtggcggtttggaagctggcctgacggcttgtactcctcggtccggttggtgtttgatgagcccgagtctggagttacaatcataaagctcaaacaaactgatgtgccagaggaagacaagtatggaaattcaactgtggtagagaacaccgagagaggctggagagaactcatattccagcggatacgcggagtgttcggttttgggatctaaagaatctaaagaggcgatttggcatgaagttagatttcaaatttttacggggtcagaccatgcacgtcatagcaatccatgttttattcacccatttgttttccatgtccttaaacacagaacactgcatatcgtggggggtttaaaaacatctgttattcgaacgctgcaatgttgcttgctcccgaaatgagtcgacgctgatctgggttggttatcttgttgcaatgattaagaatgtgtgtcggtgtgaagcgttttagtggctatatactcggtcctcgtgttgtgttttcgttgcatttggacttcaattgagtcaatgtgtcctatagtaacgatcagatcgaaaagataaggagaaaa

SEQ ID NO: 834 - DNA, 1385 bp, Zea mays
  Clone ID: PAT_MRT4577_12313C.1
ttggggtacacctcgggcttgccgggacgcgcagatccaaacgaatgcgagcccgtccaaacacttgaggcctcgagcccgcctctccctcctcttcctctcaacaccaccggcatacccatggcgaagtacggcgagggcgacaagcggtggatcgtggaggagcgcgccgatggcaccaacgtccacaactggcactgggcggagcgcgactgcatcgagtggtcccgcgcgcggctctcctcgctgctcgcgggcctcaccgtcctcgacggcgaggacggcctcacgctccgcaccgtcgcgctcgacaatctcgacggcgaggcctacgtcaacatccgcaagggcaaggtcatcccagggtacgagctctcgctcaccctctcttgggaggccgaggccgcttcggagtccggagctgtgaaggtcgccggcaccgccgaggtcccctaccttgccgacgagaacgctgacgaggaccccgacctccacatcaccgtgcgcggtgacgagacgcccctcgcgctccgcgccaaagatgccttcctctcccgcggcaaacccatggtgctcgaaaagatccgggagttcgttgctgccatggccaagggtggaccggcgaaggacgagctggattccaagaaaactcctgcgaaggtcgccgctgcagcgcctggcgccgctccggcgaagaaagaggaggtggtggctcctgcgccggctgcggggaagaaaaaggccaaggggaaggacaaggaggggttcaagaccattaagatgacggagacgttctactgccgctcaaaggacatatatgagatcttgatggatgagaacagatggaaagggtttacacagagcaatgcgaagatcagtagagaggttggaggggaatttagcctctttgatgggtgcatcactggcgtcaacgaggatctgcaggaaggaaaactgattgcgcagaaatggcggtttggaagctggcctgacggcttgtactcctcggtccggttgatgttggatgagcccgagtctggagttacagtcataaaactcaaacaaactggtgtgccagaggaagacaagtatgggaattcaactgtggttgagaacacggagagaggctggagagatctcatattccagcggatacgtgggatgtttggttttgggatctaaagagtctatagagaggcgatttaatttggcatgatgtcctaattcaaatttttacggggtcaggccatgaatgctatagcaatccatgtttctcacccagttttttttcttcatgtcggcaaaacgcaaaactctgcatatgatggggatttgaaaacatctgttattcatcaggctaaaacgctgcagtattccttgccccc

SEQ ID NO: 835 - DNA, 3137 bp, Zea mays
  UNSURE (1)..(3137): unsure at all n locations
  Clone ID: PAT_MRT4577_123163C.1
  unsure (1)..(3137): unsure at all n locations
atttcggcacgaggccctcttccgtctctctcctatgctccacacctccacgcctctcctcaccaatggagctccccacagcccgtaactacctgcccccagtccccgccgccccgcctcgcctgaccccagtccccgcggtttatccaccacgacaccaccacctctccaccgctgggccggatcgatcgggatcgcgccgccgccgccgccctccgcactcgcgggatcctgctcctaccatgcagcagcgctgcgcccttgcccgaccgcgccggcccgccgaaccgcgcgtcccgctccccgacgaccaccccttcgtcgccgtcttctccttccttttcatccccacctaaaccaacctcctcgcagcgtaattctgccagtatctcctcatcttctctcgtcgccgggagagcgaacggatcgccgcgtgctcggccgacgggatgagccgggaggcgcagaaactcgattgcgccaccggcggcggcggcggcgtcgggataggggtcttgtcgctggacctgctgggccaggtgctggaccgcctacgggagccgcgggaccgcaaggcgtgccgcctcgtcagccgcgccttcgagcgctccgaggccgcgcaccgacgcgcgctgcgggtgctccgacgcgagccgctcccgcgcctgctccgcgcgttcccggcgctcgagcggctcgacctctctgcctgcgcttcgctcgacgacgcctccctcgccgcggctgttgccggtgccggtgggggcctcgccggcctccgcagcgtgtgcctcgcgcgggccaatggggttggctggcgcggcctcgaggcgctcgtggctgcctgccccaagctggaggcggtcgatttgtcgcactgcgtcagcgccggggaccgcgaggccgctgcgctggcggcggcggccgggctcagggagctgaggctggacaaatgccttgctgtcaccgacatggggctcgccaaggtggctgttggctgccccaggctggagaagctcagcctcaagtggtgccgtgagatctctgatatcggaattgatctgctggccaagaagtgccccgagctccgcagcctcaacatatcctacctcaaggtgggtaatggatcccttagatcaatttcctcacttgagaggcttgaggaattggcaatggtttgttgttcatgtattgatgatgaaggcctggaattgctgagcaaggggagtgattcgctgcagagtgttgatgtgtcaagatgtgatcatgtgacttcccatgggttagcttcactcatagacggtcgcaattttctccagaagttatatgctgcagattgtttgcatgagataggacagcgttttgtatccaagttggcaacactgaaggaaaccttgacaacattgaaactcgacggtcttgaagtctcggactctcttcttgaagccattggtgaaagctgtaacaaattggttgagattggacttagcaaatgcagtggtgttacagatgaaggaatctcatctcttgtagctcggtgtagtgacctaagaacaattgatctcacatgctgcaacctcagtaccaacaatgctcttgattcaatagctggcaactgtaagatgcttgaatgtttgcggttggaatcctgctctttgataaatgagaagggactaaaacgaattgcaacttgttgccccaatcttaaggagatagacctcactgactgcggagtggatgatgcagcattggagcacttggctaaatgctctgaattgagagtattgaaattaggcctatgctcaagtatttctgacaaaggcattgcgtttattagttcaaattgtggaaaacttgtggagcttgatctctaccggtgcagctctattaccgatgatgggttggcagctttagcaaatggatgcaagaggatcaagttactgaacttgtgttactgcaacaagatcactgatactggtttgggtcacttaggctccctggaggagctcacaaaccttgaactgaggtgcttggtccgcataacaggcattgggatttcctcagttgcaatcggatgcaagaacctgatagagctggacttgaaacgatgctattcggttgatgacgctggcctgtgggctcttgctcgttatgctttgaaccttagacagcttacgatatcgtactgccaagtcacggggctgggcctgtgccacctgctgagctccctgcggtgcctccaggacattaagatggtgcacctctcatgggtctccatagaagggttcgagatcgcgttgcgagcagcctgcgggaggttgaagaagctgaagatgctctgtgggctgaagaccgtgctgtcccctgaactcatccagatgctgcaggcgtgtggctgccgaataagatgggtcaacaagcctcttgtctacaaggactagaccacctgttcctcatcgtttgtgaagtttcagcgctgccatggattgccaagagcccaagacctaccaggtttgccctgtgagccatgtgagatgttctgcaatagtccttgtgagatattccgcaataatcgttgggggcgtaacatatctagcggcgattatcggctctgctccagtgtatgtacactgaggcatcggttatgttcatgtgtatagcctgcagtgggatgatccacttcctgggattactttagtgtgtttgttacttcattccgcatggtttgggcctttgaagttaaaagaatcataagaccttgttcggttattgatattacatgtgtattggagtgtattaggtgggattaggatggattttgacttgttatggatttaaaccggctcaatcctattcaatacatgtggattatccccaaaaaaaaaaaaaaaaaaaaaaaaaaaaggaaaaagaaaaaaaaaaaaaaaaaaaaaaaaaaaaaaaaatatgatccatgctttggttctttcttacttttggctgacactaccttatctgataatatgtatatgggggntctgtttcatgttatgaggtgttcaaacagcagtgggtctatgaagacattgtagtctttgtcgaatggtccatgttggggacttgttctcaaatgctatgagataagaacaatgcaacac

SEQ ID NO: 836 - DNA, 2926 bp, Zea mays
  Clone ID: PAT_MRT4577_123164C.1
ggcatcacctatccacatctttctccctctctctctcctcttccgtccctcctctctctccctctctacgccacgcctccacctccacacctgcacgcctctcgctctctctcctaacctgtcgagctgcccacagcccgtacctacctgcccccagtccccgccgccccgcctgcccgacccgcggcttatccaccacgtccaccgctgggctggatcgatcgggaccggggtcgcgccgccgccgctgccctccgcactcgcgggatcctgttcctaccatgcagcagcgctgcgcccttgcccgaccgcgccggcccgccgaaccgcgcgttccgctccccgacgatcactccctcgtcgccgtcttctccttcctcttcatccccacctaaatcaacctcctcgccgcgaaattctgctacaatttcttcatcttcccttgccgccgggagcggacggatcgccgcttcctcggccggcgggatgagccgggaggcgcagaaactcgactgcaccgccgccggcggcgggatcggggtcctgtcgctggacctgctgggccaggtgctggaacacctgcgggagccccgggaccgcaagacgtgccgcctcgtcagccgcgccttcgagcgcgccgaggccgcgcaccgccgcgcgcttcgggtgctccgacgcgagccgctcccgcgcctgctccgcgcgttcccggcgctcgagcggctcgacctctccgcctgcgcctcgctcgacgacgcctccctcgccgcggccgtcgccgacgccggcggggggctcgccggcctccgcagcgtgtgcctcgcgcggaccaatggtgtcggctggcgcggcctcgaggcgctcgtcgcggcctgccccaagctggcggccgtcgatttgtcgcactgcgtcagcgccggggaccgcgaggccgctgcgttggcggcggcgaccgagcttagggagctgaggctggacaaatgccttgccgtcaccgacatggggctcgccaaggtggctgttgggtgccccaagctggagaagctcagcctcaagtggtgccgtgagatctctgacattggaattgatctgttggccaagaagtgccctgagctccgcagcctcaacatatcctacctcaaggtgggcaatggatcccttggatcaatttcgtcacttgagaggcttgaggaattggcaatggtttgttgttcatgtatagatgatgaaggcttggaattgctgagcaaggggagcgattcgctgcagagtgttgatgtgtcaagatgtgatcatgtgacttcccaggggttagcttcactcatagatggtcgcaattttcttcagaagttatatgctgcagattgtttgcatgagataggacagcgttttctatccaagttggcaagactgaaggaaaccttgacatcgctgaaactcgacggtcttgaagtctcggactctcttcttcaagccattggtgaaagctgtaacaaattggttgagattggacttagcaaatgcagtggtgttacagatgaaggaatctcatctcttgtagctcggtgtagtgacctaagaacaattgatctcacatgctgcaacctcagtaccaacaatgctcttgattcaatagctggcaactgtaagatgcttgaatgtttgcggttggaatcctgctctttgataaatgagaagggactaaaacgaattgcaacttgttgccccaatcttaaggagatagacctcactgactgcggagtggatgatgcagcattgcagcacttggctaaatgctctgaattgcgaatattgaaattaggcctatgctcaagtatttctgacagaggcattgcatttatcagttctaattgtggaaagctcgtggagcttgatctctaccggtgcaactctattactgatgatgggttggcagctttagcaaatggatgcaagaggattaagttactgaacttgtgttactgcaacaagatcactgatactggtttgggtcacttaggctccctggaggagctcacaaaccttgaactgaggtgcttggtccgcgtaacaggcattgggatctcctcagttgcaatcggatgcaagaacctgatagagctggacttgaaacgatgctattcggttgatgacgctggcctgtgggcccttgctcgttatgctttgaaccttagacagcttacgatttcgtactgccaagtcacggggttgggcctgtgccacctgctgagctccctgcgatgcctccaggacattaagatggtgcacctctcatgggtatcaatagaagggtttgagatggctctgcgagcagcctgcgggaggctgaagaagctgaagatgctctgcgggctgaagaccgtgctctcccctgagctcctccagatgctgcaggcttgtggctgccgaataagatgggtcaacaagcctcttgtctacaaggactagacagactcgtgttcctcattgtgtgtgcagtgtcagcatcagcatgtattgtcaagatcttgcaggtttgccctggctcacgttgtgagccatgggagatattccgcaataatcgttgggggcgtaagctcccgtccccaagatgtggttatggtgtttacctttggggcacatcttgcgccatttgtcactctctgctccggtgtatttgtgtatgcaaacggaggcaccggtaatgttcatgtgtatatagcgtgcagtagaatgatcccactttctgggattagttagtgtgtaatttttacctcatttcgcatgattcgaatcttgagatgaaagaatcataaggggtatgatcgatgcattgcattcaaaaaaaaatacatgtggattttcccccaaacgaaccagcccagggatattatccgggtttggttaaaaaaaaaaaaaaaaaaaa

SEQ ID NO: 837 - DNA, 2185 bp, Zea mays
  Clone ID: PAT_MRT4577_12327C.1
ccggccgggacctccttctacaaataccctggagccctagccgcccgcgacatccgctccccgccttccgcttccctaccccccgcatcacctaccaacgccggcgccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgaggttcaggaaatcattgacatgtgtgattatgctgtgggactaagtcgccaactaaatggatccattataccatctgaacgaccaaaccatatgatgatggaggtgtggaatccccttggagttgtgggtgttataacggcatttaatttcccttgtgctgtgcttggttggaatgcttgcattgctttggtctgtggaaattgtgtcgtctggaaaggtgctccaacaactccactgatcactattgcaatgacaaaaatagtggctagtgtattggagaagaacaacttaccaggcgcaatttttacatctttttgtgggggcactgaaattggtcaagcaattgccccttgacattaggatacctttggtttcattcactgggaagtacaagggctggtctaatggttcattcctgagttaggtacaggagggggccgacctagagggaggtcctagaggtagtgcatcacttggttactcccatgatgaccatagcgagcagaatgcgatcattgttatggatgctacacctagaaagattgaaggtctttctgttgggtgcacctcggtttttagagctggatatccctacaacagaggactacacaacgttctctgattctacatataaccccacgcctccgcttccttgatcagcttgttgaggtatacaaacaagtccgaattggggatccgttggagaaaggcaccttactgggaccactgcacactcctgcttcaaaagagaactttttgaaaggcattcagactatcaaatctcagggagggaaaatcctttttggaggatctgccattgaatcagaaggaaactttgtgcaaccaacaattgtggaaattacaccttctgcaccagttgtgaaagaagaactctttggtcctgtcctttatgctatgaaatttcagaccttgaaggaagcaattgaaatcaataactctgttcctcaaggattgagcagttctatatttacaaagaggccagatattatttttaagtggctcgggccccatggtagtgattgtggcatagtgaatgtgaacatacctactaatggtgctgaaattggtggagcatttggtggagaaaaagcaactggtggtggacgagaagcagggagtgattcctggaagcagtacatgaggagggcgacttgtacaatcaactatgggagcgagctacctctagcccagggaatcaattttggttaatcctgcagaaatgttgcgcgtggatctcggtgttttctgcagacgtggatgccgtacggaaagaactgatgcaaccgcatttgagatctcagcagacttgagcagcatttattggcgtcagttgtgaaacttaaactgcaggagcatcttgtacataaataaaataagatgtttgttgctcgtgggccgtggcacattttggtaccggtgtccagtctactaataaaatctaatgcaaaacggtcataactacattctcatgcagtatgattttccggccttttgatctggaattgaaatgagcgttattcgttttgagcaaaaaaaaaaaacggcacgagggccaaacttagtgttggtgctgcttattttgatctttattacaacaaaagtaaacttgtgaactttatgtatgaatgcagtacaattgttattgtcatgaatgaaaacatgagctatgtatgaatgcaggccaattgctatgtatgaatgcggt

SEQ ID NO: 838 - DNA, 776 bp, Zea mays
  Clone ID: PAT_MRT4577_123298C.1
taccagaacaagcaagaacagctgtcgatccaattgtcacttgctctccctccaacaagctaattaaggccggtccatccctcttctagctcgtttcattatccatggctgaggagaagcaccaccaccaccacctgttccaccacaagaaggacgaggagcaggccgcggccggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatcctcccgtatcgtcgtccctccccgtgtgctacgcgtgcgtgtgtgagagtgatatcgagcgcccgcccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgtttagttgtttacgcactacaccgc

SEQ ID NO: 839 - DNA, 835 bp, Zea mays
  Clone ID: PAT_MRT4577_123299C.1
gctttttttaagcaaaatcagagctgtacgcatttttcagtcatcatatatcacaatcatacacaggtacatatacacacacgtatacacgacaggttacatatagtaaccgcttattcatccagaacgcatatacatgtacgtcgagcgggcccacctctcagtctctcgatctcactctcacacgcacgcgtagatacatatacgtgtacaacatacatatacatacatgtggccgtacgtgcacgcacacgtacgtcgtcgacgggacgtatacgattgatgggccgggagaaatgaaatcagccgaagaagtggtgcttcttctcgccggcggcctcctcggcctccttgtggtccttcttcttctcgtggtgctcgtggaaggcgaagccgccggatcccacggccgccgccgccgcgatctcctcctcgatcttgtgccggtgcgcgtgctccgggtccttcttcgcctcgtgcttctcgtagagtgcgaaggcgccggcggcgatggcgccggcctcgccgaggtgctgcttgtgcttgtgctccttctcctccttcttgtacgtgtcgtactcgtcctcgccgccggtggacaccacctccgtcaccgtggtctccgtgtactcggcggcctcgccgtacccgtacccgccgccggcgacgggctgctccagctgctcctcgtccttcttgtggtggaacaggtggtggtggtggtgcttctcctccgccatgtgtgctgtgtgcagtagtggatagtgatcgagatgtgacctttaatttgctggaggaaacagatcgagcgagtgacaatgacgctgggtcgagc

SEQ ID NO: 840 - DNA, 360 bp, Zea mays
  Clone ID: PAT_MRT4577_123323C.1
aaaaatctaaaagtgggctttcttatttctgggaagccacaaacatcaaacaaaaaactttattattgaactataactcataagaaatctaaaagagggcaccaccaatgatgggttcttggtaaaatgctgctggctttgtcaaaacaagttggttgaatggcaacaattgttgcacttgtaaaagggtgccatcgttaggcccaacgtgctggtaaaaccgaaacaactgttgttgtgtcaaaaaagtatcacggctcacaccacctaactggctgaatggtactagttgttccttctttaaataagcaggaaagttcaatgctttcaattggatgaattgaagaaattgctgggggt

SEQ ID NO: 841 - DNA, 213 bp, Zea mays
  Clone ID: PAT_MRT4577_123326C.1
aacacctatagtgagtcgtattaaccgggaggccactggctaaggcaacacaaaccgcagatcaccgatatgcacgtacggcagccaccgaagcacacgggcggagaacgactcggatatcatcagcatccacatcggcaaggccggggtccaggccagcacatcctgcgtggaggtcgactgcctcgagcagggcatcgagcacgatgggtc

SEQ ID NO: 842 - DNA, 335 bp, Zea mays
  Clone ID: PAT_MRT4577_123379C.1
agattttatttttggcaaacgtggtctacgaaggtggtgttgaaacatacattttcaatcacatcaagtaccttaaacaccttactaacataacctgtatcgtctccttgaactaccaaggctgctgacctcagtaatcctatcataatctctgattagctgtacaactgtttctggaagtatacggtgagagactcacggtccctttcatgtgttaataactctaaggagcacactcgataagttacagctactactagatagcgtgttgaggaaactctgctttgttttcttaccgtgcttaattcttttcatgtataaaaaaatatagtatc

SEQ ID NO: 843 - DNA, 3706 bp, Zea mays
  Clone ID: PAT_MRT4577_123397C.1
cggacgcgtgggcggacgcgtgggggcagttcgaatgctgagttgttggctaccttctgcgacaatattctgaagaaaggctgcagtgaaaagctcagtgatgaagccattgaagatgcccttgagaaggttgtgagattgctggcatacatcagtgataaagacctgtttgccgagttctatagaagattacttttcgacaaaagtgctaatgatgagcatgagagaagtattctgacaaagctcaagcaacagtgcggggggcagtttacttccaaaatggagggcatggttacggaccttactgtcgctagagatcaccaaactaagtttgaagagtttgtagctgggcatccagagttgaatcctggcatagatttggctgttactgttttgacaacgggattctggccaagctacaaaacttttgacataaaccttcctgcggagatggtgaaatgtgtagaggttttcaaggaattctatcaaacaagaacgaagcacaggaagctgacatggatttattccttgggaacctgcaacatcaatgcactatagaagagctatgacgtcgcatgcacgcgtacgtaagctcggaattcggctctgcgaacaagggaggatgtacacaggacgtatcctgtgtgctgaaatgcaaaacacgcccaacccttcatgacgctccacgcgctcgtctctctccttccttccatcctccctccctccttccctccctcgctcgcctctggaggaccctcgccatcctccccaagcgcaccaccaaacccccagcagcggcgctagggttcgcgcctcggcgcgtcggcaccgtcacctgcggtgatggcagggcaggagcgtaggacaatcgatctggaggagggatgggcgtttatgcagaagggcatcaccaagctgaagaacatcctcgagggcaagcccgagccgcagttcagttccgaggactacatgatgctctacacgacgatatacaacatgtgcacgcagaagccgccgcaggactactcacagcagctctacgacaagtatcgggagtcgttcgaggagtacatcgcctccatggtactaccttcattaagggagaaacatgacgagtttatgctgagggagctagtgcaaaggtggtcaaaccataaagtcatggttcgctggctgtcacgcttcttttattaccttgaccgatacttcatatcaaggaggtcacttacaccacttaaagaagtgggtcttacttgcttccgagagttgatctatcaagagattaaaggacaagttaaagatgcagtgatagctctgatagacaaagaacgtgagggtgaacagattgaccgggctctgttgaagaatgttttggatatttttgttgaaattgggttgggtcaaatggagtgttatgagaatgactttgaagatttcttgctcaaggatactacagagtactactctgtcaaagctcaaagctggattcttgaggactcatgcccagattacatgattaaggctgaggagtgtttaaagcgggagaaggagcgagttggtcactatttgcatattagcagcgaacagaagttattggagaaagtgcaaaatgaattgcttgctcagtatgcaaccccgctgttagagaaggagcattctggatgttctgctttgcttcgcgatgacaaggttgaggatctttctaggatgtacagactcttctccaaaatctcccgtggtctggagcctatttcaaacatgttcaaaacgcatgtcacaagtgagggtacagccttggtcaagcaagcagaagattctgctagtaataagaagccagaaaagaaggatatggttggcatgcaggaacaggtctttgtgtggaaaatcatcgagctgcatgacaaatatgtagcttatgtgacagaatgtttccagggacatacactcttccataaggcacttaaagaagcctttgaggtcttctgtaacaaaggtgtctctggcagttcgagtgctgagttgttggctaccttctgcgacaatattctgaagaaaggctgcagtgaaaagctcagtgatgaagccattgaagatgcccttgagaaggttgtgagattgctggcatacatcagtgataaagacctgtttgccgagttctataggaagaaacttgccagaagattactttttgacaaaagtgctaatgatgagcatgagagaagtattctgacaaagctcaaacaacagtgtgggggacagtttacttcaaaaatggagggcatggttactgaccttactgtcgctagagatcatcaaactaagtttgaggagtttgtagctggacatccagagttgaatcctgggatagacttagctgttactgttttgacaacgggattctggccaagctacaaaacttttgacataaaccttcctgccgagatggtgaaatgtgtagaggttttcaaggaattctatcaaacaagaacaaagcacaggaagctgacatggatttattccttgggaacctgcaacatcaatgctaagtttgatgctaaacctattgaacttattgttacaacatatcaggctgcattgctactactgtttaatggatctgacaggcttagttattctgagattgtaacacaattaaacctgtcagatgatgatgtagtgcgtttgctccattctctttcttgtgcgaagtacaagatccttaacaaggaaccggcaaatagatccatctcgcccaatgatgtttttgagttcaattcaaaatttactgacagaatgagaagaattaagattccactgcctcccgttgatgagaagaaaaaggttgttgaagatgttgacaaagacaggaggtatgcaattgatgcatcaattgtgcgcattatgaagagccgcaaagttatgggtcatcaacagctggttgctgaatgtgttgagcagcttagccgcatgtttaagccggacttcaaagccataaagaagaggattgaggatctcatcacaagggactatttggagcgcgacaaggacaacgccaatacgtacaaataccttgcctgattggtggttagtgacaaagtccaaaacagctccgggactatgcgataccactgggatggcaatcttcctgcaatgtcgtggtgcgtccacttctaccatgatttgcagcacgttttggtgatttgccctgccacagcacgggctgctcacattttgtacattggtcgttaaataggataagcgtgttggcctacattagatataatgatgattgatgatatgaggaataggagaggcattcaagtacttgtatgtgtcttctatgccaatgctttatctatatagctgtatcagtgttccagtcaattgatatgagatgatgcttggagtcgttttgctatatgaagtgacggatacaatgggaatttgcagcatccgtttgtatctgaatgcacctgcttttgttttataggtagatgcgtattctggctccgttgtcacctgttggtttgtggaggcagagtggattggtcagctagctgacggaagtcactgactcactagaagctattaagtggttttgtacttactgagtcaaatatatgtcatacgttgaaaccatgtttcgtaattatgaatagtttctttaaaattaaatttaaaaaaaaaaaaaaactcgagagggggc

SEQ ID NO: 844 - DNA, 287 bp, Zea mays
  Clone ID: PAT_MRT4577_123473C.1
gttggcgtctcctcgcgctccggttcgggttcgggttcttgaggttctccggggttcggtttcgtgggtgggctgatcgagatggcggcgtcggatgttgagtaccggtggttcgtcgtcgagctcgggtgggacacggacgagcagtcactccacgacgccttgagcagctacggcgaggtcctcgactccaagatgatcctcgatcggtagatgcagaggtcccgctgcttcgggttcgtcagcttctccacggacgaggcgatgcggaagcgatcgatggcatg

SEQ ID NO: 845 - DNA, 225 bp, Zea mays
  UNSURE (1)..(225): unsure at all n locations
  Clone ID: PAT_MRT4577_123484C.1
  unsure (1)..(225): unsure at all n locations
acggcnatccaattgtacttgctctccctccaacaagctaattttttccggttttccctcttctagctcgtttcggtatccgtggcggatgagaagcaccaccaccaccacctgtttcaacacaagaaggacgaggagcagctcgccgcccgcgggtaccgcgagtccgccgagtacacagaggccactgtgaccgaagtggtgtccaccggccaaaaccatttc

SEQ ID NO: 846 - DNA, 744 bp, Zea mays
  Clone ID: PAT_MRT4577_123502C.1
caacggcgctccaactgcactactgcagccaggctttttgcttgcttccgcgggctccgcgtccgcgtgcgataggctcaatatcctcgccagcggatcccttccttgcgaggccggaactgagctgccgccggcgctatggtgagcggcggcctggcggctgcgtcggaagtcgccgtcgttttcctcatccgccctgtccttgccatcgccttcgtcttcaccctcatcctcctcagctggtacgtggcgtggaggacggtgctggtgcacgtgccgctggtgcaggagatcgccggcctgcgcccgaaaaagccctctaaacccaagccagccaaccgcggccgcttcgccaagttctaccagaaccaggccgaagccgcccaaaggaacagcaaatcagaaggggcatcatcttaagagaaagcagtcaccgccttgtaatgagtacctgccgcagactttgttatgcagttctaattagaatgcaagtactaccagtgacggcgtctttttaggagagaatgtatatcagcatgtgatgggagcatccctgcctgacgatacatcaggcttatgatagtagcgtatcaactgtttattgcatgaccttgtaaaggaccttatgattgtacatatatatacacctgtatacaagaaataaagagaagcacatgtcctttgaaaaaaaaaaaaaaaaacttctcctgcgtaaaaaaaaaaaaaaaaaaggcccctagggcc

SEQ ID NO: 847 - DNA, 287 bp, Zea mays
  Clone ID: PAT_MRT4577_123508C.1
gctggctttttcttcctctcttaccaagaactcttcgggttagggttacttaaggttttgtggaggggcgatggctgctgctgatgtggaataccgttgcttagtcggcggacttgcctgggccaccatgaacgagtctgtggagaatgccttcgcctcctacggcgagatcctagactacaaggtcatcaccgaccggaagacagggaggtctcacggcttcggcttcgttaccttatactactagaacttgatgctagacgctatacagaacatgaacggtaagg

SEQ ID NO: 848 - DNA, 2472 bp, Zea mays
  Clone ID: PAT_MRT4577_12375C.1
gccggccccctcgtcattttccccgcagcgacgacgattcagtgaggcacccctctcctggcctcttctcgccttctccgtttccgcgaacccagctgcctcgtagccccaccacaccgccgagcacgcggtctcccgcgccgccttccacccaagcgaagctacccctactcgacccagaattatcttctaccagcgctagtccgctccgcctctctactggctgccgtggagtggggatccgtccggacttccttctttcgctgttgatgtcatcatgctgagcattttgtggtagagacgatcatctctttgggttccagcatataactcatgcccataaaatttgcactagaaaatatgtcgacacaagcctctaaccggtcatacagatatccagacagaacccaactgccgtaccacaatggcaatccaatgcatgttgggggcaatggtaattactgtgtgcaacaaaatcacgatgatgttaactacatttcctctgatgatggatcacagagcagtagttctagagttcaagattttcaagcacagttttgcaccctagattcgtcttcggccaattgtgtttatcctgcacatagttctacctcttctcagagcataagtggaagccctctgtctcagcaggagagccactctgatcatgcatatggttcctctccaagtgcatcgtgcatcactcaggttcccacctggacacttaaggatctagaaaatgtgatgcttggacccgattctgacataggtagccctgacagttcctttctgcttgacactgccttgcatggaaataactggagagaacttttgggaattcaaactggggatttgaggcaggtaattgtagcatgtggtaaggctgttgacgagaatgctgtctatatggatgcattgatgtctgagttaagggagatggtttctgtctctggtgaaccgatgcaacgtctgggagcttacatgttggaaggcctcattgcgaggctttctttcactggacatgccttgtataaatctctgaagtgcaaagagcctgtggctacgagttctgagctcttgtcctatatgcatcttctttatgagatctgtccattcttcaagttcggttacatgtctgccaatggtgccatagctgaagcggttaagggggaagacattattcacatcatcgattttcaaatcgctcagggtagtcagtggatgactatgatacaggcccttgcttcaaggcctgggaggcgaccatacctaaggatcactggcatagatgactcgaattctgctcatgcccgaggtggtggactggatatggttggacagaggttgcacagaatggcccagtcatgtggtctgcccttcgagttcaatgctgtgccagcagctagtcatgaggttgtgtttgaagatctttgtctaagatctggggaggccatcgttgtcaattttgcttatcagctgcatcatactcctgatgagagcgtgggcatagaaaaccatcgtgatagaatactgagaatggtcaagagcctctctcctaaggtggtaactcttgtagagcaggaggcaaacacaaacacagcacctttctttcttagatacatggagactcttgattattacacagcgatgtttgaggcaatagatgttgcttgccccagggatgataagaagcgcattagcacagagcaacactgtgttgcaagggatatcgtcaatttaattgcttgtgaaggtgcggaaaggatagagaggcatgagccttttggaaaatggagggcaagacttgtaatggctggttttagaccatacccgttaagtccagtggtgaacagaaccatcaaaacactgcttgacagttaccacagccattacaggcttgaggagagagatggcatcctttatcttggctggaagaacagaaagctggtcgtatcttctgcctggtgctgatatttccaacttcttctaagaagcattgttaagattctttcgtggcttggggttcaggcgttcagcacatgaatccaaggtggaaccgaaacttcagtatgaagactgcacaatcaaaaaagaacaagctggttgcttccttactatttgttgcccagccttgaaactctcccacgctcaccatcatcgctgatgtacttaccatgactcagttccatccttatatataggtgcaaacaatggtttcatcaccccccttgtactggtcttaatattgtatgttggtagaatctggtggtattagcttccaaatctggattgctgaatcgtttgtgttactacatttagccaggatttgacagtagacacaaggagtgctgtaagatcctgtatgtacaacgtgcttcagttggtgtattgtacgtacttgggtgctatggctggtttggttatcacagtgctgagtgctgcactgttcggcgttttttaaaagccatgggg

SEQ ID NO: 849 - DNA, 601 bp, Zea mays
  Clone ID: PAT_MRT4577_123928C.1
gtaagacatcgattctatgctgttggatttagcatactaatatgccatgagctgcggaactgcatctggagcaatgttcaggaatcttcgtctattgatactgtaggttcaattgcttcagcagttggcattgttttagacaatttttgtttgattctgcattgatgacaaaggttttcccaaatggtttcccacttaggttgaaaatgatgatttgattgcctacggcctgatcccagaatttattggaaggttgccaataacagttggcctgaccaatcttagtgaagagcaattggttcaagtagtaaatttctttgattttataatttaaagcaatatttcttaaaattaccatctcaaatatttccaccacctcaaaatattagaaattctctttgcaggtgctcatggagcccaaaaacgcaataggaaagcaatacaagaagctattcaaaatgaatgatgttagtttgtgattcgtttcggccaacgaaataattgcaagatttggccgattttttttactttaaacgataatttataaccaagaaagttatttttggtcatgtttcctccataaagtcaagcttcattttac

SEQ ID NO: 850 - DNA, 804 bp, Zea mays
  UNSURE (1)..(804): unsure at all n locations
  Clone ID: PAT_MRT4577_124010C.1
  unsure (1)..(804): unsure at all n locations
cgggactcccccaccacacaccccaccccaagcccccacctccattttttccagtcaggttcacagcgagaagcaacagcaaggcaagctagctacacgccgatggccaaggacgaggtgatggagaccggcggcggcggcgacttcgcggccaaggactacacggacccgccgccggccccgctgatcgacgcggcggagctggcctcctggtcgctctaccgcgccgtcatcgccgagttcatcgccacgctgctcttcctctacatcaccgtggccaccgtcatcgggtacaagcaccagacggacccggccgtgaacaccgccgccgacgcggcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtctccctggtccgcgcgctgctctacatggtggcccagtgcctcggcgccatgtgcggggtcggcctcgtcaaggccttccagagcgcctacttcgtcaggggcacggcggcggcgccaacacgctcgccgccggctactccaagggcaccggcctcgccgcggagatcatcggcaccttcgtgctcgtctacaccgtcttctccgccaccgaccccaagcgcagcgcacgcgactctcacgtccccgggctggcgcccctcccgattggcttcgccgtgttcatgggtcacctggncaccatccccatcaccggcaccggcatcaacc

SEQ ID NO: 851 - DNA, 1287 bp, Zea mays
  Clone ID: PAT_MRT4577_124012C.1
attgggtccctcgaggccggccggggtcaaaagcgagagagctaagctaagccgagctaagaagcacagcaagtctcaccagactagcggctagcgcgagaatggccaaggacatcgaggccgcggcggcgcacgagggcaaggactactcggacccgcccccggcgccgctggtggacgcggaggagctgaccaagtggtcgctgtaccgcgcggtgatcgccgagttcgtggccacgctgctcttcctctacatcacggtggccacggtgatcgggtacaagcaccagacggacgcggcggcgtcgggccccgacgcggcgtgcggcggcgtcggcgtgctcggcatcgcctgggccttcggcggcatgatcttcatcctcgtctactgcaccgcgggggtgtcgggtgggcacatcaacccggccgtcaccttcggcctcttcctggcgcgcaaggtctcgctggtgcgcgcgctgctctacatcgtcgcgcagtgcctcggcgccatctgcggcgtcgggctcgtcaagggcttccagagcgccttctacgtgcgctacggcggcggcgccaacgagctcagcgccggctactccaagggcaccggcctcgccgcggagatcatcggcaccttcgtgctcgtctacaccgtcttctccgccaccgaccccaagcgcaacgcccgtgactctcatgtccccgtgcttgcccctctccccatcgggttcgcggtgttcatggtccacctggccacgatccccatcaccggcaccggcatcaacccggccaggagcttgggcgctgctgtcatctacaacaacgacaaggcctgggatgaccactggatcttctgggtgggtccattcatcggcgccgccatcgccgcggcgtaccaccagtacgtgctgagggccagcgccgccaagctgggatcgtctgcctccttcagccgctagatcgatggcctcccgccggacaaggacagccggaggcgtgaactgtagatataccagaggctggacaaggacagcgtgtcgtcgttggttgcctctagccatgatgcgtcgttatatatgcatgccttatgatcagtttgtatttccactgcattttgcttgctttaattttccttccaagctagtgtgattgttgtgctgtacttatccgtgtacgacgagtcgacgactgggtaaaatgaaaaagaaaagaaaaaaatgcatatatttaagtttttaaaaaaaaaaaaaaaaaaaaaggacgaccgttcgcgatcctagaactagt

SEQ ID NO: 852 - DNA, 1369 bp, Zea mays
  Clone ID: PAT_MRT4577_124015C.1
gacctcacgcactcatccattcgaccattccttaacatccttgttgcaagcggcgccagctttgctcgcgctctctcgcagctgctacgctaaagcaagcctagtctctagaggaggaggcggagggggaggccatgggcaaggacgacgtggtcgagagcggcgcgggcggcggggagttcgccgccaaggactacacggacccgccgccggcgccgctggtggacgcggcggagctgggttcgtggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtcggggtgctgggcatcgcctgggctttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtccacctggccaccatccccgtcaccggcaccggcatcaacccggccaggagcctgggcgccgccgtcgtctacaacaaggacaagccatgggatgaccactggatcttctgggtgggccccctcctgggcgctgccatcgcggccttctaccaccagtacatcctccgggcgggcgccatcaaggctctcggctccttcaggagcaacgcgtgatgagcggggcttggctgtggagcaatggcgggcgacctacgggcggggggccgtgagcgaggagaatgccatcattcatcgatcgacttggtggttggttcgggtcgccttttttttgtttcagcagctgctgcgttgcgcgcgtgcgtgagatttggtttggtttcgttcccctgcaatgtaatcatgtcgtgactctcaagggattattccgctctgctcttatggcctctgttttctatttaatgattgttattaccatgtagcagtaatcatcgtcatcagtgagaatcttgttgcttctgtctaaatcaaccgagacgtgtggagtggatggatcgttcattcaaaaaaatgaaaat

SEQ ID NO: 853 - DNA, 2744 bp, Zea mays
  Clone ID: PAT_MRT4577_124085C.1
atatctcgagaacgaggcaccaatcttaggtgacttggtgtgcgcaatgaggggctgtgtcagaaataagtgaattggattgtagaatttcagaaataagtgaattggattgtagaaaaaaaaaaaaaaaaaaaaaaaaaaattaaaaaaaaaaaaaaatttccggatcttccgaggcatcgtgctcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggccgattgcttgctggaattggtatcggggtctcatctgctcttgtacccctttacatatctgagatctcaccaactgaaattcgtggaacacttggtaccgttaatcaactttttatttgcattggaattcttgcagctttgttagctggattgcctctggcaggaaatcctgcctggtggaggacaatgtttggaattgctgtagttccatccattctgctggctgtaggaatggccttttcgcctgaaagccctcgttggctattccagcaaggaaaggttactcaagcagaattagctgtaaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgctggtataaacgctgttgtatattactctacatcggtgttccgtagtgcaggcattgcatctgatgttgctgctagtgctcttgttggagcagccaatgtttttggtactatggttgcatcttctctaatggacaaacaaggaaggaaaagccttctgataacaagcttttctggaatgggtgcttcaatgctactcctagcattgtccttcacctggaaagctctggcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtgagcaagtttgggatcagcaacgtgtatctgggatttgcatcagtatgtgcccttgcagttctgtacatagctgggaatgtggtcgagaccaaggggagatcacttgaagagattgaaagggagctaagtgtagcagaatgatgtacttttgctagtcatgctgtggcgccgttttggttatcgagaatgcaaccaagcgctcaaccgagcatccttggacctggagactctttctagtttcatgtagttttagaaataagcgaacggcaagagtaccaatcttaggtgacttggtgtgggttgtgtctgaaataagtgaattggattgtagaatttcagaaataagtgaattggattgtagaatttcagaaagtgtgttccccttattttttcgctgcagttccttccatgctagacaaaaaaaaaaaaacagttaccaatcagattcagaaacaatgaactcgtcgatgtttctggagataagttttcattttttgttctaaaatttcttgtttctcttgtataggagactttgagatagtttcagctctaaagacgtgaatatggagcagctccgctaacgaatctaggattcactagtaaaatgtttagctatacactagctctagatttacgaaacagaggtctcccttggaatgacttgttttgctcttgatgttggctgacatccttcgaagcaatttggagtaaaaatacacaatgaaatactgtcatgttaaaaaaaaaaaggcttgttcggttatttccaatcagtattgtttggttatttccaatccgtatggatagtggattgagcgggattgatatgtattttgacttgttatggatttaattcggctcgagatctcatccaatgtacatggattaacatcaaaccgaataagccctgagttggactgtgaatttcagaaataagtgaattgagaaataagtgaattggattgtagaatttcc

SEQ ID NO: 854 - DNA, 195 bp, Zea mays
  UNSURE (1)..(195): unsure at all n locations
  Clone ID: PAT_MRT4577_124209C.1
  unsure (1)..(195): unsure at all n locations
ngcaggaaggcgcccgcccgaacgggattaaataccgcggggcgcgcccgggcttgagcgagctgcggggccccatcaaccacgtcaagtgcatgagggaggttctctggcagcgctttggcttccccagcgacggcgttatcatgctcactggcgaccagaaggagccgtttcgggtgcccaccaaggacaaca

SEQ ID NO: 855 - DNA, 679 bp, Zea mays
  Clone ID: PAT_MRT4577_124368C.1
acactcctatgggcgattgggaccctcgaggccggccgccggccggcataccttatcacttccatccaacgactctacctactacacttcagtatacacccagcgtgtataactttatcatcacaaccgttactacacacctcaaacaatcaacatgactggacgcggcaagggcggaaagggtctcggcaagggtggtgccaagcgtcaccgaaagatcttgcgagacaacatccagggtatcacaaagcccgccatccgacgtctcgctcgtcgtggtggtgtcaagcgtatctctgccatgatctacgaggagacccgcggtgtcctgaagaccttcctcgagggtgtcatccgtgacgccgttacctacacggagcacgccaagcgaaagaccgtcacatctcttgacgttgtctacgccctgaagcgacagggacgtaccctctacggtttcggtggttaagctctttttgttttacatgcctgttacgaatctttgcggtcgactgcttgcagcgcaggaccttgtagggtgtttcatgatgacattgggtccggttattgtttttgggtgttatgtatcataagggatttgggggattacattcggggataatcgaaaatgcccctcgaggcgatattgatcaccaaaaaaaaaaaaaaaaaacccgcggcc

SEQ ID NO: 856 - DNA, 655 bp, Zea mays
  Clone ID: PAT_MRT4577_124370C.1
ccggccggactcttctcactcagcatctcaaacgcgtcttccaaccaaacgtcatttgcaacatcgcgataacgcgccacattcatctcttttcatcaaacacttatcttcatctatcaatatgactggacgcggaaagggcggcaagggcctcggcaagggtggtgccaagcgtcaccgaaagattttgcgagacaacatccagggtatcaccaagcccgctattcgacgtctcgctcgtcgtggtggtgtcaagcgtatctctgccatgatttacgaggagacccgtggtgttctcaagaccttcctcgagggtgtcatccgtgacgccgtcacctacactgagcacgccaagcgcaagaccgtcacctctctcgacgtcgtttacgctctgaagcgacagggccgtaccctctacggtttcggtggttaagcagctatctgcacaccgaatggttcgtttggctttgcgaatgattgcacagtcgcacatttgcagatactgggatggatgtacttgactacggcgttggggaaacacggatatgatattaccatcaggcgtcatggaagacgaccttgcgaaatgaataccacattgaacattgattaatcaataaaaaaaaagaaaaaaaaaaaaaaaaaacccgcggcc

SEQ ID NO: 857 - DNA, 444 bp, Zea mays
  Clone ID: PAT_MRT4577_1243C.1
tgcagtgcccgtagcctccctttacccttacctcccttcctatccccgcgggccgccagaggcaatttcgccctcgattcgaccccgattcgtacgcccgtgaccgggattgcctgcgccaagcgcggatctgaacgctgcgctacgtgtcgaccactcgaatccggatgaagggggccaaattcaagggcgccgccaaggccgatgccaagctggcggtgaagagcaagggggcggtgaatcccgccaaggccaggatggggaaggccggcatggaccccaacaagcctaagagggctcccagcgcttgcttcgtgatcatggaggaattgcgcaaggagagcaaggagaagaaccctatgaacaagactgtcgctgctgcgggaaaagctgctggcgacaggtggcaatccctgggcgagtgggacatggctccctatgtag

SEQ ID NO: 858 - DNA, 319 bp, Zea mays
  Clone ID: PAT_MRT4577_124450C.1
aaggaaaaacaaaatggggggacatatatttctccatacatctatgctcattgggggagacgcaactgaccacctagagctgcctacttacttattcagactgatccagcatgtgggaacatcggaagtttacatgcgtacagacgacaaattttcataacaatagcctggcttggctggttcacataataaccaaacgacaaccacgaaattgtgacgatttaaaataaacaactcaaaagcaaatcgacccccgaagcccgtgttactcataaagcactcccgtcttcttcttcatggcatccggttcctcctccca

SEQ ID NO: 859 - DNA, 384 bp, Zea mays
  Clone ID: PAT_MRT4577_12447C.1
ccgactcgtacggagcggattatcctaccactacggttcgggttcggattcgggagggtcatcctcgttcggcttcgtgggtgagcggatcgagatggcatgcgtccgatgttgagtaccgctgctacatctgcggtctctcctgggccactgacgaccactgcgtccacaacgccttcagcacctacggcgaggtcctagagtacaagatcatcctcgatcggtagactcagacgtccagcagcttcggctttgtcaccttcttcacggatgaggcgatgcggaacgccatcgcaggcatgaacggaaaggatctggacggacgaaccatcaccgctaacgatgcccaatcccgctgcggactctgaggcagaacaggtgggt

SEQ ID NO: 860 - DNA, 1806 bp, Zea mays
  UNSURE (1)..(1806): unsure at all n locations
  Clone ID: PAT_MRT4577_12449C.1
  unsure (1)..(1806): unsure at all n locations
cgaaaccgctagaggcagagggaggcgcagcacgaggaactcgttggtggcatcgagcgagcggtgcgagtggcacgagtgcgtgcgcgagcaagatcggagcttttccttcgtcgcagttgtggggaacgcggcgagcgcttccgtgatgggcgccggcgcccaggaggatgaggaggagataaccacggtggccgagggaggagtcggagaggaggagcaagcggcggctgagggcgcaggggaggaggagcagttggagcagggtgcagggggcgagggagagggtggggaggagaaagctccggcggtgatgttgtgctcgatctgcctcgacacagtggtcgccggaggcgaggagaggtccaccgcgaggctgcagtgcggtcacgaatttcacctcgattgcattggttcagcatttaatgccaaaggaatcatgcaatgccccaattgtcgcacgattgagatggggaactggctttatgcgaatggttctcgatcatcacaggacgtaaacaatgatgaatggggttatgatgacctatatgatcatggtcactcagagctggcaacctttgtgcctcttcgcattcagtggtgtcctatggggcgcctagaacttcaatccttatttgatgatggagagtccccccctccatctacttttcatgatttcacgggacaattcaactctgagcccatggtaccggtacctgccacacctcatcctggtccgtatctagcttattttcagcctgccctgccaccggtatcatcaagctcccttgtcgctgagagaacaatggatggtgctgcatatcatgatcactggaacactctggctgggctatcagatggccggcgaccctgggcgtactatcctcaacccaacagtgataatggtatagctgagcagcaaggactccctctgggggcaatggcggttggaggggttgatagtgaaagccaacaacgaggatctctctccttattttatggaaacgggtctggaagaccaaggatcccaggtgttcctcctatggcaccacaatttacaagagcgcatggcaacataaacgatcagttccagcagacagctagcttatttgctgggtcacagcaatcaggaggtatgcgtccattgggagcagtagggccttccgtgccaccacctccggagaacacctccttctgtctgttcccgccagcttcatccgtccccagtacaatggaggccgaggatgtcaacagagcaaaccagttctatgcatgggagagggatcgcctggctccttacccgctgatgcctgttaatagtgaaggtacctggtggagctcttcacaacagcagccccctccggagcctgctgcatctgcttcgaggaggctttctgggcagtggattggtaggttgccattgccaccaccagagaatagatcgccagacggctcgtccttccgtccactgcacatccctcggatgtagcgcaggaactggcaaggcgtaagttaatagtacaaacgtgggaaaccctgttggttgtaagtggtaacgccactgtaagaaagccccgtcggatggtaaaccttgtgataaaattcaggatgttgaagaaaccgaccctgaggtgaaaacatttttggcccggggtttatgcatttcgatcaagtacatatttccggtcatgttaatgaatttctaagaatcgcagttctgcttatagctgcatcgtgctacaaaaatgcaggatttgtaaaaggtgagtcgtatcatagtngagaccnntnnaagggaaggggggg

SEQ ID NO: 861 - DNA, 618 bp, Zea mays
  Clone ID: PAT_MRT4577_124572C.1
ctcgagttttttttttttttttttttttttttttttttttttttttttttttcccttaggattaaacttaaaataaagcctgacgggggtaacagcacccatcgatccgaagcccatgctggttgatgcatgggtctgctggacccgaggataaacacagcattaacaactgacacaaagcgaccttagatcaaaaacacagaggggcaacaccaaacccgggacgaacgaaaataaaccctttggactaggggaaacaacacggtagcaaacaggataacttggccgggcgggccccaccgttaatttcctccagttcccgtcggagttgccgaaccccccgccacggttgccaccgccgaacccgccgccaccaccaccggagccgccgccgccaccaccgtagccgccgccaccgccgaaaccgccgccgccatcacggggcccgccaccgccgtagccgccgcctccacggccaccaccgtacccgccgccgccgccgttttcaggggcggggggggactgggcctctttgacggggatgttggggccgtccagctccttgccgttaatgccctgaagggcgttcccgatcgcctcttccggggaaaaggggac

SEQ ID NO: 862 - DNA, 699 bp, Zea mays
  Clone ID: PAT_MRT4577_124601C.1
cattgggacctcgaggcggcaagcctattgatggcctgatagctttcgtaggtgctagctactaccatataccatatactctcacacaaagattagtacagctagcatggctaatgactccttgacgaggggccacataatcggggatgtcttagacccgtttactagctcagtgtctctaagtgtcctgtatgatggcagaccagtgtttgatgggatggagtttcgggcgtcggcggtgtcggtgaaacctagagttgagattgaaggtgatgattttcgagtggcctataccctagttatggtggatcctgatgcgcctaatcccagcaaccctagcctgcgggaatacttgcattggatggttactgacatcccagcatcaacagatgatagcttcggccgagagctcataccatatgagagcccaagccccaccatgggcatccaccgtcttgtgttggtgctctaccagcaattggggcggggcacggtgtttgcgccgcaagttcgtcagaacttcaacttgcgtaatttcgcacgccgtttcaacctcggcaagcctgtggccgcgacgtacttcaactgtcagcggcaaacaggcacagggtgggagaaagttcacttgagtaatggacctacgtacccctgatcatgtcgttcaaggggaaggccggcaaggcttgacctactactact

SEQ ID NO: 863 - DNA, 1191 bp, Zea mays
  Clone ID: PAT_MRT4577_124603C.1
ctgatagctttcgtaggtgctagctactaccatataccatatactctcacacaaagattagtacagctagcatggctaatgactccttgacgaggggccacataatcggggatgtcttagacccgtttactagctcagtgtctctaagtgtcctgtatgatggcagaccagtgtttgatgggatggagtttcgggcgtcggcggtgtcggtgaaacctagagttgagattggaggtgatgattttcgagtggcctataccctagtaagccatcacgtactccgcagatcgagtccatttggcgcgcggtaggccatatctatggccaagatgtctcgactactctccaaactctcatgtccaagtgacatccatggcttttggctcactgtgtgtgacggctaaatcagtctcctcgatcgtgcccatagctcggttgactacaaagattggctcatgctaataaatatatagtagtattatacactgagagagacactaacacccccccccccaaaaaaaaagtgcagggatttctgatcagcccagccccgaaaaaatgctcaggtttacttttaattccctaacatgttgaccatgtgtttgtgttaatgtaaatatattaggttatggtggatcctgatgcgcctaatcccagcaaccctagcctgcgggaatacttgcattggatggttactgacatcccagcatcaacagatgatagcttcggccgagagctcataccatatgagagcccaagccccaccatgggcatccaccgtcttgtgttggtgctctaccagcaattggggcggggcacggtgtttgcgccgcaagttcgtcagaacttcaacttgcgtaatttcgcacgccgtttcaacctcggcaagcctgtggccgcgacgtacttcaactgtcagcggcaaacaggcacaggtgggagaaggttcacttgtgtttttgatcatgtcgttcaaggtgaaggccggcaagcttgaacctactactactagtaacgttcgcgtgtgcttatatggccgtatcggcgtacactacgtagcatgaaagctagctagaaataaataaagatgtatttctttcgcacatgtagctaggcttttataaaggcgtacctccaagggtattatgtccggcttttaattaataatcgcgtgataagggtggttagtat

SEQ ID NO: 864 - DNA, 266 bp, Zea mays
  Clone ID: PAT_MRT4577_124769C.1
gcgctattcctcgccccgtcgccaacgcaatctttgcagccccaatccctcacagcaaccatggctgttgcgcaggagtccctttctgtggtgggcactatgcgcggccacaacggtgaggtgacggccatcgcgaccccgatcgacaactagccgttcatcgtgtcctcctcccgcgacaagtgcctgctggtgtgggacctgaccaacccggtccactacaccccggaattcggcgccaccgtctactactgagtacccttttg

SEQ ID NO: 865 - DNA, 2105 bp, Zea mays
  Clone ID: PAT_MRT4577_124783C.1
gccggctctcgtttgttatcccgtacccactctggcctactccatccaccaaaagtgcagggccccaaacggccaaacgcaaaagcgagagcaaagcaagcttcggcctcacctccagcggcaggtggtgctgcggagcttctcctcgccctagatcccgcgcacccaacgccagatcagagatcagggcgcgccggccgtctccattgcccggcggatcctgcgatgcgagctggaccgagagggaggagcgagggagcgcgcgggtagagaaggcggggcggggggaggaaggaaggaaggaaggagcgccggccggagcagacgtcccctcggggccctcggtcggatgagatcgacgatgaaggcgcagcacgccaacgggcgggggagcaggagccccttcctgacgtcctacgcgctcacgctcgccttcatcaccttcgtctccgtgctctactttaaggacttctcctccacgctgcaccgccccttcctccaccgcccccgccgccacgccgccccagacaaaagccaggcggggcgccgcgcggcggcggagcggctgccgttcgcggtgggcgcggcgccggcggggtgtgacgtcgggcgaggggagtgggtgtacgacgacgcggcgcggccgtggtaccaggaggaggagtgcccctacatccagccgcagctcacgtgccaggcgcacggccgccccgaccgggcgtaccagcactggcggtggcagccgcgcgggtgctcgctgcccagcttcaatgcaactctaatgctagagatgttgcggggtaaacgaatgttgtttgttggagattctctgaaccgtgggcaatatgtatctttggtttgcctcctgcaccgaatcatccctgagagctccaagtcaatggagacagttgattcccttacagttttcaaagcaaaggactacaatgccaccattgagttctattgggctccctttctggccgagtcgaattcggatgatgctgttgtgcaccggatcgcggatcggattgtaagagggacatccattgagaagcatgccaagttttggaagggggctgacatcttggtattcaacacctacctatggtggatgactggacaaaagatgaagattttgcggaactccttcgaagataaaagcaaggatatcatagagatggaaacggaggaagcctatgagatggtacttaatgctgtgctgaaatgggtggagagcaacatgaaccccaggacatcaagaacattctttgtcactatgtcacccacccacacaaggagcagagactggggcgatgatactgacgggaactgctacaaccagacagcccccatcgaggacctgtcctactgggggccagacaccagcaagggcctgatgcgcgtgatcggagaagtgttcagcgcgtctaagtccaggatccccgtgggggttgtgaacatcacccagctctccgagtacaggaaggacgcgcacacccagatatacaagaagcagtggaacccgctgaccccggagcaggtcgcggaccctaagagctacgcggactgcacgcactggtgcctgccggggctccaggacacgtggaacgagctgctctactccaagctctttttcccctgagttaaaggtttgagttgcgaggtgcacggtgaagttggggtctctctctggcattggcacgctgcacaatactagttagcttggcattggcccagcagtctgaagatggatgctctgctgcggtatggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacacagtgcatgaatagttgtatggggtaatgtgataatacatactgtaattctctggttccttcccttcgccttgcggagtgggccggtagacaaacatttcggcggctggtcacttggtcagtgacccgttgatattattattattattggatctaatgcaacaaccagttctggtgttggtgtcc

SEQ ID NO: 866 - DNA, 2387 bp, Zea mays
  Clone ID: PAT_MRT4577_124848C.1
cctcgaggccggccgggaagctcacctgctggcaccgcgaaactatcgagggggcatgcttccaattttctgcaagtcgagagtcgagaccgccatcgaagcaccggcgccaatgaagacttgaagagggctaaaacgaaaaagatgccaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcggcggctcatcgagcgctacattgaggaccatggcaagtgccccatcaccaaggatgagcttactatggatgatatcgtgccggtcaataccaacaaggtcgtgaagcccaggcctttgcaggctgcaagcattccaggactccttgggatttttcagaacgagtgggatgctctcatgctttctaattttgctttggagcagcagctacacacagcaagacaagaacttagtcatgcactctaccagcatgacgctgcctgccgtgttatagccaggttgaagaaggaaagagatgaggctagagcacttttggctcaagctgagagacagattccagcatcagttgcaggagctgctcctgcagctgttgtttccaatggaaaaagagcaatggaagatgaaattggccctgacggaaagaagattcgtcctggtatcaaccctgtcatgattgatgaacttacagagtgtaataccatgctttcagcacagcgtaagaaaagacaggttcctccaactctggcaccattagatgcactcgagagatacactcaaatctccagccatccccttcataagacaaacaaaccaggcattttgtccatggatgttcatccttcaaaggatgttgttgcaactgggggtatcgatacaaatgcagtaatctttgatcggtcatctggtcaaatcttgtgcacgcttactggtcactcaaagaagataaccactttaaagtttgttccacgggatcaactctttgtaactggatcagcagataagactgttcgcatttggcaagagaacgagaatggaaactataactgcgtccatacattgaaagatcatactgctgaggttgaagctgttacagtacatgcgactcagaagtattttgtgagtgcttccaaggataattcgtggtgcttctatgatatttcaacaggatcttgcctgacacaggttggcgaggcttcaggacaagagggatatacatccgcgtctttccatccagatggtcttatccttggaacaggaactactgatgctgttgttaaaatttgggatgtgaagactcagtcgaatgtcgcgaagtttgaggggcatgtaggaccagtcactgctatgtccttctctgaaaatggttacttcctagcgactgctgctcatgatggtgtcaagctttgggatcttcggaaattaagaaattttaggaccttctctccctatgattcagatacgccaacaaatactgtggaatttgattttagtggaaactatcttgccattggtggttcagatataagggtctaccaagtagctaatgttaaggccgaatggaatctcatcaagacattaccagatttatctggaacagggaaagtaacttcggtaaagttcggagcagatgctaagtacatagccgtaggttctatggaccgcaatctacggatatttggcctccctggagacgaccaaatggaggaatcaaccacagcggcagagtgaggaaaatccatggtacctaatttcctcctcctggtatactccgcaatatgttctgatgatgggtagactgagtgcaaatggatacatcacgagagaagggtcctcgcggcgatgaactggcttgagcttcggtcggtgtaaacaagctgtgacattattgtattgtaggcctcactaattcgtctgatggggatacaatttgttttgatgagtacgagtgtacgacgctaaacagccaaagttctatgcatagattccagtgattcaaaacaagctactacagtactactacttgctagtcaacttttacataggccaatggacgcactggtgtcggagcgtttagtctttgcccctgcgagtgtgcagtgcgcactgtgatctgggaagcttggttgttctctagttggtgcaatttcttttgtttccgagtttcttaaaaaccgtgcgttaaaaaatcaatggcaggttatcggt

SEQ ID NO: 867 - DNA, 2315 bp, Zea mays
  Clone ID: PAT_MRT4577_124849C.1
gccgggtccgattatttgcgccagagggcatgaatggaatctcatcaagacattaccagatttctcccgcctagggaccggccgggaggaggcagccgtcgcctgctcccatcccgccgccggccgtgccccgcatatgcggggggtcaaatttctcctctcgaagaaccctagcggcaaaacctttgctccgtcccgccgtcgcctgctcccgtcccgccgccggcgctgccacccgcatctgccgaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgtcaccaaggaggacctcaccatggatgatatcgtgccggtcaagaccaacaagatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctgcctgccgtgttatagccagattaaagaaggaaagagatgacgctagagcacttttggctcaagctgagagacagattcctgcgtcagttgcaggagctgctcctgcagctgttgtttccaatggaaaaagagcaattgaagatgaaattggccctgacggaaagaagattcgtcctggtatcaaccctgtcatgattgatgaacttacagagtgtaatgccatgctttcagcacagcgcaagaaaagacaggttcctccaactctggcaccgatcgatgcactcgagagatacactcaaatctccagccatccccttcataagacaaacaaaccaggcattttgtccatggatattcatccttcaaaggacattgttgcaactgggggtatcgatacaaatgcagtaatctttgatcggtcatctggtcaaatcttgtgcacgcttactggtcactcaaagaagataaccactttaaagtttgttccacgggatcaactctttgtaactggatcagcagataagactgttcgcatttggcaagagaacgagaatggaaactataactgcgtccatacattgaaagatcatactgctgaggttgaagctgttacagtacatgcgactcagaagtattttgtgagtgcttccaaggataattcgtggtgcttctatgatatttcaacaggatcttgcctgacacaggttggcgaggcttcaggacaagagggatatacatccgcgtctttccatccagatggtcttatccttggaacaggaactactgatgctgttgttaaaatttgggatgtgaaggctcagtcgaatgtcgcgaagtttgaggggcatgtcggaccagtcactgctatgtctttctctgaaaatggttacttcctagcgactgctgctcatgatggtgttaagctttgggatcttcggaaattaagaaattttaggactttctctccctatgattcagacacgccaaccaatactgtggaatttgattttagtggaaactatcttgccattggtggttcagatataagggtctaccaagtagctaatgttaaggccgaatggaatcttatcaagacattacccgatttatcaggaacagggaaagtaacttccgtaaaattcggagtagacgcgaaatacatagccataggttctatggaccgcaatctacggatatttggtctccctggagatgatcaaatggaggaatcaaacacagcggccgagtgatgggaattcatggtgcctaatttgtttcttctgccatcatcctcattatactgtggtgatggatagactgattgcacatggatacatcaccgtcacaagagggaagggtcctggcggggattactggtctgagcttcggtcggtgtaaaacaagctgtgatattgttgtactgtaggccttactaattcttctgatgaggatacaatttgttttgttgagtacgatgctaaacagctaaagttctctgcgcagattccagtgattcaaaacgaactacttgcttctcagcttcttttattacataggtcaatggaagcactataagatgtgcccacgcgagtgtgcagtgcgcgccgtgaactggtaagcttcgtagttctctaaaaaaaaaaaaaaaaaaaaaaaaaaaaa

SEQ ID NO: 868 - DNA, 1108 bp, Zea mays
  Clone ID: PAT_MRT4577_124955C.1
ctgagaaggaaaagcagcggcttctcgcgcggcgcttcgatctaccggggagtcaccaggcatcaccagcacgggcggtggcaggcgcgcatcggccgcgtctcgggcaacaaggacctctacctgggaacgttcagcacgcaggaggaggccgcggaggcgtacgacgtggccgcgatcaagttccgcggcctcagcgcggtcaccaacttcgacatcacgcggtacgacgtggacaagatcatggagagcagcacgctgctcccgggcgagcaggtccggcgcaggaaggaaggcgccgacgccgcggtctcggaggccgccgccgcgctggtgcaggccggcaactgcatgacggacacctggaagatccaggcggctctgccagctgccgcgcgggccgacgagcgcggcgccggccagcagcagcgccaggacttgctgtcgagcgaggccttctcgctgctccacgacatcgtgtccgtcgacgctgctgctggtacagggacagggacagggggcatgtcgaacgcgtcgtcgtcgctggcccccagcgtgagcaactcccgggagcagagcccggaccggggcggcgccagcctcgccatgctcttcgccaagcccgtcgcggcgcccaagctggcttgcccgctgccgctggggtcgtgggtgtcgccgtccgcggtgtccgccaggccgcccggcgtgtcaatcgcgcacctgccggtgttcgccgcgtggaccgacgcatgaacaaacatccgtgtcattaccagggtatggttcttttggtttgcttagagcgtgctttttagctgggtaaggttagctgcgtagcggtgatctgatcagcatatgtgagaggaactagccatgcgtgtctgctttgtcctcctgcgattcctcctccagttgcgttgcgaggaggtttctttttgtaataccggggctagatagcacagcatggatctcctcctgtagccaacactaatttggagtaggatggttagtgttgatctcctaacttcaattaggaaaaatatgccaagtaagataagtttaaacctgtgcgctttgcaattcatcaatgagctgggattcagacctc

SEQ ID NO: 869 - DNA, 1793 bp, Zea mays
  Clone ID: PAT_MRT4577_124970C.1
gttcggcacgacgttgttaccagcctgatcgggttatggagttctgcaacaacaatgatcttcagttaattgtacgagcacatgagtgtgtgatggatggctttgagcgctttgctcaaggtcacttgatcactcttttctctgcaacaaattattgcggttagatgtcttgtgaaggtctgctttctctctcctcacttaaaccctcctccgctcgacgacaccacacgaaaatatacgtcagaataaaccgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatggaatgcaggaaaaagagtggttgtccatggttgctgcacacagtgatgcatggttactttctgttgcattttacttcggtgctcgattcggtttcaataaaaatgacaggaagcgcctctacagtttgattgatgatcttcccatggcttttgaaattgttagtgggaagagtgaaaccaaggcaccagcaccaccaagcagtagtaaccacagcaatatcaaaccgaagtccaacaacaaaaagaaaccaccggagcctaaggtgaagcagccaaagccgcgtgcccctgcagaggaaggcgaggaggaagatggcagtgcaagcgagggcgagcacggggagacgctgtgcggcgcgtgcaaggaaagctacggccccgacgagttttggatctgctgcgacctctgcgagaagtggttccacggcaagtgcgtcaagatcacggcggccaaggccgagcacatcaagcagtacaagtgcccgtcctgcaccggcggcggtggcgtcggcaacagcggcaccaagcgagcccgcccatcatagctgcgacttttagtgatgtaaactgcttagaaaaactgttgcggacatagcgcccatcatagctgcgactttttaaatggtggtgtaaacttttgtagtgcgactaggccgtttgtcaccctatcatacttggcttcaagtaggttttctgtttttcagttttcattatcatactcgattaaagtagtgtggatgaatggcgtaaaacatctagcattctctataaaaaaccaaaaaattattgcgggactgcaaataatgccggtgcgatcttggttttgggtagagatcttgtggttgcgccaaaactaatccatcctttgccccctgcaattacgtcacctgaggcgtcgccggatcatattgaggacacatggatgcaggagctaaatgctaacagaccaccaactccgaccagggggcgtccccaagcagtagctaatgacaagggttctcttgcctggatatagtagattgaccacacattggttggtatgattcatatgaagcctgagtggtctggatcttgttattttcatttgtgttcgggagaggggctggtcgacagccgtaccgaaacgaaagattgatgttcaggggagcatagggactataaagttggtagaagggagcttaatctaggacaacgctcttcaattcgtaattattgtacacgtagttgcattgccaatagaa

SEQ ID NO: 870 - DNA, 669 bp, Zea mays
  Clone ID: PAT_MRT4577_124977C.1
gggtacctcgaggccggccgggaaaatctccgcccgtcggccgtcgcccgccaaaggtctcttcgatccggcctctccgggccacccagtcggccagtcccacacaaggatggatcgctagcgccgatgagctatactctttgctcactgtactagtcacacgattggctacacgacacgagctcagagctctcaggtttcccaacgccggctgctggccaatggcgcagcaccacggcagccactccctggaggtcggcggcgtcggcgccggcggcgtcgagctcgacgacgacggccacgccgcgcgcaccggcaacctatggacctgcttcgcgcacatcatcaccgccgtgatcggctgcggcgtgctggcgctctcgtggagcgtcgcgcagctgggctgggtgggcggccctgtcgccatgctctgcttcgccttcgtcacctacctctccgccttcctcctgtcccactgctacaggtcccctgcctccgatgatggctccctgaaacgccagaggaactacacctacatggacgccgtcaggacgcacctggtacctcaacatgtacgggaccgcaatcgcctacaccatcaccacggcgacctgtctcagggcgatcgtgagggccaactgctaccacagccagggccacagcgctccc

SEQ ID NO: 871 - DNA, 1955 bp, Zea mays
  Clone ID: PAT_MRT4577_124979C.1
caaaagtctccgcccgtcggccgtcgcccgccaaaggtctcttcgatccggcctctccgggccacccagtcggccagtcccacacaaggatggatcgctagcgccgatgagctatactctttgctcactgtactagtcacacgattggctacacgacacgagctcagagctctcaggtttcccaacgccggctgctggccaatggcgcagcaccacggcagccactccctggaggtcggcggcgtcggcgccggcggcgtcgagctcgacgacgacggccacgccgcgcgcaccggcaacctatggacctgcttcgcgcacatcatcaccgccgtgatcggctgcggcgtgctggcgctctcgtggagcgtcgcgcagctgggctgggtgggcggccctgtcgccatgctctgcttcgccttcgtcacctacctctccgccttcctcctgtcccactgctacaggtcccctggctccgatgatggctccctgaaacgccagaggaactacacctacatggacgccgtcaggacgcacctgggtacgcgttgctcctgcatccttgttcttgttcctatcctacctatcggctagcgtattagcctttggtggcgactccacttacgagagctagcaagagcaacgcgcgcaggggagaagcgcacctggctctgcggcctgttccagtacctcaacatgtacgggaccgcaatcgcctacaccatcaccacggcgacctgcctcagggcgatcgtgagggccaactgctaccacagccagggccacagcgctccctgcggcgccggcggcgaccacctctacatgctgctcttcggggcggcccaggcggtgctgtccctcatacccaacttccacagcatggcctggctctccgccgtcgccgccgtcatgtccttcacctacgccaccattggcctcggcctcggcctcgccaagaccatagaaaatggggcgatcaaaggaagcgtcgccggagttccgatgagcaccgcgccgcagaaagtctggcgagtcgcgcaggccatcggcgacatcgcgttcgcctacccgtacaccattgtcctactggagatacaggacacgctcaaatcgccgccaccagagagcgagacgatgcagaaggggaacgtgctcgcggtcctggccaccacgttcttctacctcgccgtggggtgcttcgggtacgccgccttcggcaacgctgcgccgggcaacctgctcaccggcttcggcttctacgagccgtactggctcatcgacttcgccaacgcctgcatcgtgctccacctgcttggtggctaccagatgttcagccagcagatcttcaccttcgcggaccggtccttggcggccaggttcccgaacagcgcgttcgtgaacaaatcctacgccgtgaaggtgcccggcgcgccggcgtcgtggagctacagcctcaacctgcagcggctgtgtttccggacggcgtacgtggcgagcaccacggggctggccctcctcttcccctacttcaacgaggtgctgggcgtgctgggcgccgtcgtcttctggcccctcgccatctacctccccgtcgagatgtactgcgtccagcgcggggtcctgccgtggacgcggacgtgggtcgcgctccaggcattcagcgtcgtctgcttcgtcgttggcaccttcgccttcgtcggctccgtcgagggagtcatccgcaagaggctcggctagttgtggtattagcgccttttctgtcgtcaaccatgtcatgaatggtggaagtgtgtaaagagagtgtactgtatctaagttttttttatttccccgtgttcgcttagccatgagcccatgaccatgatgattgatgaatatatctacccgtgcgtgtttagatccaaagttttttttgtgatgctgtgtcactgctacgtaaatgatttttgcaacag

SEQ ID NO: 872 - DNA, 2297 bp, Zea mays
  Clone ID: PAT_MRT4577_124982C.1
accccctcgaggccggcccgggaaaaaaaaaaaaaaaaaaaaaaaaaaaaaaaaaaaaggcctcgtcctgcttcgtactaccagtagtagcacgtaaaccagggcgccacgccagccggatcggatcgtcttggatgtgggcatgtggctgtggacgagacaaaagtctccgcccgtcggccatcgcccgccaaaggttctcttcgatccggcctctccgggccacccagtcggccagtcccacacaaggatggatcgctagcgccgatgagctatactctttgctcactgtactagtcacacgattggctacacgacacgagctcagagctctcaggtttcccaacgccggctgctggccaatggcgcagcaccacggcagccactccctggaggtcggcggcgtcggcgccggcggcgtcgagctcgacgacgacggccacgccgcgcgcaccggcaacctatggacctgcttcgcgcacatcatcaccgccgtgatcggctgcggcgtgctggcgctctcgtggagcgtcgcgcagctgggctgggtgggcggccctgtcgccatgctctgcttcgccttcgtcacctacctctccgccttcctcctgtcccactgctacaggtcccctgcctccgatgatggctccctgaaacgccagaggaactacacctacatggacgccgtcaggacgcacctggcaagagcaacgcgcccaggggagaagcgcacctggctctgcggcctgttccagtacctcaacatgtacgggaccgcaatcgcctacaccatcaccacggcgacctgtctcagggcgatcgtgagggccaactgctaccacagccagggccacagcgctccctgcggcgccggcggcgaccacctctacatgctgctcttcggggcggccccaggcggtgctgtccctcatacccaacttccacagcatggcctgggctctccgtcgtcgccgccgtcatgtccttcacctacgccaccattggcctcggcctcggcctcgccaagaccatagaaaatggggcgatcaaaggaagcgtcgccggagttccgatgagcaccgcgccgcagaaagtctggcgagtcgcgcaggccatcggcgacatcgcgttcgcctacccgtacaccattgtcctactggagatacaggacacgctcaaatcgccgccaccagagagcgagacgatgcagaaggggaacgtgctcgcggtcctggccaccacgttcttctacctcgccgtggggtgcttcgggtacgccgccttcggcaacgccgcgccgggcaacctgctcaccggcttcggcttctacgagccgtactggctcatcgacttcgccaacgcctgcatcgtgctccacctgcttggtggctaccagatgttcagccagcagatcttcaccttcgcggaccggtccttggcggccaggttcccgaacagcgcgttcgtgaacaaatcctacgccgtgaaggtgcccggcgcgccggcgtcgtggagctacagcctcaacctgcagcggctgtgtttccggacggcgtacgtggcgagcaccacggggctggccctcctcttcccctacttcaacgaggtgctgggcgtgctgggcgccgtcgtcttctggcccctcgccatctacctccccgtcgagatgtactgcgtccagcgcggggtcctgccgtggacgcggacgtgggtcgcgcttcaggcattcagcgtcgtctgcttcgtcgtcggcaccttcgccttcgtcggctccgtcgagggagtcatccgcaagaggctcggctagttgtggtattagcgccttttctgtcgtcaaccatgtcatgaatggtggaagtgtgtaaagagagtgtactgtatctaagttttttttatttccctgtgttcgcttagccatgagcccatgaccatgatgattgatgaatatatctacccgtgcgtgtttagatccaaaaaaaaaaaaaaaaaaaaaaaaaaaaaaaaacaaaaaaaaagaaaaatccagatgcggacaagaaccaagtcgccatgaaccccatcaacaccgtctttgatgccaagcgtctcatcggcaggaggttcagtgatgcgtctgtccagagtgatatcaagctgtggcccttcaaggtcatttctgggcctggtgagaagccaatgattgttgtccagcacaagggtgaggagaagcagtttgcagctgaagagatctcctctatggctcttatcaagatacgtgagaatgctgaagcttaccttggttgcaccatcaaaaatgc

SEQ ID NO: 873 - DNA, 368 bp, Zea mays
  Clone ID: PAT_MRT4577_125022C.1
tggattctcctgcccctacggttcgggttcgggttcgagaggatctacgctgttcggctccggggttgagcggatcgagatggcggcgtctgatgttgagtaccgctgcttcgccggcggcctcacctgggccactgacgaccacttcgtgcacaacgccttaagcacctacggcgaggtcctcgatgtccaacatcatcctcgatcgggagacgcacaggtccgagcgctcttgcttcatcaccttctccacggatgaggcgaggcacaacgccatcaacggcatgaacagcacggagcttgacgggcgtaacatcaccgtgaacgatgcccatgcccgcggcgtacggggaggtggttgcggtggg

SEQ ID NO: 874 - DNA, 357 bp, Zea mays
  Clone ID: PAT_MRT4577_12507C.1
gcgttcgtgaggttctccggggttcggtttcgtgggtgagcggatcgagatggcggcatcggatgttgagtaccgctgcttccacggcggactgcactgaaccacagacgaccactccctacacaacgccttcagcacctacggcgaagtcctcgagttcaagatcatcctcgatcgggagacgcagaagctccacggctactgcttcaccaccttctccacggaggacgcgatgcagaacgccatcaagggcatgaacagcgaggaactggacagacgcaacatcaccgtcaactaggcccagtcccgatgaagccgcggatgcagacgcagctgcaggtactgctgtagccgatg

SEQ ID NO: 875 - DNA, 875 bp, Zea mays
  Clone ID: PAT_MRT4577_125103C.1
caaccagttgcatatgcattttgtgcctactctacctttaaggcattcatttataaatggagtattctaatttgcagcagcaggcagcgtccttgaaaaagaacctctttgatcagggatacttggatgagcaattttgtcagattgaggacttgcaggatgaagcaagccctaattttacagaagaagttgtttccctgttcttcaagaactcaaccaggctaatgacaaatattgagcaagctatggacaggaatcccagagatttcagtaaatgggatgtaaacatgcagcaattaaaaggaacctgttctagcatcggtgcttgcaggatgaagaacgagtgcacctcattcagaaatagatgtggagacgagaacgttgaaggttgtatgaggtccttccagaacctgaagagggagcatggagtcctcaggcagaagctggaatcctacttccagctgctgcgacaagccggtcctgccgtgactgcaaccaggcctagaggcatgtaaggaacggctgttggcgtgcagggagcagtgcaagggacagacagcgtcatagcgatgctccactacgccattgttgaggctagctgtaacgatgggccacgaataagaagtttgcctatggcctgtgggggagttccctgcgggttttaaagtgtaataacacccttcataatcgatgccttaagctggtgctgccgagtgccgactagctaggccggcatgtaagagcagcctagactgatgttgatgtggtctggcagacgtcctgtgctgtgcctgcctctgtatttcggtcaaataaataaactagatggagtttgcatgtttgcatcagacaaggataacgagaaagtaaaaggg

SEQ ID NO: 876 - DNA, 1159 bp, Zea mays
  UNSURE (1)..(1159): unsure at all n locations
  Clone ID: PAT_MRT4577_125324C.1
  unsure (1)..(1159): unsure at all n locations
accatgtgcttgtggagatgacaggcatcggcgtggccgcgacctcctcgtcgagcttccgccatgtggccgacatgtcgcangcgccggccgggaacctttgcttcttcctccccctaatcgcgaacgagcgtctttctcctccgtccgcgcccgtttgctcatcggttttgcctgccggtgggggaccgcctgcacgagcagcggctagccagacgtacgggcttcgtttgaggctggagtcctgattggcaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgaccaggcaaaggctccaagcaagctatcatctgcattctctggaactcaagataaatgcgcggcctgccagaaaacagtgtatccattggagaagatgactctggaaggcgagtcctaccacaagagctgcttcaaatgctcgcacgggggctgcatcctcaccacgtcctcctacgccgcgctcaacggggtcctctactgcaagatccatttctcgcagctgttcaaggagaagggcagctacaaccacctcatcgagacggcgcagaccaagaagaacgaggccgcggaggccggaccggagccaccggcggacgcaggcgcgggtgagccggaagcacccgcgcaatcggcgtagaacgtacaaagattagcagcaacgcaaagagaaatagagccgtacgtgtctatctcctctatatatacgaaccctgcattattagtaagtagtcgtcacaagtatatgttcttattttgtaaccttggcagcttggttcagtctgggattgtaacaagtgcatgttgaattgcttgttatgtattatgaggctttggattcatgacgatgaaatgagtatatgggtgtaaacatttggcttccaacaaaaaaaatgatgaaaaat

SEQ ID NO: 877 - DNA, 1025 bp, Zea mays
  UNSURE (1)..(1025): unsure at all n locations
  Clone ID: PAT_MRT4577_125327C.1
  unsure (1)..(1025): unsure at all n locations
ccggccgggcgattgggttactcgaggccggccgggaacctttgcttcttccttccggccgaattgcgagcgagcgttcctctccgtccgcttccgccgtttgcccgtcgatcagttgttggctgccggccgggtactaccgcctgcacgagcagcggctagccacagcccacagacagacgacgtcaggtcttggcaggtgtgcaagcagacagagctcgctcggtcgccatgtctttcaccggcacgcaggacaagtgcaaagcctgcgacaagacggtccacttcatcgacctgctcaccgccgacggcgtctcgtaccacaagacctgcttcaaatgcagccactgcaagggcgtcctctcgattagcagctactcttccatggacggcgttctgtactgcaagacgcacttcgaacagctcttcaaggagacagggaacttctccaagaaattccaaggtggaggtggagcatcttcaaacaagaacgacccggcaaaggctccgagcaagctgtcatctgcattctctggaactcaagacaaatgcgcagcctgccagaagaccgtgtatccattggagaagatgacgctggaaggcgagtcgtaccacaagggctgcttcaagtgctcgcacggcggctgcatcctgaccacctcctcctacgccgcgctcaacgggatcctctactgcaagatccatttctcgcagctgttcaaggagaagggcagctacaaccacctcatcgagacggcgcagaccaagaagaacgagggcgcggaggccgcagaggagccatcggtggacgcaggcgccgcggctgaggcggaagcgcccgcggaatcggcgtagaacgaagagtagccgtgtgtgtatctcctaattatacgaactctgcattcagtaagtagttttcacaaatctatatatgttgttgttatgctgcagcttggttttggtcagtctgggattgtatttgtaacacgtgcatgttgaattgcttattttgtattcgaggcntc

SEQ ID NO: 878 - DNA, 378 bp, Zea mays
  Clone ID: PAT_MRT4577_125341C.1
gttggcggcaccaagaagcaccatggtttccttaagattaacttagagtaaagcctgacgggggtaacagtattcatggatccgcagtgcatgctggttgatgcatgggtctgctgaaaccgaggatgaacacagcactaacaactgccacagtgcgaccttgcagtcaaaaacacaaatgggcaacaacaaacacgacacgaacgaagatatagcctatggactcgggtaaacattactgtagcgaacaggataactcggtcgttcggtcccgaccggtcagtttgttcagatcctgacagagctgccggattcgacgtcacggatgtcaccgtcgtagacgccggcaccaccaccgtagtcgtcgtcgtcaccgta

SEQ ID NO: 879 - DNA, 535 bp, Zea mays
  UNSURE (1)..(535): unsure at all n locations
  Clone ID: PAT_MRT4577_125744C.1
  unsure (1)..(535): unsure at all n locations
agaactagccccgccgccggccacgccgccgcctgtaccagcggagtcaagatgagtcggcaccctgaagagaagtgggctcagatgatcgacagggtttacataactgaacagtaacctgatgcctaggacgctaaggcctatctggacactcattatggagactacacattctctggcagggctggtacaaacttatatgaattgaaactagatgtgaatgacgaagtaaacgatgaggctagcgacaataactgtgggtgttaggtacactattgtggattgaacaaaaagctgaggccaaatggaggaataaacttggtccacatgatcagagggcacctcactttgagaaagttgattgggacttgatgggatgacgaagatgatgatggtgttgatgactacttggatggcatggacttctcgaattttgacgcgatgggagggatgcgtggcatggttgatatggctggcttgngtggtcttgctggaatgagtgttatgggaatggatgattctgaggatgatagtg

SEQ ID NO: 880 - DNA, 1524 bp, Zea mays
  Clone ID: PAT_MRT4577_125748C.1
ggcagaggctgcagaagcagaagcccaagccccgccgccagggatcgggcgtaccccggtgcccgttcaccgccgttcacgccgcgtgtgcgctctggctctgccgctctctctccctcgtctgcgcgtggcgcagctgccgtcctatcccaggcgcccccgtctagcctcgccggtgcctccgccgggtcgttctcgggcccttcgccaacgacgagcgcccgctaggtgaaaaggtgcgcattccggttcatcacaccctagtagactgggacgccggtgcccgttcaccgccgttcacgccgcgtgtgcgctctggctctgccgctctctctctctctcctgcgcgtggcgcagctgccgtcctataccaggcgcccaggtctagcctcgtcggtgccttcgccaggtctttctcgggcccttcgccaacgacgagcgcccgctaggttagaaggtatgcattcgtgttcataatattgtatttgactaaaaagactgggcctacgcatgggggctccaaaacagaggtggacttctgaggaagaggctgctcttagagctggagtagccagacatggagttggaaattggcgcatgatattgaatgatccagaacttagctccacattgcgctaccgctcgaatgttgacctaaaggacaaatggcgcaacatgaatgtaattgtcacttcatcgagtactcgtgacagggggagaacttccacgaggagaacccgagctgctcctaagaataatgaccaattgttggcaatgagcacaatcacttctgaggttgatgatgagattgttgatgtaaagcccatagtatcaatgtctgttgaaggatggaatacttcaaattcaaagaaatctcactcaaggctagacaatattataatggaggctataaagaacttgaatgagcctacagggtcccacagaactactattgctaattacatagaggagcaatattggccacctagtgattttgatcacttattgtctgcaaaactgaagtatttagctaccagtgggaaattgttgaaggtgaatcggaagtacaggatagcacctagtttgctggaagacgtgcaaagagaacccttgaaattagggagtgatgctagtagaacccttacaagatcccaagtcgatgctgaattggtccgtatggcaactatgactgttgaggcggcggcggcagctgctgctcatgcagttgcagaggcagaggctatcatggcagaagctgaagcagctgctagggaagcagaagctgcggaagcagaggcccgagctgcacaggcctttgctgaagcagcagttttgacactgaagaacagaaatgctgcgaaattggtatagctcgagtccatgaatcttagatatgccctcttgtccttccacacgtagaatccagttccgtagctctgtatgcaactaattggttactaaaagaacctgaaatcagaagttttcacaaacacaccgacttattcaccgaagattatgatttcc

SEQ ID NO: 881 - DNA, 3054 bp, Zea mays
  Clone ID: PAT_MRT4577_125772C.1
caagagcaagagcaagagcaattactgcaaaaccctaaattagctacgtatagcttctcttctcacccatggccaagtcaagcagctacggccttgggcttgcttgcttcttcgccattgccgctgcggtcgccggcgggacgcagttcatggtcggcggcgccaatggctggagcgtgcccaccgccggcgccgagcccttcaacacttgggcggagaggacgaggtttcagatcggagactccctagtgttcgtgtaccccaaggaccaggactcggtgctgctggtggagccggcggactacaacgcctgcgacacgtcgtcgtacgtgaggaagttcgacgacggcgacaccgtggtcacgctcgaccgctccggcccgctcttcttcatcagcggcgtcgaggccaactgccgcgccaacgagaagctcatcgtcatggtcctcgccgcccgcagcaacggcaacggcaccggcggcggcgcgcgggctccgagcacggcgccgcagccggcgtcaccggcggcatcgccccctcccgccagctcgaccccgcccccgccgtcgtcgcccgctcccaagggcgcgtcgccgcccccggcctctgctcccacaacgtcaccgggtacgacgccgccccctgctccgagcgcgtcgtcgcctgctccggcggggagcgagacgcggacgaggagacgcggaaccagatgatgcagaacctattcggagaccagtcggaggacgaggacgatgcggacgacgacgacggccagcagcaacagctgcagtcacccccgcaccaccaccacgagatagaggacgacgccgatgaagacggcgacgacgcccgcagcgacgcgcctgcccgccacggcggataccactcggaagaagtggatggagaggcagagaatggaggagaaggtgaaggcgaaagtgaggggcaagttgaaatggaagaggaaagtgaaggcgaagctcatcgtgctgaccttgatcaaggagaaagtgatggggacaaagtccatagctccccagaaagagaactccatgaccagaggatggaatctgatgcaaaaggacttggacagtgaagatgaaggctaccagcagaggacagtatctggcagaagaaggggagttattgcctccgaatcggagggatctgaagatagttactatgctgctggagctcaagaagacgaggaacctcgccaaacaaggaaacaaagctctccgttggaggaagaaagagatcatgaagtagttcgggatgtgtttggtgatagcgatgaagatgaaccagctccatatcgtgttcgccatgaaatcgatgaagattctcataggtctcacatggaggatgaaggccattatgagaaggacatgcaaccagatgaagttgtggctgacgaagatatgcgatatgaatctgatgataatcgtgaactgaaaccaaaagagaaaccagtcggtccacccctcggctcggcggcgccgtttggccgtcctcctgctcgaccgcgccgagggcttgtgtgcgtcggaccagacattctgggggttgaccctaaaccctttgatccaaaaacgtatgtggaagaagatgtttttgttacagatgaatctgggactaagaaaaggatacggctagaggacaatattgtgcggtggagaaccattaggaatgcagatggcactacatcttgtgaaagcaatgcacgctttgtaaaatggaaggatgggactatgcagcttctgattggcaatgaggttcttgatatatctgtacatgaggcgcatcatgaccagtcccatctgtttttgaggcatgggaagggaattctacaatcacaaggaaggcttttgcacaaaatgcgatttatgccatcctccttgtcttcaaagtcgcatcgcttattaactgctctggttgattctcagaataagaaaactgttaagatgcaaaaatggtttgagactaaggatcctgagaaagcgaaaatggaaaaagaaagggttttgggccaaaatattcgagcccattcaatccttcaacgcaaaagagaaaaagtgaaccgcaagtacacacagcctgcccggccaaggcggcagctttctccagggttcttggaagacgctctagatgaggatgatgagcctggctatgattctcggcgaatgccaggccgtaggcgttttgaggatgaattggaggctgaagcactagctgagaggcgtatcattaacgcgaagaagtcaaatatgagcagaaatgttccccacaaaccaccgtaccctcctgcccgtccaccgagacgtcaagcggatgaatactcggggagtgagagggaggagtcagagtacgaaacggatggtgaggatatcgaacattcaccgcctcgtggaagaagggaggacgagctggatgaggaggaagaatacgaggaagatgttgaagaagaagaagcgcctctgtcggatgaagaaatggaggcaccgaaacgtaagagagaatcagggggtggtgggcaaaggcgcgaggagctggtgtctgaggaggaggacgaggaccacgacgattctccgccaaggaagcagccggctgtttcgcatcgtagaaaggctgtcgtgtttgatgacagcgacgaggactaaaatttgtaaaacgttggtgtgtgtatgacgacctgacatgatacgcttgcttttttttccccatttgtttaagagaatgattagttatttttcgtcatgctggtgtaatatggttgcaattctacctacagaggtgagattgtacatcgcaagcatgaaacatgaagaaatcgataattggattggagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccgttttaaaggatccaagtttacttccccgtgcttgggaatttatagttttttttttggggcccctaaattaaattccctggccgttgtttt

SEQ ID NO: 882 - DNA, 581 bp, Zea mays
  Clone ID: PAT_MRT4577_125823C.1
actgttattaaacaggatgaagggcgggcctggtgcagtggtagagtctaccgtctgtaaccggaaggtcccgggtttgagccccagcctctgcatattatgcgggtaaggcttggcacttaaagatacccttctccagaccccacacagtgcgggaagcctacggcactgggtacgcccttttactgttatcaaacaggatgaaccaaagataatataataatgacaagaagagtaaaagagtagtaacatatacacgctattatttactaaaagtatcctaacacatgcaagtactgtattcaattgacaaggaaatcatgtacctaatagatgtacataatcaataatgctccatctccctatcattccacccaacaaaaaaatgcacattgcagaattggtttataacaacatcataatgacctcggaagaagctaactctacaactaaaacaacctttggagaaacaaatccaaaggtagccaaaattcatcatgtcacaagttaccacgtgccaccaagagtttcttaatccttaattaagaaaagaacctgctattatttatctgctacagtag

SEQ ID NO: 883 - DNA, 520 bp, Zea mays
  UNSURE (1)..(520): unsure at all n locations
  Clone ID: PAT_MRT4577_125903C.1
  unsure (1)..(520): unsure at all n locations
tattgagaccaatngcaacatagaaagccaatagtgtgccaacaatggcagccaaaatttttgcttccttatgctccttggtctttctgcaagtgttgctaccgcaaccattttcccacaatgctcacaagctcctatagcttcctttttttccccatacctctcaccagcggtgtcttcagtgtgtgaaaccccaattgttgaaccctgcaggatccaacaggcattggcaacaggcatcttaccattttcacccttgttcctccaacaaccgtctgtcctattacagcagtttcctttggtccatttggtggctcataacatcagggctcagcaactacatcaacttgtgctagcataccttgctgcatactgttagcttcttcattttctttccttcaaccaactggctgcgttgnactctgttgtttatttgctacaacaattaccgtttcatccagctaggttgctgcctcccccccgttgtttcttccatttngcctacttgcagcttttaact

SEQ ID NO: 884 - DNA, 407 bp, Zea mays
  UNSURE (1)..(407): unsure at all n locations
  Clone ID: PAT_MRT4577_126100C.1
  unsure (1)..(407): unsure at all n locations
gtagccgccgccaccgcctccgtagccaccgccgccgccgcctccgccgcgggactgggcctggttgacggtgatgttgcggccgtcgagctccttgccgttcatgttctcgatggcgtttatcatggactgctcagaggagaaggtgacgaggccggacccgcgggacctccccgtctcccggtcggtgatgaccttggagtcgatgacctggccgaagttggcgaaggcttgctcgagggtctcgttgttggtggcccaggcgagcccaccgacgaagcaacggtactccacgtccgccgncgccatatctcccctccacaaaaaccctaacgaaccctaaaccgaggacgaggacttggtaagagggggaggagaagccacccacgcgtncgcccacgcgtccg

SEQ ID NO: 885 - DNA, 238 bp, Zea mays
  Clone ID: PAT_MRT4577_126197C.1
ctttctgcaagtgctgctacggcgaccattttcccgcaatgctcgcaagctcctataagcttccttctttccccgtacctctcaacaggggggtcttcgggatgtgaaaaccccattcttcaaccctacagggtccaacagggaatcacagctggcattttaactttattaaccttggttcttccaacattattagccctattacatcaggtacctttgggggatttattgggacaaa

SEQ ID NO: 886 - DNA, 1325 bp, Zea mays
  UNSURE (1)..(1325): unsure at all n locations
  Clone ID: PAT_MRT4577_126268C.1
  unsure (1)..(1325): unsure at all n locations
acgaggaccggacgacgatgcgggggcggggctcctcgggcgcgcgcatgagcnangggnacgcggcggaggcggcagtnggcgcggtcgggtgcggctacgacctgacgggggncctccgcctgggccgcgccaagcctggtggccggctcgtggacctcgacggcgccgggaagtgggcggggacgtccccgtcgccgcgggagctggcgttccccggcggggccgccgtggcgggcgtgccggccggggtcgtcgccggcaagggcgagcgcgcgcggttccgctccgacgtgctccccttcgcgcagatggcggaggaggtgaaccgctcgctgtcgctgcccgccagcaagatcccctcgggcgccttcaacgccatgttcgactaccgcgggtgctggcaccgcgacgccgccgccacgcgcagcctctgcttcgacgcccgcctcgtcgagctctacagcgtcgaggccgtgcgcgccagcctcgccctcagggaccacgtcaggcgggacctcccgcccgtctgggaccccgccgcgctcgccgagttcatcgacaagtacgggactcacgtcatcgtcggggtgaagatgggaggcaaggacgtggtgtgcgtgaagcagctcaagggctccagcctcacgcagagcgacgtgcaggcccggctcaaggagctcgccgacgacaggttctcggaggattccacagcaagttccaattcttccaccgcgggaggcggcaggttgtcgcaggggctaaacgttgggcccggatcggccgcctggcagtccttcagatcacccgtcgtgtctcacaaggatgacatggtgtgcattcacgtcaggagaggcggcgtcgacagcgggcagggccacggcaagtggctctccaccatcaccggcttcccggacgtcatctccatgtcgttcgtgcccataacgagcctgctcaccggcgtccggggcagcggcttcctcaaccacgctgtgaacctctacctcagatacaagccgcccatagaggagctgcagcagtttctcgagttccaggtgcctcggctctgggctccagagttcggtcagctcccgctctcgctccagaggcggaagaacatcctgccgtctctccagttcaccctcatgggccctaaacttcacgtcaacactgccaaggtcgactcctgcctccgcccggtgaccggcatccggctgttcctggaaggcaagaagagcgaccagctgggcgtccacctgcagcacctgtcggcgacgcccagcgcgatcacggtgctcagcgaggccgcgtcctcggcggacgac

SEQ ID NO: 887 - DNA, 431 bp, Zea mays
  Clone ID: PAT_MRT4577_126272C.1
ctccgctgcagcagcgcccggagcctccgttttcctttttctgcctccctatggaagggggccgacagaggcagatatcgccctcgattctaccgcgattcgttcgaccacgagcgggattccctccgccaagcgcggatctgaacgctgcactccgtgtcgtcgctcgaatacgacatgaagggggccaaatacaagggcgccgtcaaggtcgatgccaagctggcggtgaagagcaagggggcggagaagcccgccatgggcaggaaggggaaggccggctaggaccccaacaagcctaagagggcttccagcgctttcttcgtgttcatgcgggaatatcgcaaggagttcaagggagaaaaaccctaacaacaagtctgtcgcttgggtgggaaaagctgatggcgacaggttgaaatccctgaacg

SEQ ID NO: 888 - DNA, 221 bp, Zea mays
  UNSURE (1)..(221): unsure at all n locations
  Clone ID: PAT_MRT4577_126415C.1
  unsure (1)..(221): unsure at all n locations
tcaacttttcaatgagcttcaaaaatactacctgcgaagacctcgaactggggcacgggcacncaaacaggaaaaaagagatttatttccaatgaatagagaaggctatcatgcaggttttcaggatttccagtatttgctaacaacgttcactcaatacaggcgactacttgtaattgcggaactaaaacatggagacttgtttaactttgccaatattt

SEQ ID NO: 889 - DNA, 2606 bp, Zea mays
  UNSURE (1)..(2606): unsure at all n locations
  Clone ID: PAT_MRT4577_126568C.1
  unsure (1)..(2606): unsure at all n locations
ggggtaccctcgaggccggccggggggcgcccaccgtttccgcccctcgtcctcgcctcttctttcttcgcctcttctgcaccgcgctctcgctcgcccctccgccgcttggcctccaccctcccgctgccggctccgccgattggacttccgcccgtcgctggccgtcggcgcgcccgttcctcgcaggtgaattgttcaggctgaattgatcggtggaagctgtgcattgactatttttttaatctcagaatcaaagagagaaattgaactgggaggctgggaatcgcgagagaagtgatgtctttcgttaggcaagcagacccatcagcgtcctgtgcggagaccacttacatccacaaatttgtgccaccaggaccagttttcccagcacagagatttgtctctggcaccgacttgcttcaccacgggcctcaaccatataatgctgagggctacaagcagtctggtttcaatggcacagcgcctcatgcatttcagagcttttacaatactgatagctatgctgaatctcactttaatgaagcaccatattctcctgcaatcttcgatatatctcagcagaactctcaatctttatcggataaccaggcctctgatcttgtagagttcgatgaggatgagatgagagtaaagcttcaggagcttgagcatgctttacttgacgatggtgatgagatcttttttgacttgtcagggagcattaacgatgagtggaatgataacattaagacaaacaatgaatgggtcaataccatgaagaatattgtgagccccgactctccaaaagaggcatcacctgagtcaagcatctgctgtctcgacaacaatgttggagaagcgcggaacccgaaacagttgctttttgactgcgcagaagcgatatccgaaaatagcatcgatgaagcacagtcaatcatagcagaactacggcagaaggtggcaattcaaggagaaccttctcagagacttgcggcctatctcgtggagggccttgctgccacactacagtcttcaggaaagggcatctacagggccctgaggtgcaaggaggcccctactctgtaccagctttcagccatgcagatcctcttcgaaatctgcccatgcttcaggctaggcttcatggctgctaactatgctattctcgaagcctgcaaaggcgaagatgtcgtgcacatcattgactttgacatcaaccagggtagccagtacataactcttatccagttcctaaagaataacagtaacaagccacgccttttgaggataactggtgtcgatgatccagagtcagtgcacagagctgttggaggactgaatgttgttgggcagcgactagagaagcttgcagaggactgtgaggtacggtttgagttcagggcagtggctgctaacattgaagatttgactgctggaatgctaggtcgccgtcccggagaggccctcattgttaactttgcattcctgctgcaccaccttcctgatgaaagtgtctcaattatgaaccaaagggatcggcttctccgtatggtgaagggtctccgaccaaaactagtgacgttggtggagcaggacgcaaatactaacactaccccattcccttccaggttccgggaggtctatgactactattcggcactttttgattcactggatgccacccttccaagggaaagcccagatagaatgaacgtggagcgccagtgcctcgcacgggaaatcgtcaacatcttagcttgtgaaggtcctgaccgtgtggaaaggtatgaagtggctgggaaatggagagctagaatggcaatggcgggctttgtgtcgtccccatttaacagcggcgcgattgatggcataagatctctactgaaatcgtactgcgataagtacaggttcgagaaggtccaggacggtctccactttggctggggcgacaagacgctcgtcttctcttcggcgtggcaatagaagcttgcttgtactattgcctatctgagcactttccagcgtttttaggagcatctggggcaagggctgtaaagagatttctgtcgccgtattgttgacctaccatataagtacactcgtagctaaccttagcgtgctgcctgcctgtaggcttgtgacttgtgaggtctacggtttacctagtttcttagatgaaagtatgttgtgcattgtacacctactgaactacatgtagactgtagagtcgcgggtgtatttaattttgcccttcttttggaggggcagaatcacaatacgcgtgattggatacctggccgcgtgcgtctgggctctccacattccgttgaccgcatttaaccagtgattggtgggctgtatgtatggaggcgagcttgcacgcaccgatgcaactcagtggctttttgttgtgtcaatttgcatgcgtggagatacggtgagggagcatccctgcgcatccagaccaccgcgagccttgcgcccacgagctggacgtcccatcatgctgaatatgtcgacatttgttcgtgtatnaagtactggatgatgatgatgctctaaaaaaaaaaaaaaaagcggcgcttttttttttttttttttac

SEQ ID NO: 890 - DNA, 160 bp, Zea mays
  Clone ID: PAT_MRT4577_126700C.1
gacaacaaaattccgcactcaatggttgcttaaaacggggatgtggttatttgctaacacattgatgttgggatgaaacaatggcttaccccgttaattgggccattaaaccattttttacttattccacataaatgggcttaatggacccattatgggt

SEQ ID NO: 891 - DNA, 446 bp, Zea mays
  UNSURE (1)..(446): unsure at all n locations
  Clone ID: PAT_MRT4577_126775C.1
  unsure (1)..(446): unsure at all n locations
tttnatggtccaactagaaacatagcaagcgcactggtgtaccaacaatggcaggcgagatatttagtcttcttatgcttcctggtctttctgcaagtgctgctactgagaccatttttccgaaatgctcgcatgcttctatagcttccctatttcccccgtacctttaaccagcggagtcattgtgttgtgaaaacccaattcttcaaccctacaggatccaacaggcaatcacagctggcatcttacctttatcacccttgttccttcaacaattattagtctctattacatcaggtacctttgttgcatttattggcacaaaacattagggcacaactaactacatcaacttgtgcttgcaaaccttacttcctactctcattaacatgtgtttcttccatttaaccaacttgctgaattgaacttttgtttttatttgcaat

SEQ ID NO: 892 - DNA, 2325 bp, Zea mays
  Clone ID: PAT_MRT4577_12685C.1
ctccatttccccccgcaccaaaccagccaaaccactggcgcacgccgaggagagagaaagggggtgtgcggggcggcgaccggcctccgacgacgcggggcgtcgcggcgtcgtggcggtgaagcggatgaggctgtgggaggaggaggacgatgacgaggacgaggaggggatggaagtggacggggaggcggaagatgagccggggtggccgtgtggggcgccggaggcggggcccggcgagacgaggccggcagcgatcctcgtggcggacgcggcggaggtcgacttccccgtcatctacgtcaacgccgccttcgaggccgccacggggtaccgcgcgcacgaggtgctcgggcggaactgccgattcctacaattccgggatccacatgcccaaaggcgacaccccctcgttgatcccatggtcgtttcagagattcggcgatgtctcagcgaggggatcgaattccaaggcgagctgctgaatttccggaaggacggtgctccacttcacaacagattaaggctcgttcctatgcacggcgatgatggctatgtgacgcatgttatcggaatccagctattctctgaggcgaacatcgatctcagcagcgtatcttatccggtgtacaagcaaaagtccagcagcaggcccagcattcaagatctgaactcatctccccacgagcacgctccgaaaatccagagcgcagaccactgcggcatgcttcagttgtcagacgaagttctcgcacacaacatcctatcccgcctgtccccaagagacgttgcgtccatcggatcggtgtgcaccagaatgcatgagctgaccaagaacgatcacctgaggaagatggtctgccagaacgcgtggggaagggacgtcaccgtgaggctggagatgagcaccaagatggtaggatggggccgtcttgcgagagagctaacaactctcgaggccgcctcatggcggaagttcacggtcggagggcgtgtcgagccttcccggtgcaacttcagtgcctgcgctgttggcaaccggcttgtcctgttcggaggggaaggcgtgaacatgcagcctatggacgacacgttcgtgctcaacctggaggccgcaacgccggagtggcggcgcgtcaaggtttctgcctccccgcccggccggtgggggcacactctgtcgtggctgaacgggtcgtggctggtagtgttcggaggctgcgggcagcaaggtctgctcaacgacgtcttcgtcctcgacctcgacgcccagcagccgacgtggagggaggtcgcgagcgagggccctccgctgccgcggtcctggcacagctcatgtaccctggacggctcgaagctcgtggtctcaggtggctgcgccgagtctggtgtcctcctcagcgacaccttcctcctcgacctcaccaaggagaagcctgcgtggagggagatccctacgtcctggtcgcccccgtcccgcctcggccacaccacgtccgtctacggcgcgaccaagctgttcatgttcggtgggctggcgaagagcggctcgctccggctgcgctccagcgacgcctacacggtggacgtcagcgaggacagcccgcagtggaggcagttggccacgacgaccgggttcccaaacgtcagtccgccgccgaggctcgaccacgtcgcggtgagcctgccctgtggacggatcatcatattcgggggctccatcgcggggctccactcccccgcgcagctgttcctgatcgatcccgcggaggagaagccgatctggaggatcctgaacgtgcctgggcagccccccaagttcgcatgggggcacagcacctgcgtggtcggcggtaccagggtcctggttctcggaggccacactggcgaggaatggatactgaacgagctgcatgagctctgcctggcaagcaggcccgacgaggacggctgatgacttcttttcgttgcacttgcacacatatggttcgttcgtctctctctgttttacgtcctatatatgcgcgctatgtcttgtttgtgtatcatctactttcagtctgttgctgcgtcgtgtcggtccgtcggtatgagaaaaaaaaaagcggaaattgattttttaaaaattagtctggatgagtttagtctattttattgtcattggagaagttctctttcatcggtctaggataagattctatggtctatatgtatgtatattttcatgtctcagaaaacacaaaaaaaattattgaaggtccaatgtcttgtactcgtattttgtctacacgtttcaaaactgtgtattatgtcttttggatg

SEQ ID NO: 893 - DNA, 526 bp, Zea mays
  UNSURE (1)..(526): unsure at all n locations
  Clone ID: PAT_MRT4577_126890C.1
  unsure (1)..(526): unsure at all n locations
aagggaaattgggagggaggaagtcttcggtccagtcctgtgggtaaagaanttagccctgaagaagaagccantganctggccaatgatacccagtatggtttagntggtgctgtaatttctggtgatcgtgagcgctgccagagattatctgaggagattgatgctggaattatctgggtaaactgctcacagccctgcttctgccaggctccctggggcggtaacaagcgtagtggatttggacgtgagcttggagaagggggcattgataactacctgagcgtcaagcaagtcacggagtacatctctgatgagccgtggggatggtatcgatccccctccaagctgtaaactggcatgaaattttgtttgttccattagaataaatatatctcgatgctatacagaacgaacccgtgtatcaaatggagtatgacattgtgaaaaaggcacatcagcggaacaaatgtcagagttgacaattccctctaatgcaaatagttaactcgcccttgagtaccct

SEQ ID NO: 894 - DNA, 597 bp, Zea mays
  Clone ID: PAT_MRT4577_126925C.1
cgatccaattgtcacttgctctccctgcaacagctaattaaggccggcgcatgcgctcttctagctagatacattattcatggggggagagtaagcaccaccaccaccacctgtttcatcacaagaaggacgaggagcagctcgccccccgacgatacaagcaagtccgccgagtacactgcggccactgtgacggagggggtgcccacggccgacaactagtacaacgagtacaagaaggaggagaaggagcacaagcacaagcagcacctgggcgaggccggcgccatcgccgccggcgccttcgcactctactgagaagcacgaggcgaataaggacctggagcacgcgcaccgccacaagatccatgatgaggtctcggcggctgcggctcgttgttccggcggcttcgccttccacgagcaccactagaagaagaaggaccacaaggaggccgaggaggccgttcggcgagaagaagcaccacttcttcggctgattgatcctcccgaatcgtcgtccctccccgtgtgctacgcgtgcgtgtgagagtgatatcgagcgcccgccgggttttgcgcgcgtacgtatgtatt

SEQ ID NO: 895 - DNA, 1594 bp, Zea mays
  Clone ID: PAT_MRT4577_126939C.1
atctcaaaaattcaaaccgcatcaagcttcccaagaccccagacgaacgccgcgcgctgcacacatcgcccgacccgaaccaaacccttcaaaccccagcgaaaagcgaaggcaatcggaggaacgaatccgcgcgaccaacacgttggcagcagcattaggatccggatccgaagaccgccagcccagagccggaggcgatgaagagaatcggagcactccgcgcactcggcgccgcctctcaacaggccgcgcgggaagcgcaaggccctggccgagctccccaagtccaacggactgaacatgaaccacgactcggcgccgcggccgtcgaagccgagaacgcggtcggcggcgcgagctgaggccgaggcggaggcggcgatgaaacggcggaaggccggagacgccgcgcgctggccgatggacacgaggcagcctgacgctgaagcggcggttgcgccatacgtcggggacatcgaccggtacctccggtccctggaggttgaaccgttgaggaggccaagccatagctattttcaggatatccagaaaaacatctgccccaaaatgagggctatccttgtggactggttggtggaggtggctgaagaattcaagcttcacgcagaaacactccaccttgcggtttcctacgtggaccgcttcctcacaatgaatgtcgttgctcggaacaagctgcaactactgggtgtcactacattgctcgttgctgctaagtatgaagaaattgagtcttctaagatgaaggtggtcaagatggagactgacttactaaaatctcttagctttcagattgggggtcccacagtgacaacatttctacggcaatttatagcttcgtgtcgtggaggcaatagtgcaagcagaggaaaacttgagtttgtgtgcagctaccttgcggaattgagcttgctggattatgactgcataagctatctaccctcagtagttgctgctgcctgcttgtttgtagccagattcataatccacccaaagactcgtccttggaacttgtcacttgaacaaagcacgggttatagagtctttgatctgcagaaatccatttatgtcatacatgaattgcagttgacaataaggtgcccaaatcaggtagccatcagggagaagtacaaggaccccaagtttgggtgcgtgtcgacaatggtttcaccacgagaaatccctacgtctttccttgaaggttgccataagtgaagtccggacttggacttggagaagggtttttgcagtaatgctgctggcgagtggcgatgcagaaaatagcttgatggtaggataatttaagggtaggtcggaaaatataccatggccagcgttgtagatcgttggtacggtactggtctcacagttggtagaatatgcaattgaaggctttttgtacaggagttaggctagtccgtgacacacacgtgtgcatcctctatggtctgtctttgcgcacattatgccgagcgccgaccatctcgtgctgttggcctgtctcaattaccaccagacatttgacacgtggaatctttttaagattcaatttttaaaaattgtatttctc

SEQ ID NO: 896 - DNA, 377 bp, Zea mays
  Clone ID: PAT_MRT4577_126959C.1
cgcatgcagaatatgcatttttcgcccacctgcggtgcgactactgctgctgggggaagggaggctgaaaaggaggcccttgctcccgaccgccgcccgaatcatagtcgtattaaccaccacccatggcggacgtgcacataacctttggtgcgccgtaacgaggaagaaggacttggaggactacttggtgaagttccggtggatactaacgatctttggggtccttactatttcaactctgatctacttcaacatcgtcctgggcgacatgtggtccgtcatgaattcagagaaaaagcgctctaatcagcacgacaagaacgtgcataaggtcgggaatcggctcaagcagatgaacccgaagaatgacggtc

SEQ ID NO: 897 - DNA, 810 bp, Zea mays
  Clone ID: PAT_MRT4577_127009C.1
agtctatactaggagctttggttcttatacttcgcgagaagagattttcctctcagaagcttggtagctttatggagttggcattcggcggacgatatgttattcttctgatggcaatattctaatatactgtggccttatatacaatgagttcttctcagttccattccatatatttggcaaatctgcatatgaatgccgggacaaaagctgcagcgatgcacatacttttggtctcatcaaagtccgtgaaccctatccttttggggtggacccaagctggcgtggaagtcggtctgagctaccctttctaaattcattaaagatgaagatgtctatactaatgggtgttgcccagatgaacctggggattgtattaagttattttgatgcacgatatcatggaaatgctcttgacataaggtatcaattcataccacagatgattttcctcaatagcctttttggttacttagcactcctgattcttatcaagtggtgcacgggctctcaagctgatctttatcatgtgatgatatatatgttccttgatcctgctggagatcttggagaaaatcaactgttctggggccaaaaggaacttcagatattgttgttacttctggcttgatcgctgttccgatgctcttcccaaaaccttttatctgaaaaacttcataggagagattcaggtcacacttatcgttctaggacatctgaaatggatccagattctgacctgattcgccgagcacgtatgatgatttcaattcagcgagttttgtgcatcaatgatacatccattgagtt

SEQ ID NO: 898 - DNA, 191 bp, Zea mays
  Clone ID: PAT_MRT4577_127074C.1
ggtccgtgaggttctccggggttcggttgcgtgggtgagcggatcgagatgacagcgtcgcgggttgagtaccgctgcttcgtcggcagtctctcctgtaccaccgacgaccactccctgcacaacgcctttagcacctacggtgaggtacctggagtccaagaacaatactctatctggagacgcatatg

SEQ ID NO: 899 - DNA, 377 bp, Zea mays
  Clone ID: PAT_MRT4577_127114C.1
ttcactcactctcgctccatttccccatatgccagatccaatttgagaggtctcccttctatgcggccatggggctctctgaggagaagacctggtctggacgggagtacaaggtcaaggatctgtcgaaggcggacttgggccgactcgagattgagttggacgaggaggaaatgccaggtctcatggtgtgccgcgccgagttcggcccgtacaagcccttcgacggcactaggatctcgggggctctccacatgaccattcagaccgtcgacctcatcgagaccctcaccgcgctggggcaccaggtcctatggcgctcactgcaacatgttcttcacgcaggaacacgccggcgtcgccattgcgcgcgactg

SEQ ID NO: 900 - DNA, 218 bp, Zea mays
  Clone ID: PAT_MRT4577_127137C.1
agcatacagacgaataatctctacttcactttactaacaccagctagcaactctttctcggctgcaggaatggccgctcgctcctactcctaccagccgcagctggtcgcagccgctgaggtactggcagcggagctgatgctgctggcggcggcggccgagacagcgtccgagctgtgagctgcagacaggtgacgtcgtcagaggcgccgagcctc

SEQ ID NO: 901 - DNA, 345 bp, Zea mays
  UNSURE (1)..(345): unsure at all n locations
  Clone ID: PAT_MRT4577_12720C.1
  unsure (1)..(345): unsure at all n locations
gcaaggcaagtccccgttgcgcggagctgtcacctgacctgactgccgtcccgggggcgggtccatactaacgctgttacggggccgcccaccgcgacggaacggaaaggtgctgtctacccaccccgtcccagncccatcaccgacgagggccgtgtggataaacaaacccagcggccccagccccctgttcacctcattcccttccttgctttgctcctcccctgcctagactctctcccctatcctcaactccagctcctgctcagcccgatagcgtccaactgcacgcgcgcctactatagccaataatgacagcccgaaggacgcaccgggtgcactgat

SEQ ID NO: 902 - DNA, 353 bp, Zea mays
  UNSURE (1)..(353): unsure at all n locations
  Clone ID: PAT_MRT4577_127230C.1
  unsure (1)..(353): unsure at all n locations
ggcttctccttcccctcttatcaagacctcctgcgctgagggtttcttagggttttgtggacaggcnatggcggcggctgatgtggagtaccgatgcttcgtcggcggacttgcctccgccaccaacaacaagtggctggagaatgccttcacctcctacggcgagatcctcgactccaaggtcatcaccgaccgggagactgggaggtcccgcggcttcggcttagataccttcttctacgagaactccatgctcgacgctatcgagaacatgaactgcaaggagctgcacagccgtaacatcaccgttaaacaggcccagtcccgtggcggcggccgctgtagccgccgcc

SEQ ID NO: 903 - DNA, 366 bp, Zea mays
  Clone ID: PAT_MRT4577_127244C.1
ggtggattctccttcccctccggttctggttcgggttcaagaggttctgcggaatgggagttcgtgggtgagcggatcgagatggcggcgtatgatggtgagtaccgctgcttcgtcagcggtctaatctgggccacggacgaccacttcctacacaacgccttcagcacctacggcgaggtcctcgagtccaagatcatacttgatcgggagacgcataggtcccgctgtttcagctccaacaacttgtacacggacgaggcgatgcagaacgccatcgagggcatgaacggctaggagctggacagccgtaacatcaccgttaacgaggaccagtcccgatacggtcgttgacgccgaaaccgt

SEQ ID NO: 904 - DNA, 536 bp, Zea mays
  Clone ID: PAT_MRT4577_127500C.1
gaatacatggacattgtacttattcaactacaagcatgcccatcgcttattacaatgctagcaataaagggtacgtcgaaataaacagggtgcccatccagcactgatgtgttagccaccagtgttgttctcttcatgacagactcctcacggccatcaggcaatgtcatcgtcaactggggaaagtccatgagaacctcagccatctcgtttcctcgttcaccacagcccacataaaccacagcttcggaattggagtacttggaaagtgcctgactaatgacagttttaccacagccaaatgctcctggaatagcacaagtgcctcccagaaccgaggggaatagtgcatccagtacacgctgccctgtcagaagaggtgtatccgcagcaagcttcgatgcaacaggccttggtgaacgcacaggccatgtctgaagcatggtaaatttcttttttatgccctgaaattccaattctagcactgtgtcctgcaggttgtactggccagctggtgcaatgtaacttattttccc

SEQ ID NO: 905 - DNA, 3844 bp, Zea mays
  Clone ID: PAT_MRT4577_127502C.1
tttttttttttttttttttttttccaaaaaggcaacatagttttttcaacaaacaaataaacatgacgctgatgtttgaatacatggacattgtacttattcaactacaagcatgcccatcgcttattacaatgctagcaataaagggtacgtcgaaataaacagggtgcccatccagcactgatgactaaaatagtggtggcaaagaaatgagtagcggtggggaaaattctcatacatggtctcaatctacaacttccgtaccttataaaacatttggcagccattattgtcttacacaaaatctacagcagttcaccgtgcctcatcttctaggttgcggaacccagtggtaaggtcgtcgtacagtttcttaaacttgccgaccaaagcttcttcgccttctgcaggatcctcgaacttttgggatactaggcgataaaatagatcccccaaccgatgctttatgacactgtatgttatcttatggccgtcagtaccagctgcccgctccacagcctgatttgccaatgtgttgaagtgaataatgttgcgcatcatccaaacggatttgtagaatgggcagaacttatcatatggggtgaatgcattttgtgccaaataatcttctctcaaaagctttgctgtctccagcgtaatcttgtcagattctgccagcgcatctttaccaacaagctgcacaatttcattcagatcgtcctccctctgcaacacctcacgtgcttttgtcctaatatcaatgaaatctggatcaaatttctcgtaaaaagactcaagggccttggagtatttcgaataggaaatgagccaattcacagatgggaaatgcttcctttgagcgagctttttatctaaaccccagaagacctgaacaatactgagggttgcggaggtaacagggtctgaaaaatcaccacctggaggagagacagctccaacaattgtgacactgccagtcctgtctggacttcccaggcatttcaccttaccagcacgttcataaaaggatgccaaacgcgcagccaagtaagctgggtaaccactatcagcaggcatttcagccaaacgccctgagatctcacgcaaagcctcagcccatcgtgaggtggagtcagccatcatactaacgttgtagcccatatcacgaaaatactcggcaattgtaattcctgtataaatggaggcttcacgagcagcaacaggcatatttgatgtgttagccaccaaggttgttctcttcatgactgactcctcacggccatcaggcaatgtcatcgtcaactgggggaagtccatgagaacctcagccatctcatttcctcgttcaccacagcccacataaaccacagcttcagaattggagtacttggaaagtgcctgactaatgacagttttaccacaaccaaatgcccctggaatagcacaagtgcctcccagaactgaggggaatagtgcatccagtacacgctgccctgtcagaagaggtgtatccgcagcaagcttcgacgcaacaggccttggtgaacgcacaggccatgtctgaagcatggtaaaattcttttttatgccctgaaattccaattctagcactgtgtcctgaaggttgtactgaccagctggtgcaatgtaacttattttcccccaaagaaactaggtgttggagatgtcatcacaggtggagatctatacgctactgtctttgagaacacattgatgcagcaccatgttgctcttccaccgggttctatggggaaaataagttacattgcaccagctggtcagtacaaccttcaggacacagtgctagaattggaatttcagggcataaaaaagaattttaccatgcttcagacatggcctgtgcgttcaccaaggcctgttgcgtcgaagcttgctgcggatacacctcttctgacagggcagcgtgtactggatgcactattcccctcagttctgggaggcacttgtgctattccaggggcatttggttgtggtaaaactgtcattagtcaggcactttccaagaattccaattctgaagctgtggtttatgtgggctgtggtgaacgaggaaatgagatggctgaggttctcatggacttcccccagttgacgatgacattgcctgatggccgtgaggagtcagtcatgaagagaacaaccttggtggctaacacatcaaatatgcctgttgctgctcgtgaagcctccatttatacaggaattacaattgccgagtattttcgtgatatgggctacaacgttagtatgatggctgactccacctcacgatgggctgaggctttgcgtgagatctcagggcgtttggctgaaatgcctgctgatagtggttacccagcttacttggctgcgcgtttggcatccttttatgaacgtgctggtaaggtgaaatgcctgggaagtccagacaggactggcagtgtcacaattgttggagccgtctctcctccaggtggtgatttttcagaccctgttacctctgcaaccctcagtattgttcaggtcttctggggtttagataaaaagctcgctcaaaggaagcatttcccatctgtgaattggctcatttcctattcgaaatactccaaggcccttgagtccttttatgagaagtttgatccagatttcattgatattaggacaaaagcacgtgaggtgttgcagagggaggacgatctaaatgaaattgtgcagcttgttggtaaagatgcgctggcagaatctgacaagattacactggagacagcaaagctactgagagaagattatttggcacaaaatgcatttaccccatatgataagttctgcccattctacaaatccgtttggatgatgcgcaatattattcacttcaacacattggcaaatcaggctgtggagcgggcagctggtactgatggccaaaagataacatacggtgtcataaaacaccgtttgggcgatctattttatcgcctagtatctcaaaagttcgaggatcctgccgaaggtgaagaagctttggtcggcaaatttaagaaactgtatgatgacctcaccactggtttccgcaatctcgaagacgaggcacggtgaactagtgtagattctgtgtaaacaaggactgccaaatgttttataagatacataaattgtagattgagatcatctgtaagaattattcccaccgttgcaccatctcttcgccaccactgttttagtcatcggtgcctgatgggcaccctgtttatttcatgtatcatttattgctgtcattgtaataagcgatgggcatgattgtagttgaataagtacaatgtccatgtattcagacaccagtatcgtgcttatttaactacaatcatgcccatcgcttattacaatgacagcaataaatgatacatgaaataaacagggtgcccatcaggcaccgatgactaaaacagtggtggcgaagagatggtgcaacggtgggaataattcttacagatgatctcaatctacaacttatgtatcttataaaacatttggcagtccttgtttacacagaatctacactagttcaccgtgcctcgtcttcgagattgcggaacccagtggtgaggtcatcatacagtttcttaaatttgccgaccaaagcttcttcaccttcggcaggatcctcgaacttttgagataccaggcgataaaatagatcgcccaaacggtgttttatgacaccgtatgttatcttttggccatcagtaccagctgcccgctccacagcctgatttgccaatgtgttgaagtgaataatattgcgcatcatccaaacgaatatgta

SEQ ID NO: 906 - DNA, 2725 bp, Zea mays
  UNSURE (1)..(2725): unsure at all n locations
  Clone ID: PAT_MRT4577_127503C.1
  unsure (1)..(2725): unsure at all n locations
ttcggccgggtattctggtgtcctaggcgtagaggaacccaccaatccatcccgaatttggtggttaaactctactgcggtgacgatactgtaggggaggtcctgcggcaaaatagctcgatgccagaatggccctcctccccatcgcgtctgtccgctacccctccccgaccagatcgctacgagacgccgcgcgatccgacccaggccgacgccgacgacccctctcgccgccggcggccatggcgtacggcgaccggcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaacaagaaagcctctttcagttgaattgggacctggaattcttggaaacatttttgacggtatccagcggcctctaaaaaccatcgctattaagtcaggagatgtgtatattcctcgtggtgtttcagttcctgcccttgacaaagatgtattgtgggaatttcagccaacgaagctaggtgttggagatgtcatcacaggtggagatctatacgctactgtttttgagaacacattgatgcagcaccatgttgctcttccaccgggttctatggggaaaataagttacattgcaccagctggccagtacaacctgcaggacacagtgctagaattggaatttcagggcataaaaaagaaatttaccatgcttcagacatggcctgtgcgttcaccaaggcctgttgcatcgaagcttgctgcggatacacctcttctgacagggcagcgtgtactggatgcactattcccctcggttctgggaggcacttgtgctattccaggagcatttggctgtggtaaaactgtcattagtcaggcactttccaagtactccaattccgaagctgtggtttatgtgggctgtggtgaacgaggaaacgagatggctgaggttctcatggactttccccagttgacgatgacattgcctgatggccgtgaggagtctgtcatgaagagaacaacactggtggctaacacatcaaacatgcctgtcgctgctcgtgaagcttccatttacactggaattacaattgctgagtatttccgtgatatgggctacaacgtcagtatgatggctgactccacctcccggtgggctgaggcattgcgtgagatctcagggcgtttggctgaaatgcctgctgatagtggttacccagcttacttggctgcacgtttggcatccttttatgaacgtgctggtaaggtaaaatgtctgggaagtccagacaggaatggcagtgtcacaattgttggagccgtctctcctcctggtggtgatttttcagaccctgttacctccgcaaccctcagtattgttcaggtcttctggggtttagataaaaagctcgctcaaaggaagcatttcccatctgtgaattggctcatttcctattcgaaatactccaaggcccttgagtctttttacgagaaatttgatccagatttcattgatattaggacaaaagcacgtgaggtgttgcagagggaggacgatctgaatgaaattgtgcagcttgttggtaaagatgcgctggcagaatctgacaagattacgctggagacagcaaagcttttgagagaagattatttggcacaaaatgcattcaccccatatgataagttctgcccattctacaaatccgtttggatgatgcgcaacattattcacttcaacacattggcaaatcaggctgtggagcgggcagctggtactgacggccataagataacatacagtgtcataaagcatcggttgggggatctattttatcgcctagtatcccaaaagttcgaggatcctgcagaaggcgaagaagctttggtcggcaagtttaagaaactgtacgacgaccttaccactgggttccgcaacctagaagatgaggcacggtgaactgctgtagattttgtgtaagacaataatggctgccaaatggtttataaggtacggaagttgtagattgagaccatgtatgagaattttccccaccgctactcatttctttgccaccactattttagtcatcagtgctggatgggcaccctgtttatttcgacgtaccctttattgctatagcattgtaataagcgatgggcatgcttgtagttgaataagtacaatgtccatgtattcaaacatcagcgtcatgtttatttgtttgttaaaaaaactatgttgcctttttggaaaaaaaaaaaaaaaaaaaaaaaaaaaaaaaaaaaaaaaaaaaaaaaaaaaaaaaaaaaaaaaaaaaaaaaaaaacccccnccttggggctttttgttttgcccccaattgggtggggggctttataaaacggagaaagggaaacacccttggcccgtttacttggggaacccaagggaattcccccttgcggaaccttgttgaaatgggaaggggtttgttaaccccaaatttaccggggccgatgcccgaaacccctcttgatatcccccgccgggggagcccggacttccccagggaaagggaggttttgggggggaac

SEQ ID NO: 907 - DNA, 2580 bp, Zea mays
  Clone ID: PAT_MRT4577_127724C.1
cgtcagcccctctctctcccggcgtggggtggccatagcttcgctgcctccacttgtcttctttgtttcaccatcagttcaattcagtttctcgccggtcgccgctggcttgctagttgctactgcgcgcacttcagctgcccgctgttgtaccgcggactctacctcatcattcgccttgctgcctccgccgcctaggtcgcgcaggttcggacgccatgaccgcgacgccggcggtgatcgggctgagcgcccgcggcaaccgcctcctggccacctcattcggttccgctgagctcgctcccccggacgcgtacccgtcgcggcagttcgccgccgcagcgcccaagctcaccgtcgtggcgcaccgcgcctccgcctccgcctcctccccggccgacatcgggggcgccggccacgcgcgcgcgcacgccatccgggcgctcaggaaccactccgcgccggcgctggccccgcctcctccggctgacccggctccggagctggactccaagttcgagttcgagttcgagtcctcgctggaggccatcgtgctgctgcagcgctccatgctcgagaagcagtgggagctgcccttcgaggacgacatctcctccacggaggacgaggacgaggacgagaggtccacggtggtggtggcgcggtcgggcgtctcggcgcggcagcggcggatgagcgggcggcggcggggcgctgtcgttggccggaagagcgtcaccgtcagcccggagctgatgcagagccggaaccgcatctacctccggggcaccgtcagcaaggacctcctcacgcacaagcaggtcgtccagctctccaggaagatcaaggacggcatctggcttcagcaccaaagatccaagctgaaggagaaactgggcaacgagccgtcatacaagcagctggcgcaatcgctgcggataccagctcctgagctgcgagcgaggatgcgcgagtcgtttcttgcgagggagatgctggcgatgagcaacacccgtctggtgatatccattgcccagaagtacgacaacctcggcgtcgagctgccagaccttattcagggtggtctgatagggctgctccgtgggatcgagaagtttgatgcctcaagggggtttaggatctccacctacgtgtattggtggatccgtcagggggtttcaagagcattggccgacaactcgagatcgttcaggctccctacttatttgcacgagaggttggtagccattcgcggcgcaaagtacgcgttagaagaccaaggaattgctccgacaatagagaacatagcagagtcgctcaatatatcggaaaagaaagtgcacaatgctacagaggctgtgaacaaggttctttcactggatcaacaggcgttcccctccttaaacggtctacctggggacacactccatagttacatagaggatcaaaacgtcgcaaatgatccatggcatggatttgaggaaatgtatctcaaggaggaagttaacagtcttataaattcaactctcaacgagcgcgagagggacattattcgattatatcatggcataggaaagcagtgccatacatgggaggatatcagcagacaattcgggttgtcgagggagcgcgtgaggcaggtagggctcgttgcgatggagaagctgaagcatgctgcaaggagggaacatttggatgcgttgcttgaggaatactgagtgagatgttcttcgcttgagtcggttaattccaccgttgcagtggttgtatatactccggaaacataggggggcaggcacatcatccttgaaaggcttcactgccactcactcactctgcagataactatacatgtacatctgtgacgatcagtaggcatgcatagttaaagcatctgtggctgcaaaatcgtcaaggcgatccaacaaaaggagaaccttttttttggtcttggaagctctacaaagtgtgatgtggtatgtatatgcaaatgtaatgtatcagtaattcagtagagcaataacgtttatgtcctggatttgtattcttgtccacctacatagaaggaaaaaatgcttaccacttaaaaaaaaaaaaaaaaaaaaaaaaaaaaaaaaaaaaaaaaaaaaaaaaaaaaaaaaaaaaaaaaaaaaaaaaaaaaagcatgctgcaaggagggaacatttggatgcgttgcttgaggaatactgagtgagatgttcttcgcttgagtcggttaattccaccgttgcagtggttgtatatactcggaaacataggggggcaggcacatcatccttgaaaggcttcactgccactcactcactctgcagataactatacatgtacatctgtgacgatcagtaggcatgcatagttaaagcatctgtggctgcaaaatcgtcaaggcgatccaacaaaaggagaaccttttttttggtcttggaagctttacaaagtgtgatgtggtatgtatatgcaaatgtaatgtatcagtaattcagtagagcaataacgtttatgtcctggatttgtattcttgtccagttacatagaaggaaaaaatgcttacaactgcag

SEQ ID NO: 908 - DNA, 1193 bp, Zea mays
  UNSURE (1)..(1193): unsure at all n locations
  Clone ID: PAT_MRT4577_127949C.1
  unsure (1)..(1193): unsure at all n locations
gcgtgaggcgtgagtccgtgaccattcccgtcggccgtcccaaaagaagcgcaaatttacaacccagtccaccacgggccacacaatcccaaatctaaccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcgggcccgggactggcggagcggttcctcagggccttccggccggcgctgtacgaggtgctggcgtcgacggcgacgacgtgcgaggcggacggcggcgccgacggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgatccggtaaaaaccaccccggccccccaccccccggcgagcggtgaccgcccccgtcgcgcgcgcctcggctgtgtgctgcaagttccgtgtggccttccgtgtacgcgtagcaaaccaaagaagaagaaaaaaaaaagagaaaaaaaaaggtgtaggagcagtagtagactagtagtagtgcagggttgctgtcgcttgctttcccctttcgcttcttgtattccccctcccattctctttgcgttttccgttccgtgctgtcgcctgtagcgtgtaaatactccggttcgcacttggcagcagaggcagagtgtagagtgctcccgtggccgtggctgtggctgatggtgtagcactttttacgagctcagctcgtgtagtacattgcatcctcttctgttcgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanggggggggnnntttaaaggaaacaaattttaaaacgggggggagggagaaaaatatttttt

SEQ ID NO: 909 - DNA, 989 bp, Zea mays
  UNSURE (1)..(989): unsure at all n locations
  Clone ID: PAT_MRT4577_127956C.1
  unsure (1)..(989): unsure at all n locations
gccgcagcccgcaacagcagcgacacgcaaccccccgttcccctatcacgccacccggctccacggaggagggagaccgttcgccgcagatccttggtctcgatcgcggcgctggcggggctggtgcgggcggcgctggtgttcctggacctgcaggccgcgctgccgcccggggacgacggcggggaccgactggcggcgtnngncccgggactggcggagcggttcctcagggccttccggccggcgctgtacgaggtgctggcgtcgacggcgacgacgtgcgaggcggacggcggcgccgacggcgacgactgcagcgtgtgcctggccgggttccgggcgagggccgtggtgaaccgcctcccctgcggccacctcttccaccgcgcctgcctcgagacctggctccggtacgagcgcgccacgtgcccgttttgccgggcccacgtgcccctccccgccgacgagacgccgctgctccgctacccggagttcgagtgatccggtcggtaaaaactaccaccccggtcccccaccccacccaccccccggcgagcggtgaacggtgacccccggtcgcgcgcgcctcggctgtgtgctgcaagttccgtgtggccttccgtgtacgcgtagcaaaccaaagaagaagaaaaaaaaaaggtgtaggagcagtagtagtggtgtagggttgctgtcgcttgcttattgctttcccctttcgcttcttgtattccccctcccattctctttgcgttttccgttccgtgctgtcgcctgtagcgtgtaaatactccggttcgcacttggcagcaaaggcagagtgtagagtgctcccgtggccgccgtggctgtggctgatggtgtagcacttttacgagctcagctcgtgtagtacattgcatcctcttctgttcaaaaaaaaaaaaaaaaaaaaaaaaaaaaaaaaaaaaaaaaaaaaaaggacggcgctcgcgatnctagaacta

SEQ ID NO: 910 - DNA, 3186 bp, Zea mays
  Clone ID: PAT_MRT4577_127957C.1
attggttttcctagtttttgtacataaacatttggtctatgcgttagtgtctctcacattatccgctatataacattacaattaagattcatctaaatactggtaatttgaaagcgacagacataaaacttgtagatgaattattgtcttccaaaggtaaccgcgaacggatgagtagcagattaacaccagaactgtgaaaaacgaaagaaaagtttggtaagtgaagatggatcgacaaggagaatgaataggagctgatctggaccagagtgatgaaggatcgccgatagaatttgatgagaagagccggcgccggcggagggcgccgggtgcggtacgtgcggaggcgcgtccgggcgggcggatcggccgaacgggagccacgtgccggctttaaacgtaggaccagtggctatttaatcggacggtcgtgcggccgttggacggcgctgggtccaacgcgcggtggtccccccccgctccccgtcgtgcagccctcctctcgcttggcccctgacgccaccgctcccgccgcgattccgcccagttcttttcacgtttcgagtgctccgtaaatccgcactacgtatcccccactcctcccaccgctggccagagaccgtgtaaccgcgcgccgaatgttgcgggatccagtcaaaacttaccccagtcctgttgcgcgtaggccgtactttccacgttccgttaggccgtccgtgtagtcgtaggaagataaacaatcaggtacataagaagttcgacgagtcgttgtccagcggactgaataattggatcccctgcgctgcgctgcgcctcactacccgcacctctcattctctttgctgtttccgttccgtgctgtagcctgtagcgtgtaaatactccggttcgcacttggcagcagaggcagagtgtagagtgctcccgtgcccgtggctgatggtgtagcactttttacgagctcagctcgtgtagtacattgcatccttcttcctatccaaacaagatagagccagccgcagctataaaaatgcacgccaccccccctcgccgtgggggtgtgtgtgtgtgaccgtgcgtgaggcgtgagtccgtgaccattcccgtcggccgtcccaaaagaagcggaaatttacaacccagtccaccacgggccacacaatccccaaatctaacccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccgactggcggcgtcggcgcccgggactggcggagcggttcctcagggccttccggccggcgctgtacgaggtgctggcgtcgacggcgacgacgtgcgaggcggacggcggcggcggcggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgatccggtcggtaaaaactaccaccccggtcccccaccccacccaccccccggcgagcggtgagcggtgacccccggtcgcgcgcgcctcggctgtgtgctgcaagttccgtgtggccttccgtgtacgcgtagcaaaccaaagaagaagaaaaaaaaaaggtgtaggagcagtagtagtagtgcagggttgctgtcgcttgctttcccctttcgcttcttgtattccccctcccattctctttgcgttttccgttccgtgctgtcgcctgtagcgtgtaaatactccggttcgcacttggcagcagaggcagagtgtagagtgctcccgtggccgccgtggctgtggctgatggtgtagcactttttacgagctcagctcgtgtagtacattgcatccttcttctattcaattctccccgactggctaaaatatcgaggattgttttggaattggaacggttgtgtgtgcgtgcagtgcatactgtaataataactccacagcaaaaattacagcaaaatctgcagaattcatgtgcgaaacacgaaggcatcttctacgtacgggtgttccgattcgttgaaaggcacggattggttgggcgtttgcttagacggggctgcgacaggtcacatggacgacggcgtggtggagtggtacgtgcgtgggccccggcgtcgccgatggcacatgcggtcctcgcacccgaaaggaacctcgcgagcgtgcgtgcagtgcaccaggccaggcatcggaatggatcaagaccaaccgtactgcacgtctgcaccggaagccggaagggatgaacatgaaccccggaaaagaggcgtcacagtcacagcagcatggcggcagaggcacgatacacgacaggagaagcaccatagctacaagagcacaggtgcgttggatgaggacgcgcagtagccgccagttctcatccgatccacggtacgggggcatggcttttgtcgcatcgcgccgcgcgaggatttgcctccttcggccttcggggtgaagtcgaaccggtgcgccgaccgcggagtgagtgagcgagtgagcgagcgagcgcaggtccttgttgtcgctcgcacaccaccgtccaacagcacgcagtacgcgactgcgagcagcaagtttgttgcgacgtcggcttcagaccagaacgtcgcgttgtgcaggcaggcaggcaggcatatcatcagcgcctggcttggcttctccactccacccagccagcgtcatctgataaagcttggccggctggcctcgtccgacagacgaagcaagcaaagcaaacgcgcgttttttgcctgtgtggactttggagtgtagacacgccgcacgcagtcacgagcacgcacacgcacagtaagcagctggagataaacgtggttcgagttggatgggatcggaggcccccaagcaggaacgcatctcctgtctcgcgtcgacacgacacggcttgactcttgagcttgtgttgtgctttggtaaccgatcgtctgcttgctcagc

SEQ ID NO: 911 - DNA, 648 bp, Zea mays
  Clone ID: PAT_MRT4577_128071C.1
gatacacatattattgagaccaactagcaacatagaaagcacaatagtgtaccaacaatggcagccaaaatattttgcctccttatgctccttggtctttctgcaagtgctgctacggcgaccatttttccacaatggctacaagcttctattggtttccttctttccccgtaccttttaccagcgggggttttgggttgggaaaacccaattttttaacccttttggatccaacagggaattggaggtgggattttacctttattacccttggttcttcaacaattattaacccttttacaggagttacctttggtgcatttattggcacaaaacattagggcacaacaacttccacaacttgggcttgcaaaccttggtggcttcttttagcaacaacaggttctttcattcaaccaactagctgtattgaactctggttcttatttgcaacaacaacaacttccattcaagcaggtatctggtggctacccccagcaatttctttcattcaaccaactgacaggtttgaactcttctgtgtttttacacgggcaacaactccttccatttagccaggttgctggtgtgagccctgcgtcctctttgtcacaaccacaattgttggcgttttaccaggacgctgtg

SEQ ID NO: 912 - DNA, 1171 bp, Zea mays
  Clone ID: PAT_MRT4577_128099C.1
cattgggtacctcgaggccggccgggattccccatctcccttcattgctcgctcgctcgctcgttgctcttctccagcagcagctccttcaaatgcaaatctctttgctgccgacgcagagactcgccaaatttccctccctcctcctagccttctcgtcgctcctgttcttctcgcatcctgctctcccatccccatccccagcccaggtggtgtcccctgtcgcgttgatgcatgctccctcggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtgagttgcgacgatacgttcagaatcagaatcgctgatactcctacgtagaattatacctacctaattgatgacaccgcaccgcacctcgttgtgctgcctgtccttgtacgtttactaattactgctgcctgtatgtaaatcaaaatctgaggctcccatttcgaaacggacggtgaactactcttcccgtttcgtttcatacgagaatcgaactcgttttcaatt

SEQ ID NO: 913 - DNA, 1685 bp, Zea mays
  Clone ID: PAT_MRT4577_12812C.1
atcatggccgtcgcgctcgcgaatggaggaaacaagccgcccgactggcaggacttcgtggggatcatcactctgctcattatcaactccacaatcagcttcattgaggagaacaatgcgggcaatgccgctgccgctctcatggcacgcctcgcccccaaggccaaggttctcagaaatggccggtggaccgaggaggaatcggctatccttgtgccaggagacatcatcagtgtgaagcttggggacatcattccagccgatgctcgtctgcttgaaggggatccactgaaaatcgatcagtctgcactcaccggcgaatcccttccggtcaccaaaggccctggtgatggagtgtactctggctccacttgcaaacagggtgagattgaggccgttgtcattgccaccggtgtgcacacattctttggcaaggccgcacatcttgtcgattcaacaaaccaagttggtcatttccagaaggttctcactgccatagggaacttttgcatctgttcaattgctgtgggaatgctcgtggagcttgtcgtcatgtacgctatccaacacagggcttaccgacccggaatcgacaatctattggtgcttctgattggaggaattccaatcgccatgcccactgtcctttctgtgaccatggcaatcggggctcatcgcttggctcaacagggagcaattactaagagaatgacagcaattgaagaaatggctggcatggatgttctttgtagtgacaagactgggacattaaccttaaacaagttgactgtggacaagagtcttgttgaggttttccaaagaggtgttgaccaagatacagtaattttgatggctgctagagcttctcgcacagaaaatcaggatgccatagatgccacaatagttggtatgctggctgatccaaaggaggctcgtgctggtgttcaagagatccattttcttccatttaacccaactgataaaagaactgctttaacctaccttgatggagaggggaaaatgcatcgtgttagcaagggagcaccagagcagatccttcatcttgcccacaacaagtcggatattgaaagaagggtcagagctgtgatcgacaaatttgctgagcgtggtctgcgagcacttggtgtggcttaccaggaagtgccagatggtaggaaagagagtcctggaggaccatggcagttcattgggctcttgcctctttttgaccccccgcgccatgatagtgcagaaactatcagaagggcactcaatcttggtgtcaatgtcaagatgattacaggtgatcaacttgctattgggaaggaaactgcacgtcgtttgggaatgggtactaatatgtacccttcttctgctttactcggacaaaataaggatgagtcaattgcttctttgccaattgatgatttgattgagaaggctgatggctttgctggtgtctttccagaacacaagtatgagatcgtgaaacgcttgcaagcaagaaaacatatatgtggcatgactggggatggtgtaaatgatgcaccagctttgaagaaggctgatattggtattgcagtagcagattctactgacgcagctcgtagtgcttctgacattgtcctaactgaacctggccttagtgtgattattagtgctgggctgacgagtcgggcaatttt

SEQ ID NO: 914 - DNA, 337 bp, Zea mays
  Clone ID: PAT_MRT4577_128163C.1
actagaaactcagtgccacatagcatgatttatccaatgtcaatgcacttacaatgcaaaaggaataagattagcccccgtacaggtacattcttatgcctgtgctgactgtcaaaacataagaaagaccagtgtgtttttaaacgaacaaagccaatcatcgcatggttcgatcatctcatatgagctatcccagcacttacaagctcctgaatcttctgtataacccaggcgttcttcaggagctcctgtgacggactaggactctcctggacaatattacaacctgcaccatgataaggtcggtaacaatgatctgtacctatggatcttgcat

SEQ ID NO: 915 - DNA, 1474 bp, Zea mays
  Clone ID: PAT_MRT4577_128306C.1
cgcttcctccctcccccactactccactagtcggattgctccgattgcccgcgggcacccatgtcgtgccccctcatgccgcttcctccggggctcgccgtatgtgaacaagcaaggaagagccagaggcgagcgagcaagccgcgggcggcgggggcgggactgaccccacccatccaccgagctgccctgctacacggtcccctgccaagatccatcttcccggttccgccgcctgatcgaagtgaacaagcaaggaagagccatggcgagcgagcacgcggcggggggcgaggctaagcatgaccagaagcagagcctgatggacaaggcgaaggggttcgtcgcggagaagatcgcgcacatccccaagcccgaggcgacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaggaggtggcgtccggcaccatgccggaccccggctggatcgccgccagcggctccaccgcgctggagatccccgccaaggtgccctacgacttcctcgtctccctcgtcagggacgtcggccgggactgggacatcgactacgagctccaggtcgggctcaccgtcgacctccccatcgtcggcaacttcaccatcccgctctccacctctggcgagttcaagctccccaccctcaaggacttgttctgatctagtagtagctcgcttgccttgtgttctgtgcgggcgcgcaccagcgatctgtacgacgagcttttgcaaataaacgacgcagctcctctgttctatatatctcaatgaatgcctaagctaaggggatggatggtttaatttgactaaataaagagctggatttcattcaggttcctgtctctaagctggatttcattcgggcatccaccgtgatctggatgtgcctgccgcgtccgtccacaagcccacctttaatttgcccctaaagataaggtgaggtagatgacaaagaaaactaagggtgtgtttggcatggctctgctccaccccagagcagctctactctaaaactctgggtggagcagctctgctccagagtttagattgtttctcataaccagtggcaatggcgggtaaataactcaaaactccatgactaggttgcttttttggagttttcagagcagcaaaagaggtactccaaaaaattgtactgcagctccaaaaactccatagagtttacaactctggagttagggtgtttggcatgctttggccagctcctccttggagttttgctctggagccatgccaaacaggccctaatactccttccgtttctttttagttgtcgctggatagtttaactttacactatacggagggtgtaataaccttacattatagccatcatatatgcccatt

SEQ ID NO: 916 - DNA, 586 bp, Zea mays
  Clone ID: PAT_MRT4577_128341C.1
gttggcttctcctccccctccggttcgggttcgggttcgaggggttctccggggttcgggttcgtgggtgagcggatcgagaggcggagtaagatgttgagtaccgctgcttcgtcggcggactcgcctgggccacggccgaccactacgcagcacaacgccttcagcacctacggcgaggtactcgagtccaagatcatcctcgatcgggagacgcaaagggcccgaggattaggttatcacaccttctccacagcagaggcgatgcacgaacgccatccagggcatgaacaggaaggagctggaccgccgtaacatcaccgtcaactaggcccagtcccgctgtggcacaacgaggcggccgcagtgggtacagtggtggccgtggaggcggcggctactgctgaggcggacgcccagatggcgggggaaggtactggggcggcagcggctaccggggcaacgcgttactaccgtggcggtggctgaggctacggcgggggcaaccgaggcgggggctacagaaactccgaccgcgaactggaagaactgaacggtggggcccgctcggacaagttatcctgaa

SEQ ID NO: 917 - DNA, 1588 bp, Zea mays
  Clone ID: PAT_MRT4577_128747C.1
ttgggtacctcgaggccggccggattgggccgcgggactcggcgacaggccttttgtagaccgcagccggcaccatctcttgccgcaccccccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatcaatggctggtctcagtggtctatacgtatgctttttggttctcttgattcctcacagggtgagtgggggcatgagcatttctctgtctcatctcaatgatgtaagttttctgtttggtgtctcgttccaagatgacttcagaatccgtaaatctctgaagtctaaacgctctatctaaacctttggattcgattacaattgtagatatagaaatctgtagaagggtgcaattcagaatactttgccatgaaatgaatatccttcttgtgagactctgtattaagactaaaacagctcaaattgatagagattctgtgattccttccc

SEQ ID NO: 918 - DNA, 1842 bp, Zea mays
  Clone ID: PAT_MRT4577_128748C.1
cccacgcgtccgcccacgcgtccgggtttccttcctcctccagtgctgtcatcgccgccgccgccgccccggtttccttcgtaagcccgtcgtcctccgtccgcgactctgcgcgagaagcgagagtatggacacccaagtgaagcttgctgttgtggtgaaggtgatgggaaggaccggctccaggggtcaggttacccaggtcagagtgaagttcttggatgaccagaaccgtctcatcatgaggaacgtcaagggaccggttcgcgagggagacatcctcacactgctcgagtctgagagggaggctaggaggctgcgttgaggcggaatagtgtcttggtagttttcgtatggagttggatgaccagaaccgtctcatcatgaggaacgtcaagggaccggttcgcgagggagacatcctcacactgctcgagtctgagagggaggctaggaggctgcgttgaggcgggatactgtcttggtagttttcgtatggagttggatgtcatctaattgtgctatgtttggcaaactttggtatgacctttaaaacacctgccttgtatgattatttgtgagcctggtggtaagattgcagtttggtttttaaaaaaaaaaaaaaaaaaaaaaaaaaagccgcaccccccattcgaacgccggagctcgacgaggacgaccgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgctcccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgggttgggaagccctttaaactgttgtcacttgcattttaccttttccatcgctgtttattgtgagtggtcctatatcaaaaaaaaaaaaaaaaaaaaaaaaaactcgag

SEQ ID NO: 919 - DNA, 1351 bp, Zea mays
  Clone ID: PAT_MRT4577_128750C.1
gcaccccccaattcgaaagccggagctcaacgaggacgaccgacgacgcacgcggtgtatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgggttgggaagccctttaaactgttgtcacttgcattttaaccttttccatcgctgttcagtggtcctaaatctatggctcgtctcagtggtctagtatatgttttcttggttctctcttgattcctcacacggtgagtgggaccgttcgcatttgtctgtcccatcccatcttaaggtgaatgtgttctgtttggtgtctcgttctgatgtgaatttgcaccatatccatttcatcttcaataagatagtattttat

SEQ ID NO: 920 - DNA, 1520 bp, Zea mays
  Clone ID: PAT_MRT4577_128751C.1
ccggaccgggacacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcgtcacgcattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcgccatcccccacctcgtttcaggcgggggacgctggagcctggtccggttgggttgggaagccccttaaactgttgtcgcttgcattttaaccttttcatcgccgttcagtggtcctaaatctatggctcgtctcagtggtctagtatatgttttcttggttctctcttgattcctcacacggtgagtgggaccgttcgcatttgtctgtcccatcccatcttaacggtgaatgtgttttgtttggtgtctcgttctgatgtgaatttgcagcatctcgatttcatcttcaataagatagtattatatt

SEQ ID NO: 921 - DNA, 2429 bp, Zea mays
  Clone ID: PAT_MRT4577_128794C.1
ctcgaggccggccgggccgggatttcaactctggcaccggaatgtattggcccctcacctgctcggctgctccccttctgtccagcccacgggagggcgactagggttagggccttaggggcgacgccaaccatctagccaccggaggtcgccgcgcctgcccagatccactcatcccttccgttcaagccgccggagctcccaggacgctggtgtcgaagccgtcgtcccttccttccaggcccgcctcctctctgtccgttctgtcttggtcgccgaagctcaagaccacagtgtcaggaagctctccaatcttccagccaaacacaattcatcagtcagatacacttttaccaaggaatttttcagaatcactccacgagaggttcagctctcgaagctagagaagcagagctctaccaaacaggccaggacgtctctcaaatccccagctcagtaactagctaacagtagctggcggctcggcgcacctacagcgccgtataccgagtccgagaccacgactccacgagacgacacaaaccccagtttaggaacagttggaaaagagggagaaatggagaacggcggcggcaaaggcgacgttcccaacgatgcgaacgaacattgccctggaacgcagtcggaggaggcggggaaggcggatgcctgcgctgggtgccccaaccagcagatttgcgccaccgcccccaagggccccgatcccgatgtggttgctattgttgagaggttggctactgtgaaacacaaattattagttttgtctggaaagggaggtgttggaaagagcacattctcagcccaactctcctttgccttagctgaaatggaccatcaggttggccttcttgacatagatatatgtggccctagcatcccaaaaatgttaggcctcgagggacaagatattcatcagagcaaccttggttggtcacctgtgtatgtcgagtccaaccttggcgtgatgtcgattggtttcatgctgcctaatccagatgacgctgtcatatggaggggtccccgcaagaatggactgatcaagcagttcttaaaggatgttgactggggggagattgactatcttgtagtggatgctcctccaggaacatctgatgagcacatctcgattgtgcaataccttcaagccacaggaattgatggcgctataatcgtcacaactccgcagcaggtctctcttattgacgtgaggaaggagataaacttctgcaagaaggtcggcgttcctgtcctaggtgttgtggagaacatgagtggcctgaggcagccactttcagatctcagtttcgtcaagcctggtgaggcgggcgagacagacgcgacagagtgggccctgaactacatcaaggagaaagcccctgagcttctgtcagtcatggcctgcagcgaggtatttgatagcagcaagggaggcgccgagaagatgtgccgtgaaatgggggttcctttccttggcaaggtgcccatggatccgcagctgtgcaaggcggctgaggaagggaggtcatgcttcagtgatcagaaatgcggtgccagtgcgccggctcttcagagcattgtaaagaagctgatcaagactgggtgagaaaataatgttggcctgctgggaatctggtagtgagaattgagatgaacaggtgtcagagttgtcatgaccaatatatatgttattgtgttttgaacactgaatctgtgtattagactattagtgccagtactagtattggatctgtaagtttttttttgttcgtgaatcaccagtgggtggactgggtgtacaaactgcggccatatttctgctccacgaagtgaaatatgtttcgaggcactgcctgtatcccgaaagacactggatgggggttgcttctgtcagtgtggtaaggtgcccaatatatacctattgtgttttgaacgctgaatctgtgtattagtgctagtattggatctgtaagttttttttgttcgtgaatcatcagggggtgcacgggctattaaaagccaagtttctgctctaccaagtggactatgtttgcttgaacgatatgtactgtacgcaccagaactgaatgagagtgtacggtgtttgcaaaatataaaaaataaaaaaatcgtaaaataaaaaatctgaattaaaaaaaaaataaaaaaaaaaagtttttgtacgttaataatcagtgggtgcacgtaaaattaagtggagtagggggtgaggctttttaaaggtgctaattactgtccgtaggggagtgcacggtgtcaacaatatccctgggtgcgcctcattgctctctagtggcacgagcactacatgtttgtaatcaagctaccaggtagttggtctgtcgggcaagaaatcagatcggcaccttatacatgtttgtcatcattac

SEQ ID NO: 922 - DNA, 2187 bp, Zea mays
  Clone ID: PAT_MRT4577_128796C.1
cgacagaagagcgctcacgtccggtgccctcgtacgtcggctcgagtattcttcactgcacgacggctcggaattcgatcgtacacgatatgcggacaacgccgcacccttctatctaggccagactagaaggtagaagaagcaacgacggtcaggacgggctagctatttgttaactctggcccctcacctgctccccttctgtccagcccacgggagggcgactagggttaggggcgaccggaggtccccgcgcctgcccaaatccacccatcccttccgttcaagccgccggagctcccaggccgctggtgtcgaagccgtcgccccttccttccaggcccgcctcctctctgtccgttctgtcttggtcgccgaagctcaagaccacagtgtcaggaagttctccaatcttccagccaaacacaattcatcagtcagatacactttgaccgaggaattattcagaatcactccacgagaggatcagctttcgaagctagagaagcagagctctaccaaacaggccaggacgtctctcaaatccccagttcagtaactggctaactgtaggagaaggagagagagatggagaacggcggcgctaaaggcgacgtccccgacgatgcgaacgagcattgccctggaacacagtctgaggaggcaggcaaggcagatgcctgcgctgggtgccccaaccagcagatttgcgccaccgcccccaaggggcctgatcccgatgtggttgctattgttgagaggttggctactgtgaaacacaaattgttagttttgtctggaaagggaggtgttggaaaaagcacattctcagcccaactctcgtttgccctagctgaaatggaccatcaggttggccttcttgacatagatatatgtggccctagcatccctaaaatgctaggccttgaaggacaagatattcatcaaagcaaccttggctggtcacctgtgtatgttgagtccaaccttggtgtgatgtcgattggtttcatgctgcctaatccagacgatgctgtcatatggaggggtccccgcaagaatggactgatcaagcagttcttaaaggatgtcgattggggggagattgactatcttgttgtggacgctcctccaggaacatctgatgagcacatctcgatcgtgcaataccttcaagccacaggaatcgatggcgcgataatcgtcacgactccgcagcaggtctctctgattgacgtgaggaaggagataaacttctgcaagaaggtcggcgttcctgtcctaggtgttgtggagaacatgagtggcctgaggcagccgctttcagacctcagattcatcaagtcagatgaggcgggcgagacagatgcgacagaatgggccctgaactacatcaaggagaaagcccctgagcttctgtcggtcgtggcctgcagtgaggtatttgatagcagcaagggaggcgccgagaagatgtgccatgaaatgggggttcctttccttggtaaggtgcccatggatccgcagctgtgcaaggcggctgaggaagggaggtcatgctttgctgatcagaaatgcagtgccagtgcgccggctcttcggaacatcgtgaagaagctgatcaaggccgagtgagaaaatagtgttggcctgctggggaatctggtagtgagaaatgagatgaaatgacagatgccagagttctcgttaccaatatatatatatgttacggcgttacacactgaatctgtattagtgctagtgttggatctgtaagtttttgttcgtgaataatcagtgggtgcacagactattaagtggactatgttttgaggcgctgcttgaatgatctgtactgtacgtaggggagtgtacggtgttagcaatatccctggctgcgcttcattgctctctcgtggcacgagcacgacatgtttgtaataaagttaccaggtagtggggctgtcgggcaaaaaatcaggacagcaccttagacatgtttgtaataattagctgaatgcccatgcgttgcaacaggaatatataatactagtatactatgataacttatatacaaaatattaccagtatactacgataacttatatttttccaaaaaaaaaaacgaaagtaaaaaaaaaaaaaagggcggcaaaactagaggatccaagctcacgttgggtgttt

SEQ ID NO: 923 - DNA, 285 bp, Zea mays
  Clone ID: PAT_MRT4577_128800C.1
tttctattactacatcctatagtgagtcgtattaacaggagtaacaggccatcgccttaccagttctggtcccagatcacttaaggagtacgtgccgcgtgctcatcactcagccccaggggaggggagttcaagaacggccgcgtttctgcaacgaacatctattccctgtgcatggcgacgccccgctccgacccgcttaaatgggggaaggctggcgccgatctgatgggcatccaactgtacgaagtcaagcggatcgtggcgtagtatcggcatcccttg

SEQ ID NO: 924 - DNA, 2576 bp, Zea mays
  Clone ID: PAT_MRT4577_128868C.1
gccggccgggtcgggaaaaaaaaaaaaaataaacggtagcagtgcaagccccgcttttcatggcgtgagcgccggggcaaggcaagtagccgctgcgcggtgctgccacctgacctgactgccgtcccggtccccggtccatccgaacgccgttacggggccgcccaccgcgacggaacggaaaggtgcggtcaacccaccccgtcccagtcccatcaccgccgggggccgggtggataaacaaacccagcggccccggccccctgtccgcctcattcccttccttcctttgctcctcccctgcctcgcctctctcccctctcctcgcctccagctcctgctcggcccgctcgcgtccagctgcgcgcgcgcctgcggtggccgtgaaggacagcccgagggacgcgccgggtgcactgatctgggggccgcgtgtccccggtggtggggcgaggcggcgccggcttccaggaatgggcagcttgtagtggctgtttcttttgcatatgcactttctattgttgttgtcatttcaaaggaggccatagtctcctggattttgtatgccttgttatctggaattggtgaccatagatgtcatttcgtagcatagtccgtgatgttagggatggcttcggcagcttgtcgaggagaagctttgaggtgaccctcgcaagcatttatggccttactgggcatcacaaagggaagacccagagctcatcacatgtgctcgacgactcaccttccataatttgtgaaagtcgctgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccggagttttgtggcaagctcaccttccctgtgtctctaaaacagcctggtcctcgagatggaaatacaatggtccagtgttttataaagaggaataagtcaaaatccacttaccatctctacctgtgccttagcaatgttgttacttcagaaagtgggaaattcctcttatcagctaaacgacaccgcaaaaccacatgcaccgagtacactatatcaatggattctggcaacatctcaagatcaaaaagaacctacattggaaaaataaggtctaacttccttggcacaagatttttaatttatgatacacaaccgccctataatggggctgtagttcctcctgccggaaggacaagcaggaggttcaactccacaaaagtctctccaaagctgccttcagtcagttacaacatcgcacaggtatcgtatgagttaaatgtccttggcacgagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcatccatggatttcaatagcgctcgcttctctgacatcgctggcagcagcgctcgcttcacgggcgttcctggtagcagcgctcgcttcgcgggcgttcctggcagcagcgctcgcttctcgggcattgctggcgccagactggacaacgacgaggagagtgaaaccaaggagaggccactggtgcttcgtaataagccgcctaggtggcacgaacagctgcagtgttggtgcctcaacttccgtggccgtgtgacaattgcctcggtgaagaacttccagctgatcgccgcggctaccccgccaccggcaggtgcgccaaccccctctcagcctgccccgtcagatcccgacaaggtgattctccagtttggcaaagtggcaagggatatgttcacgatggactatcgctaccctctctcggctttccaggcctttgccatttgtctgagtagctttgatacaaagttagcctgtgaataaatggagaagaacaaaggtaaaggagaacatcaggttgcttgcattaggccatcagtgtacctctttccatctggctctcgtgttgccttggttgtattttgtgcttaatgtagccatgaagttggtggcccatatatggacgcatgtgttgttgttggccctctcccttagaagtgattaaaagttgcatttggaccacatgttacccgatctgtaatatacttgcagtggcatcgcatgccgcgtgataacaaagttcccgttcgtgattggacttgtatggtttcagaaaagcagcaaacaaagtttggtacggtgtgcatacctctttccatctggctctcgtgttgccttggttgtatttgtgcttaatgtacccatcaagttggtggccatatatggacgcatgtgttgttgttggccctctcccttagaagtgattaaaagttgcatttggtccccatgtagcccgatttgtgatacacttgcagtggcattgcatgccgcgtcataacaaagttcccgttcgtgattggact

SEQ ID NO: 925 - DNA, 2339 bp, Zea mays
  Clone ID: PAT_MRT4577_128869C.1
ccggccgggatggcgtgagcgccggggcaaggcaagtagccgctgcgcggtgctgccacctgacctgacctgactgccgtcccggtccccgctccccggtccatccgaacgccgttacgggggccgcccaccgcgacggaacggaaaggtgcggtcaacccaccccgtcccagtcccatcaccgccgggggccgggtggataaacaaacccagcggccccggccgcctgggcgcctcattcccttccttcctttgctcctcccctgcctcgcctctctctctctctcccctctcctcgcctccagctcctgctcggcccgctcgcgtccagctgcgcgcgcgtctgcggtggccgtgaaggacagcccgagggacgcgccgggtgcactgatctgggggccgcgtgtccccggtggtggggcgaggcggcgccggcttccaggaatgggcagcttgtagtggctgtttcttttgcatatgcactttctattgttgttgtcatttcaaaggaggccatagtctcctggattttgtatgccttgttatctggaattggtgaccatagatgtcatttcgtagcatagtccgtgatgttagggatggcttcggcagcttgtcgaggagaagctttgaggtgaccctcgcaagcatttatggccttactgggcatcacaaagggaagacccagagctcatcgcatgtgctcgacgactcaccttccataattcgtgaaagtcgatgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccggagttttgtggcaagctcaccttccctgtgtctctaaaacagcctggtcctcgagatggaaatacaatggtccagtgttttataaagaggaataagtcaaaatccacttaccatctctacttgtgccctttagcatgttgtacttcagaaagtggggaattcctcttatcagctaaacgacaccgcaaaaccacatgcaccgagtacactatatcaatggattctggcaacatctcaagatcgaaaagaacctacattggaaaaataaggtctaacttccttggcacaagatttttaatttatgatacacaagccccctataatggggctgtagttcctcctgccggaaggaccagcaggaggttcaactccacaaaagtctctccaaagctgccttcagtcagttacaacatcgcacaggtatcgtatgagctaaatgtccttggcacgagaggtcctaggaggatgcgttgcatcatgcactccatacctgcatcatcagtggagccaggtggcacagtgcccccacgcgtccggcagattgtacctcgagctctggaggattcattccgcagcacggcttccttctcgcagtcgttccgtagcactgcctcattctccaagtccatcatggactcatccatggatttcaatagcgctcgcttctctgacatcgctggcagcagcgctcgcttcacgggcgttcctggtagcagctctcgcttcgcgggcgttcctggcagcagcgctcgcttctcgggcattgctggcgccagattggacaacgacgaggagagtgaaaccaaggagaggccactggtgcttcgtaataagccgcctaggtggcacgaacagctgcagtgttggtgcctcaacttccgtggccgtgtgacaattgcctcggtgaagaacttccagctgatcgccgcggctaccccgccaccggcaggtgcgccaaccccctctcagcctgccccgtcagatcccgacaaggtgattctccagtttggcaaagtggcaagggatatgttcacgatggactatcgctaccctctctcggctttccaggcctttgccatttgtctgagtagctttgatacaaaattagcctgtgaataaatggagaagaacaaaggtaaaggagaacagcaggttgcttgcattaggccatcagtgtacctctttccatctggctctcgtgttgccttggttgtatttgtgcttaatgtagccatgaagttggtggccatatatggacgcatgtgttgttgttggccctctcccttagaagtgattaaaagttgcatttggaccacatgttacccgatctgtaatatacttgcagtggcattgcatgccgcgtgataacaaagttcccgttcgtgattgcacttgtatggtttcagaaaagcagcaaacagagcttggtacggtgtgccttttttagacc

SEQ ID NO: 926 - DNA, 2233 bp, Zea mays
  Clone ID: PAT_MRT4577_128873C.1
ttttagcgcttgcttctcgggcgttgctggcgccagactggacaacgacgaggagagtgaaaccaaggagaggccactggtgcttcgtaataagccacctaggtggcacgaacagctgcagtgttggtgcctcaacttccggggccgtgtgacaattgcctcggtgaagaacttccagctgatcgccgcggctaccccgccacccgcaggcgcgccaaccccctctcagcctgccccgtcagatcccgacaaggtgattctccagtttggcaaagtggcaagggatatgttcacgatggactatcgctaccctctctcggctttccaggcctttgccatttgtctgagtagctttgatacaaagttagcctgtgaataaatggagaacaaaggtaaaggagaaacagcaggttgcaagtagccgctgcgcggtgctgccacctgacctgactgccgtcccggtccccggtccatccgaacgccgttacggggccgcccaccgcgacggaacggaaaggggcagcttgtagtggctgtttcttttgcatatgcgctttctattgttgttgtcatttcaaaggaggccatagtctcctggattttgtatgccttgttatctggaattggtgaccatagatgtcatttcgtagcatagtccgtgatgttagggatggcttcggcagcttgtcaaggagaagctttgaggtgaccctcgcaagcatttatggccttactgggcatcacaaagggaagacccagagctcatcacatgtgctcgacgactcaccttccataattcgtgaaagtcgatgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccggagttttgtggcaagctcaccttccctgtgtctctaaaacagcctggtcctcgagatggaaatacaatggtccagtgttttataaagaggaataagtcaaaatccacttaccatctctacctgtgccttagcaatgttgttacttcagaaagtgggaaattcctcttatcagctaaacgacaccgcaaaaccacatgcaccgagtacactatatcaatggattctggcaacatctcaagatcaaaaagaacctacattggaaaaataaggtctaacttccttggcacaagatttttaatttatgatacacaaccgccctataatggggctgtagttcctcctgccggaaggacaagcaggaggttcaactccacaaaagtctctccaaagctgccttcagtcagttacaacatcgcacaggtatcgtatgagttaaatgtccttggcacgagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcatccatggatttcaatagcgctcgcttctctgacatcgctggcagcagcgctcgcttcacgggcgttcctggtagcagcgctcgcttcgcgggcgttcctggcagcagcgctcgcttctcgggcattgctggcgccagactggacaacgacgaggagagtgaaaccaaggagaggccactggtgcttcgtaataagccgcctaggtggcacgaacagctgcagtgttggtgcctcaacttccgtggccgtgtgacaattgcctcggtgaagaacttccagctgatcgccgcggctaccccgccaccggcaggtgcgccaaccccctctcagcctgccccgtcagatcccgacaaggtgattctccagtttggcaaagtggcaagggatatgttcacgatggactatcgctaccctctctcggctttccaggcctttgccatttgtctgagtagctttgatacaaagttagcctgtgaataaatggagaagaacaaaggtaaaggagaacatcaggttgcttgcattaggccatcagtgtacctctttccatctggctctcgtgttgccttggttgtatttgtgcttaatgtagccatgaatttggtggcccatatatggacgcatgtgttgttgt

SEQ ID NO: 927 - DNA, 3129 bp, Zea mays
  UNSURE (1)..(3129): unsure at all n locations
  Clone ID: PAT_MRT4577_128883C.1
  unsure (1)..(3129): unsure at all n locations
gcagttcccccgtgcccgagacgcaaccccccgccaggagtaagtttgttcttttatcgatattatcgatatggcgagggaggagaatgcctacatgttcaagctgactgaccaggccgaaagggatgaagagcatgcatagccatatgcagcagatggctgacaacagcgttgagcaagcatcgatagagaagcctcctaatgcgcttgaatggcagccacaagaacgagctatgcggctactgcgatgcagacctgctgccgcggatcccaccgctcagaatcctgcaaaaaacgtttctttgcttaaagcgcaagagttattcaaggagaaaaggccgagcttnatgcttgcaggcctcctccttttcgcctacctactagtgccgggaaaaaaaaaaaaaaaaacaaaagggcgaacacaggagaggggagagcccgagagcttcccttgccggcgagatccagtccggctcacgcgatctgactttcccggaggtaaagaagctcgggatttgccgtagtctcttgatgccaaatcaaatctcgtttgcaagtagtacaagtgctgcttcggtctatgcatgtccatatctatgattatagcgagaactagttttctccttttctggattggacagggaattagctggtctggagtgaatactgaaccgaaatgcctctgctcccgtttgttctttaatcttacgttcttcaacagttgaaatccatcccaccccaatgtttccatgttcattccagaagcaattcttgcttgattcgtggacttctttcctaagctacagcttctttccaagtagagtaccagaaccagatacccgatctcaagggatgaagatagtgaccgggccatgggaattagaccgagaaagaaagggccaggttgagatatcgggggcaggttgcccttccggtgcctgaagggcaaacaaaatgtcataccaagtcaggctgctgcgcttttcctatgaattggccttctcgcaatcccttctgttttgcctcgcctcaatctgttgatggtaggtggacaacgctataatagttcatcatgcttcattgctgctgttcaatttgggttcatggtatctcaatttcaattaggcttggtcatctgtacaacctggttatatgtatcaggggaaaacctgtttatatgtagaatatgtcttgctgatgatctggatatcctcatatatatattctacctgtcattttatatgccagtacacattcagttctctgaaattccattggggagctcgagttcggccgattctcggccacctccggttgaggcgcggacaaaaggcgacgcgaacacaggagaggggagagcccgagagcttcccttgccggcgagatccagtccggctcacgcgatctgactttcccagaggtccttgaatgtgatcgcatcattgcagcagatccaggttaagcagatggctgacaacagcattgagcaagcattgatagagaatcctcctaatgcgctgaaatggaagccatcagaaagagctaaacggtttcgacgatgcaggtcaactccctcagatcccaccgatcaaaaacctgcagaaaacggatctgtgcttaaagccaaagagttattcaaggagaaaaggccgagcttcatgcttgtaggcctcctccttttcgcctacctactagtgggtgtcatcatcttttacctattcatggatcagttatctgggaagacaactgatagagtgcttgacgccttgtacttcgttattgtcacaatgacctcggttggctatggggatcttttcccaaacagtgacacaacaaagctgcttgcttgcgcttttgtattcacaggaatggcgatcattgctctcttcatcagtaaagcggcagattaccttgttgagaaacaggaggtgttgttcttcaaagcactgcacatgaatatgaagggcagcgaggccaaaatgctaggagcaatggaaacaaataggataaagtacaaattctacactgtcgctctgcttcttgcaatggttattgttgctgggactgtatttctgtggaaggttgagaagctcagccttgttgattccttctactgtgtctgtgccacgatcactaccctgggttatggggataaaagcttctcgtccaaactggggcgtgtttttgcagtgttttggataaccacaagtactctcatcatggctcagttcttcatgtaccttgctgagctctacactgagcgccggcagaaaatcctgaccaaatgggtgatcaacaggaggataaccaccatggatcttgaggcagctgatatagatgacgaccgacaagttggtgctgctgaatttgtactttacaagctaaaagagctgggcaagatcagccaagaggagatatcttgttttctcgaggagtttgacaagcttgatgttgaccagtctggcacactctcaacttacgaccttactctaggacaaaccagtcaatgactgatgatgcatatgtgattttgctgactgaatgattttgtttgatgtcgttagcatttctgttgtccatatgtaacacgctacaatgttgtaaagatgtaaattaagatgattgagaaattgtgccccgccttttctccaaactggggcgtgtttttgcagtgttttggataaccacaagtactctcatcatggctcagttcttcatgtaccttgctgagctctacactgagcgccggcagaaaatcctgaccaaatgggtgatcaacaggaggataaccaccatggatcttgaggcagctgatatagatgacgaccgacaagttggtgctgctgaatttgtactttacaagctaaaagagctcggcaagatcagccaagaggagatatcttgttttctcgaggagtttgacaagcttgatgttgaccagtctggcacactctcaacttacgaccttactctaggacaaacaattcaatgactgatgatgcatatgtgattttgctgactgaatgattttgtttgatgtcgttagcatttctgttgtccatatgtaacgctgtaatgttgtaaagatgtaaattgagatgattgagaaattgtgccccgcttttctcc

SEQ ID NO: 928 - DNA, 1338 bp, Zea mays
  Clone ID: PAT_MRT4577_128885C.1
cattgggtacctcgaggccggccggggggagcccgagagcttcccttgccggcgagatccagtccggctcacgcgatctgactttcccggagcagatccaggttaagcagatggctgacaacagcattgagcaagcattgatagagaatcctcctaatgtgctgaaatggaagccatcagaaagagctaaacggtttcgacgatgcaggtcaactccctcagatcccaccgatcaaaaacctgcagaaaacggatctgtgcttaaagccaaagagttattcaaggagaaaaggccgagcttcatgcttgtaggcctcctccttttcgcctacctactagtgggtgtcatcatcttttacctattcatggatcaattatctgggaagacaactaatagagtgcttgacgccttgtacttcgttattgtcacaatgacctcggttggctatggggatcttttcccaaacagtgacacaacaaagctgcttgcttgcgcttttgtattcacaggaatggcgatcattgctctcttcatcagtaaagcggcagattaccttgttgagaaacaggaggtgttgttcttcaaagcactgcacatgaatatgaagggcagcgaggccaaaatgctaggagcaatggaaacaaataggataaagtacaaattctacactgtcgctctgcttcttgcgacggtcattgttgctgggactgtttttctctggaaggttgagaagctgagccttgttgattccttttattgtgtctgtgccacaatcactaccctgggttatggggataaaagcttctcgtcccaattggggcgcactttcgcggtgttttggataattacaagcaccataattctggcgctgttcttcatgtacctcgctgagatctacaccgagcgacggcagaagatgctggccaaatgggttctcacacggagagtaacaaccatggatcttgaagcagctgatctggatagtgatcggaaagtgggtgcagtgctgctgaatttgtcgtgtacaagctcaaagaactggggaagatcagccaagaggacatatcttcttttctagaggagtttgacaaactcgacattgaccagtccggcacgctctccacatatgaccttactcaggcacaatccggtcagtgacgaacatatgggcttgtacttaatgttacagcttaaatggttgaatggttagttaatgctgttaattaattctgtaatctagtaaaagtgtcaaaagatacgaccttgttgagttaacacaatggatctgctcatatgcacctggacacgtgtaagaaagaagtatttggtgatgcttc

SEQ ID NO: 929 - DNA, 734 bp, Zea mays
  Clone ID: PAT_MRT4577_128901C.1
accagccgtataccacaccacaccgcctccgcacttcctcccggcgcctcgctttccattttacaaccgcggatcccctcggagtactgtagacatggccggaaggggcaaggcgatcggctcgggcgccgccaagaaggccatctccaggagctccaaggccgggctccagttccccgtcggcaggatcgcgcggttcctcaaggccggcaagtacgccgagagggtcggcgccggcgcccccgtctacctcgccgccgtgctcgagtatctcgccgctgaggttctggagttggccgggaacgcggcgagggacaacaagaagacccgcatcgtgccgcgccacatccagctcgccgtccgcaacgacgaggagctctcccgcctgctcggcatggtcacaatcgccagcggcggtgtcatgcccaacatccacaaccttctgctccccaagaaggccggaggcagcaaggccgtggctgccgacgacgatagctagatgacgactcctcggtggtcgtgggtgctcggctgtatccagttctgtgtagtagcgtgttcagttaaatgttgcctaggtgttgcgttttacttctaggatgttagtactactattagtttctgaatctgtgtgcttgtaccggtgctaaactaggtgtggacaatggttacatcctgtgtaagtcgttgctagttcgttctataaaagtgcacctatggattgcttacttgcg

SEQ ID NO: 930 - DNA, 1413 bp, Zea mays
  Clone ID: PAT_MRT4577_129094C.1
ccggccgggaaagtcccgcactcccgcctggcgcctaccgcggtgtttctttcctctcctccaagccagcgctcggcgcccgcctccggcgaccgccacccgcctttcttttataccttcgccgcggcgacccacgccaaccttcgacccccctaaccctaccaaagcccgaactctcgagatcacaggacgcggatccaaaccagaggcccctgcctgccctctactcccccaccacaccacagcctaccgccatgtcggcgaccgctacggacgaggccgcggtggaggcgcgcctccaggagctgcgggggaggctcgggaagaagcagcacttcgaggaggccgtaaacgagctcgccgccgccgtccgggaccgctacgccggcgcctcccccgccctccgcaaagcgatgtattcaacggtttgccgcgttgcaacagtgcttcaaaccagatatacagctccaggattctggcatgttggtctgaacctcttcgttggaatagagaagctggtaagtaatcctgctgaaaaggagcacctgaagacctgcatttcgagggcccgtgagcatcttgatgaaaaggaaaatgaggattctgtgccaagcaacagagaagcagacaccagatttctttttgaagggcaccttactgtgggacaggaacctccacctccagcatggctttgttgcccagaatttaacgagggaattgagcatactaactgaatcctctggtgatcaagatgcgagccaacaaccagaacagtgcctagagccgaggagattacacctgctataatgaacctcctagaaaccatatcaggcgacagggatctagaaactgctttggaagaatcactgcagggaatcattgagtatccacagagggcacccccggcttcaaaggaagttgtcgccaatcttcctgtcattgctgttaccgaggaagtcatgtctagattgggtagtgagacggagtgtgctgtctgccgcgaaaacttggttgtggatgacaagatgcaggagcttccctgcaagcatctcttccatcctctttgtctgaagccatggctggacgagaacaactcctgccctatctgccggcatgagctgaggacggacgaccatgtgtatgagagcaggaaggagcgtgaaagggaagaggaagaagatagaaggggtgcggcaaatgctgttaggggtggagaattcatttatatctgaactcaacagttccagaatgtaatccctttgatgaacttcgttattaccatgttgacatctatatatacctagttacttgttctagaatttaatccctttgatgaacttcgtgattaccatgttgacatatatatatacctagttacttatgcttgagttaaataaaaaaaaaaaaaaaaaa

SEQ ID NO: 931 - DNA, 403 bp, Zea mays
  Clone ID: PAT_MRT4577_12910C.1
gttacacattcggatcgccatgtcagactcggatgagcaccacttcgaattggatgggcgcgccggatcgtccaagacctacccagcacatgctggcaccgtccgtatgaactgcttcatcgtcatcaagaaccgaccctgcacggctgtggaggtttctaccttaaagactgataagcatggtcatgccaaatgctactttgtagccatagatatatccaacggtaaaaagttcgaatatattggtccttcatgacacatactgcatattacagctgtgaaccgtactgagtatcacatgattgatatatcagactatggattagcgagctttcttacttcagatggtaacactaatgatgatcttaaactcccaactgattatactcttgtagcccagatc

SEQ ID NO: 932 - DNA, 1691 bp, Zea mays
  Clone ID: PAT_MRT4577_129308C.1
aattcggcacgagggccggtcgcagtccgccggggtattcacacgcagccacgctaaacaaagcccgacgagagattcgtctccatctcccctcgtcttcctccctccttcagcccgaggaaaccctagcacgtcccgtctcgcctcgccgccggcgatggccgctgcatgatcggtttccccccttggaactgcctgcctaccggcatcgccaagatcgccgccgcggctgccgtcgtcgtagcggcgctcgcgtcctccgggatcgccctcccgcgtccacgcgccgcgccgcccccatcgggattcggcctcctcatgtcgaaggcgaaggtctacaccgacgtcaacgtcctgcgtcccaaggagtactgggactacgaggcgctcaccgtccaatggggtgagcaggatgactatgaagttgtcaggaaagttggaagaggtaaatatagtgaggtctttgaaggcatcaatgttaacaacaatgagaaatgcatcattaagatccttaagcctgtcaagaaaaagaagatcaaaagggagatcaaaatacttcagaatctctgtggaggtccaaacattgtgaaattgcttgatattgtcagggatcagcattcaaagactcccagtttgatatttgaattcgtcaacaacacagacttcaaagttttgtaccccacattgacggattatgacatccgctactacatatatgagctactcaaggcccttgattactgtcattctcaaggcatcatgcatcgagatgtcaagccccataatgtaatgatagatcatgagcttcgaaaacttcggttgatagactggggcttagctgagttctaccatccaggcaaggaatacaatgtccgtgttgcatcgaggtatttcaagggacctgaactccttgttgatttacaagactatgattattctttagacatgtggagtcttggttgcatgtttgctggaatgatatttcgcaaggaaccattcttttatggccatgacaaccatgaccaacttgtgaagattgcaaaggtccttggaacagatgggctgaattcttatttgaacaagtaccacattgagctggaccctcaacttgaagctcttgttggaaggcatagtagaaaaccctggttgaagttcatgaatggtgataaccaacatctagtatcacctgaggccatagattttctcgataagctcctgcgctatgatcaccaagacaggcttactgcacgggaagctatggcacatccctacttccttcaagtcagagctgtggagaacagtaggacgagagcacaataatcatggtctgcactcttgaaatggagttgttgctagttcgtgaaaatcataggcttaaatccatgttcagtattcacatcgctccaggaatctgggccatgactccatggcaatgaatcaaaatagtacgagccgcatcatgtggacaaccttggcagatctttttattcttgtctttattgctgggagcactgtagctttaaacctacaagtagtgcttgaatgagatgagattcatatcatctcctgtggtggaatgtgaaattgtatgtgacctttagactaattaaaaagtacaatacagcgctaagcatactgcttgtattaaaaaaaaaaaaaaaaaaaaaaaaaaaaaaaaagggcgcggccgc

SEQ ID NO: 933 - DNA, 1869 bp, Zea mays
  Clone ID: PAT_MRT4577_129310C.1
tctctggctgttcccaacagattattaaagaactcccacactacctcctttttcctttcttggtccatcacgagtctgtcgtccactttcacttgggaccggtcatcccaggtcccagtccaccggtatcctcacgcagccacgctaaattcgtctccacctcctccctcgtgacatcgtctcgcacggtcgctcccacctttccgcccgccgaaaccctagcccgccccgcctcgccgacggcgatgggcgctgcatgatcggtgcgtccccttggaaccgcctgccttctggcatcgccaagcccgctgccgcggctgccgtcgtcgtagcggcgctcgcgtcctccttcctcgccctcccgcgtcctcgcgccgccccgcccccagcgggatccgggcccctcatgtcgaaggcgaaggtctacaccgacgtcaacgttctgcgtcccaaggagtactgggactacgaggcgctcaccgtccaatggggtgagcaggatgactatgaagttgtcagaaaagttggaagaggtaaatatagtgaggtctttgaaggcatcaatgttaacaataatgagaaatgcatcattaagatccttaagcctgtcaagaaaaagaagatcaaaagggagatcaaaatacttcagaatctctgtggaggtccaaacattgtgaagttgcttgatattgtcagagatcagcattcaaagactcccagtttgatatttgaattcgtcaacaacacagacttcaaagtcttgtaccccacattgacggattatgacatccgctactacatatatgagctactcaaggctctagattactgccattctcaaggcatcatgcatcgagatgtcaagccccataatgtaatgatagatcacgagcttcgcaaacttcggttgatagactggggcttagctgagttttaccatccaggcaaggaatataatgtccgcgttgcatcgaggtatttcaagggacctgaactccttgttgatttacaagactatgattattctttggacatgtggagtcttggttgcatgtttgctggaatgatatttcgcaaggaaccattcttttatggccatgacaaccatgaccaacttgtgaagattgcaaaggtccttggaacagatgggttgaatgcttatttgaacaagtatcacattgagctggaccctcaacttgaagctcttgttggaaggcatagtagaaaaccctggtcaaagttcatgaatgctgataaccaacatctagtatcacctgaggccatagattttctcgataagctcctgcgctatgatcaccaagataggctcactgcacgtgaagctatggcacatccctacttcctccaagtcagagctgtggagaacagtagaacgagaccacaataatcgttgtctacaccctcgaaatgaagttgttgctaatttctggaacatcataggctaaaaccgttcaataagcatctcgctccaggaatctgggccatgactccgtggcagtgaatcagatagtatgggtcgcatcatgtgggcaaccttggcagatgtttttattgttgtctttaatcttgggactactgtagctttaaacctacaggctgtgcttgaatgacatgatattcatatcatatcgtctcctgtggtgggatatgaaattgtatgttatctttaaacataaacatactggttgtattatggtgtgctattatgtatgtatgattcttatttattttgtgtgatattgtgatgaaatactcatggatctcatagatgacatgagtttccgaaaaaaaaaaaaaaaaaccgattgttatttattttgggcgatagtcaccgtgatcaattgcttt

SEQ ID NO: 934 - DNA, 1535 bp, Zea mays
  Clone ID: PAT_MRT4577_12935C.1
gcttacctaggtccgcctccctatccccacctcctccaaacccccaccccaccccacccctcctccgctgcccatcccagcacagcggaagcgatcggcaatggcgtcctccacccagggccaggtcatcacctgcaaagcggcggtggcgtacgaggcgaacaagccgctggtggtcgaggacgtgcaggtggcgccgccgcaggccggcgaggtccgcatcaagatcctctccaccgcgctctgccacaccgactactacacctggagcggcaaggatcctgagggtctctttccttgcattctcggtcacgaggctgctggaattgttgagagtgtcggcgaaggggtgaccgacgtgcagcctggggaccatgtcatcccttgctaccaagcggaatgcagggactgcaagatgtgcaacagcgggaagaccaacctctgcggcaaagttcgcggcgccactggggttggggtcatgatgagcgaccgcaagagccgcttctcggtgaatgggaagcccatttaccatttcatggggacgtcgacgttcagtcagtacactgttgtgcatgacgtcagtgttgccaagatcaacccgcaggcaccccttgataaagtctgcctgctcggctgtggtgtttctactggccttggagcagtatggaatactgcaaaggttgaagcaggttccattgttgctgtttttgggcttggcacagtcggacttgcagttgctgagggggcaaaatcagctggtgcttctcggattattggcattgacattgataccaagaagtttgatgttgctaagaactttggcgtcacagagtttgtggacccaaaagagcatgacaacccaatccaacaggtcctggtcgatctaacagatggcggcgtggattacagctttgagtgcattggaaatgtttcggttatgagggctgcactggaatgctgccacaagggctggggaacttccgtcatcgttggtgtcgccgcctctggccaggagatcgccacacgaccattccagctcgtgactggtcgtgtctggaagggaaccgctttcggtggcttcaagagccggacccaggtcccatggcttgttgacaagtacatgaagaaggaaattaaggtggacgagtacattacgcacaacatgaacctggctgacatcaatgacgccttccacctgctccacgaaggtggctgtctgcgttgtgtgctggcgatgcagatctgaaattcctaagctaagcagtttttggatatgtgtcggcatagactgtcttttgttttggaactagaactcctttttgcctcgttaggcctggacccactgtataatgctatgttgcgttggatggctgacgatggttaccgctgtgttgctagcaatgtggtacttgatctgtatcacggttgcaaataagtgctgtttctaaaaaaaaaaaaaaaaaaaaaaaaaaaaaaaaaaaaaaaaaaaaaaaaaaaaaaaaaaaaaaaaggacttctgcgttgttaccactgct

SEQ ID NO: 935 - DNA, 667 bp, Zea mays
  Clone ID: PAT_MRT4577_129407C.1
cggtgcggacggcgtcatgatagacgtctggtgggggctggtggagggcaagggccccaaggcgtacgactggagcgcctacaagcaggtcttcggcctggtgcacgaggccgggctcaagctgcaggccatcatgtcattccaccagtgcggtggcaacgtcggcgacgtcgtcaacatccccatcccacagtgggttcgcgacgtcggcgccaccgaccccgacattttctacaccaaccgcggcgggacgaggaacatcgagtacctcacccttggagtggacgaccagcctctcttccatggaagaactgccgtccagatgtatgctgattacatggcgagcttcagggaaaacatgaagaagttcttggatgccggtaccatcgtggacattgaagtgggacttggcccagctggagagatgaggtacccatcgtatcctcagagccaaggatgggtcttcccaggcatcggagaattcatctgttatgataagtacctggaagcagacttcaaagcagcagcggcgaaggctggccaccctgagtgggaattgcctgacgatgctggagagtacaacgacactcccgagaaaacccaattcttcaaggacaacggaacatacctcacagagaaggggaagtttttcctgtcatgctactcc

SEQ ID NO: 936 - DNA, 428 bp, Zea mays
  Clone ID: PAT_MRT4577_129427C.1
tgggaccctcgaggccggccgggagatgtctggccggagaacgcggccccgctttggcccgccgtgacactatcaccgctaccatggaaggcgtcacctctctgctgactaccggatggaagactagtcaaggggcgatggagatgccgctaatgatccagggctacgagaagggactcatcgaatatccccatcatcacctgtcgcaagtcctggagacgcgtaggaggaggccaatgtatgcaccagctactagcacaagcacaggagtgccaagtgcgataacgtaaatccgggggaccatagccgtctactcgtctatactgcaccaaaatctccattctcctaggacatgtgaggtaatgtttctgacactcggctagatatttcaaattcactgctcctcacaggagacaaaaagagcggcc

SEQ ID NO: 937 - DNA, 220 bp, Zea mays
  UNSURE (1)..(220): unsure at all n locations
  Clone ID: PAT_MRT4577_129440C.1
  unsure (1)..(220): unsure at all n locations
ctcgtagcttgcgctccacaggagcctatgtgccacccacaaccgtgcgaccgtccgtgctgccggcgaccccgaaccgccgacccggcccgtgccaccacaccttactcgncgttggcaggtatggccccgacggagccgacccgggaggagagcgtgaacatggccaagctggcagagcatgcggagcgatactaggagatggtcgagttcattgagc

SEQ ID NO: 938 - DNA, 614 bp, Zea mays
  Clone ID: PAT_MRT4577_129576C.1
gtaaggactccataggaccacctgttgcgaatgcacggtctcgaccgccggtagcgtgtcaagcatactacccgcttcaggctgtaaccgctcgtagagaacggattcataggcatcaaaaaccgtccctgtaaggttgtggagggtgctacctgaaagaactggacatcatggccatgccagaatgccactttgctgccatagacagtgattcaacggctagaaaagctccacagatattggtccttggtgacacaattgtaatattttacatggaaaccgtactgagtacacagcttgaatgatatatcagaggatggattagcgagccttcttacttcagatggcaatactaatgatgatcttacactaccaactgatgaaactgtagcggcccaaatcaaggaaggggtagaaagcggaaaggatcttgttgtgactgtccagactgctatggcggaggagcaaatatgagcgctgaaggatgttggccccaagcaacttgcctgtcttgaaatactgtatctcagaaactaaatcgaaaaaagaagtgtatcaagcattgctacagagacatccatatgtcttgagctggcttttgctatggcaaacac

SEQ ID NO: 939 - DNA, 313 bp, Zea mays
  Clone ID: PAT_MRT4577_129683C.1
atcgagaccaactagcaacatagttagcacaatacagtaccaccaatggcgggggaaatattttgcctccttatgctcctagctctttctgcaagtgctgctacagcgaccattttcccacaatgctcacaagctcctatatctttcctccttcccccgtacctctcaccagcggtgtacttccgtttgtgaaaacccaaatctttaaccctatatgatccatcaagcaatctcatcttgcatctaacctttatcacccatttttctccaacaaacatcagtcctataacagtatttccctttggagcattta

SEQ ID NO: 940 - DNA, 281 bp, Zea mays
  Clone ID: PAT_MRT4577_129823C.1
tccacgcgtacgcaactagttttttttaaagcacaatagtgtaccaacaatggcggccaatatatttggcttccttatgctcctaggtctttttgtaagtgctgcttcctcaaccattttcccacattgctcacaagcttctattgctttctttctttccccatacctcttaccagcggtgttttcagtctgttaaaacccaattctacaaccttacaggatccaacaggtaatcgcagtatgcattctacctctatcacccttgtttcctccaacattcc

SEQ ID NO: 941 - DNA, 1920 bp, Zea mays
  Clone ID: PAT_MRT4577_129850C.1
gcatctcgcgtccggacgggggcttcctctctctctctctctctctgtcgccaggagggcgccgccgccaccaacgcaacgcgcgccgccgcagatctccgccaccgacgcgccggccatggagtacgagcgcattgagaagccgttccccgtccagggcggcgggttctcgcccaagcggctgcgcgcgatgctgctgggggtggacaagcgccgcaaggggcaggacggcgccgccgaggaggacgaggacggcggcggcggcggcgactacggcgccctgcccaaggcccacgccagatccggcgccggcgacggtggtggcgccacgtgcgaagaatacaaggacgtggacgtggtgagcaccacctcagagttctcgtcctcgctggagacagcgggtgggcaccggccccgggacgcccaccccgtcgccacgggttctaggaccagggtgccgcccgaggaggactcgtgcgactcggagagcgtggcatccaacttcgagttccacaaggagcggcgggcagcggcggcggcgtcggtcgtccctccattctcaaagcccgccccgtcaaagtgggacgacgcacagaagtggatcgccagcccgacggcgaactgccctggcaggggtggcgcggctcctgcgccgaagaagacagagaaacctggctccggcatcgggaggctgccgctgccggcgaccaaggtcgtggtagaggccactgaggagatagataccaagaggatggatccgagccaggagaagcgagagattgggtggcagaaagcggcgaggtgggcgccgcccgacccctgtccggaggcggagccctgcccaacaaagaccacactactcgctgtagaaactacagtggctgctgcttcagcagcagctgttaatttcaaccgccatgatgcatccaccacgcttcagagcgcagcaacatgcatacctcctccaacaacggtccggtcagtgtcgatgagggacatgggcacagagatgacgcccatcgcaagccaagagccgtcccggaccgggacgccggtgagggcgacgagcccaaactgctcccagccaacgactccacggaggacgctcggtggccccagcgcagtcggctccttcatcagccacggaggagaatgcagcagctcggagctgagcgagcaggagctgcagaccaaaaccaggagggagatcatgctccttggcacgcagctaggcaagaccagcatcgcggcatgggcgagcaagaaggaggaggagaaggacgcctcgctctcgctgaaaccggtgcccatggaccagtcgacgcagaacataaccgcgatccgtgcggctgcgtgggaggaggcggagaaggccaagtatttagcgagattcaagcgagaagagatcaagatccaggcttgggaggaccatcagaaagcccagatagaagctgagatgaggaaaatcgaggtcgaggtggagcggatgcgtgcccgcgcgcaagacaagctgatgaccaagctcgcgtcggcgaggcacagcgcagacgagaagcgtgccgcggcggagctgaaacggaaccgcgcagccgcgaggaccgctgagcaggcagagcacatcaggaggaccggccgggtgccgccgtcgtttggctgctggaactggtgctcatgaagtgcccatggaagatgagtcgcccgttgagaatgagtcgcttgtaagctgttgtaactatatatatatatatacacacacgtatgtaagatgtgagatccatgcgtcctgtgctgtggtggttactgtgtaagtgtcacagatgtaccgaattcaaggccgagcttggattcctagtccacatatgtgataaacttcacaccatgctagttgtgactggatttgatttgtgctctaaagcggcc

SEQ ID NO: 942 - DNA, 3874 bp, Zea mays
  UNSURE (1)..(3874): unsure at all n locations
  Clone ID: PAT_MRT4577_129994C.1
  unsure (1)..(3874): unsure at all n locations
ccgggaccgtggtcttcgccaaaccgctttccttcccatctaaaaccgccccctcccttcctcttctcctagctctcttgcctgcgcaccactcgagtcgagactcgagaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgtaaaaaaaaaaaaaaaaaaaaaattccagaagatcaagtctgctcttttgtcgaaatgttggtgtctcaggttcatgcatgtgtcatatattaagagattgtccctgttccacattttagtattatataaacggtatacaaggtgatcataatatttaaacattagtttgattttttggcacatatttcattacagtttcaaatatggttccttaaacaacacggctatcttagaaaatagatgcttgattatagcaaaaattgaccttatgctgctataagttagattctaggaggttaaattggcatgagtacatattctgaccatgcaacatattcatatataaccgatcgattcagggaaaatgtcactgagttaacttaccctccccacactggattatctgtaactctctagtgctggagacaaaatatgtatgttaaaaaataataagcacgttttagcttttgcacacgagtgatatgtgttggtgatatgatccgaagttgatagagattgtggcttgagtcaccgcaaaatttgatgacattttctttagctgaacccatgccggtaatgaattttattttaaaaaataatatgatatggcttaatgtagatccatttttatatgttgtggattatagaaaaccatgctaattacaactacgagtttgaatttgaaatatcaatagattcctacaaaaatgtatatcactatacttttgctaatttactaaagatgttacaaactttactgttcaaacccgacaaaaaaggtagatgccaaatctgtctaaaagattatattagatcgatccacagattatagtatcaaagtgatggaaaacattgtttgcacaaacaactgagtagctcgctactttttagagctttttttacatcattatttactcttgacttgttttattgttctaaaataccctttctgagttcatgtatgaactatatatgaagcaccatctgttcattaagtaatgacccacttatgtgtgcatgtgatgacagacgttgttccataaccatgcttgcatctagctatgcatgtgattcaaggttagctgtccaatgtcttttgcaattctggaatcgggagaatatacttgtatatatatatcttacatttatcaaatagggagaaattaaatcttgatatcttgaacgttgttcatcgtgaattttgtcgttttgtatgcaatactaatatacttcatctagtaatacaaaaggtacaagaaaaagaaaattgcacctggctatttgtcttaatatattatgctggaacatgacattgccgtgtgctcctgcctttccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacctagagggggcgcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactactaataaagtcaggccccgtcaaatgctttacatggtgattgaagtctggagcttctcagcaccaccatatattgtgttcagttcttgtgtttattgccatagctaccttttttttctctgatctacgagctagacgtagctttgtgcttggagattccactactatgtttcctctgtcctgtgtatgctttaacggagatgcacgttgtacccgtggtaatatatataaatttgcgttgtaaaaaaaaaaaattacctcgtccgccccagtctagtccgattcaaacccgcccgttccccgtgtccgagccacgcaagccgagctcaatccccagaggccagagccagctgctcggcgctccacgcgatggcgcagaaggagaccaatggcagcaacggcgaagaacatctccacccgcccgccgncgaccccgtcgcccctccgcttctccaagttcttcccagctaacctgcggatcctg

SEQ ID NO: 943 - DNA, 486 bp, Zea mays
  Clone ID: PAT_MRT4577_130243C.1
aaaaaaacaaatcatggggggccaattaatatatgggtacaggagaggcaatcgggatcaaccaacaggcggggggacacacgtccgtacatgagcacaaagactggcgccaaacatgcggagggagatagcaaactgaaaaactttggttttttttttttcacacacaccaaaaaatacctatgtttgggagccagctcggcctcgtttattattggtcaacccccaccccaagctagatagaaaaaaatcatatccatgggcggcgatcgatgggaacaacagttgcagggggcgcacttgcagttgccacccaaactgcaaccggggggggcctccccggactcccccgggggcttaaaaaactcgggcgcggcctttttttccggggccaccccaaggaccacgggggcctgcgcgggggggctcgtctcctccagggaaggggactttttgccgcacttgcagcttgagccccaaccccaa

SEQ ID NO: 944 - DNA, 1505 bp, Zea mays
  Clone ID: PAT_MRT4577_130373C.1
ccacgcgtccgggcacgagggtacgctggtgcgcctctcccctcctcagctcctctccacggctccaacccacctcggcatcgacgccgatttgttacatggcggactcgccggtggagctgccgaaccggctcgccatactgcctttccgcaacaaggtgctgctccctggagccatcgttcggatccgatgcaccaaccccagtagtgtgaagttggtggagcaagagctctggcagaaggaagataaaggactgatcggggtacttcctgtgcgggactcggaggcaacagctattggctctttgctgtctcctggtgtgggcagtgattcaggtggaggaggcagtaaggccgtcggttctgcaggagagtcatcaaagcagcacctaaaaaatgggaaggagcccattcagtggcacaccaagggagttgctgccagagctttacacctttccagaggggtggagaagccaagtggaagggttacatacattgttgttcttgaaggtctatgtaggttcagcgttcaggaactaaatgcaggaggaccataccattttgcccgtgtttcgcgccttgacatgacaaagactgaattggagcatgcagagcaagacgcagatcttattgctctttctaggcagtttaaagctactgccatggaactaatttctgtacttgaacagaagcagaagacagttggtaggacaaaggtgctccttgatacgtcgctttttagtaccagaaaagtgagagcagatcctgctgtttctggctagatgactttaaggggccttgtatttgccagttggtggtgttaaagacaaggtacttccggcccatcgttatggaatcaagagagtaatttttcctgaaaggaacttgaaggacttatcagaggttccattaccaattctctccgacatggagattctgcttgtgaagcgcatcgaggaagtactcgaccatgctttcgaaggcggatgcccacttagatcacgctccaagttgtagcacccaactcgcgtttggtatggatgtttgcttgagaggatcatcgtcacagtaccacgaatggtcaacagtgtgagattccctgctggtcttgccacgcccttttcggtttggcttcgcgtctggaatgtgtatacaggattactggtcagaattctgagaataacgagaagattctctgctgggatagtgggattccctgcatatttatgtgaaaccagctgtcggtctttatgcacagatgcaacagcaacacaaatctggtaggaacactggtgggtttctgtcgataatttgagtgtatatgtaatattatgtaatctattccagggaaacatagttaaaccgaggttgtgaaagccaaagagattgagaaaatatcatacgtactttagggttgggtgacttcgccgaaacggcttgtgttacaaaatgtgcatattcacacttcttcaataaacaaccgaaaatgcaaacatttgctcgtt

SEQ ID NO: 945 - DNA, 3343 bp, Zea mays
  Clone ID: PAT_MRT4577_130377C.1
cggacgcgtgggtgcgccgaattcggcacgaggttcggtattcgtctattttcttttttttaaaaaaaaatattgttctttggcgtacgctggtgcgcctctcctccccgcctcggcatcgacgcgatttgcgtgcccgacatgtcggactcgccggtggagctgccgagccggctcgccgtactgcccttccgcaacaaggtgctgctccccggtgccatcgtgcggattcgctgcaccaaccccagtagtgtgaagctggtggagcaagaactctggcagaaggaagagaaaggcctgatcggggtacttcctgtgcgggactcggaggcaacagctgttggctctttgctgtctcctggtgtgggcagtgattcaggtgaaggaggcagtaaggttggcggttctgcagtagagtcatcaaagcaggacacaaaaaatgggaaggagcccattcactggcacagcaagggagttgctgccagagctttacacctttccagaggggtggagaagccaagtggaagggttacatacattgttgttcttgaaggtctttgtaggttcagcgttcaggaactaagtgcaagaggaccataccatgtcgcccgtgtttcacgccttgacatgacaaagactgaattggagcaggcagagcaagacccagatcttatcgctctttctaggcagtttaaagctactgccatggaactaatttctgttctagaacagaagcagaagacggttggtagaacaaaggtgcttcttgatacagttcctgtttacaggctagctgatatttttgttgctagctttgagataagttttgaggagcagctttcgatgctggattcagttcacttgaaagttagactctcaaaggcaactgaacttgtagacagacacctgcagtccattcttgtagctgagaaaataacacaaaaggttgaggggcagctatcaaagtcgcaaaaagaatttctactgcgccagcagatgagggccataaaagaagaacttggtgataacgatgatgacgaagatgatgttgctgctctggaaagaaagatgcagaatgcaggaatgcctgctaatatttggaagcatgctcaaagggaaatgaggcgcctacgaaagatgcaacctcagcaacctggttatagtagctctcgagcctacttggaacttcttgctgaccttccttggcaaaaggtcagtgaagaaagggagcttgaccttagagttgcgaaagagagccttgaccaggatcattatggactaacaaaagttaagcaaaggattattgagtatttggctgttcgtaagcttaaacctgatgccaggggtccagtgctgtgttttgttggaccacctggtgttgggaagacatctttggcctcctccatagcaaaggccctgaacagaaaattcataagaatctctcttggtggtgtaaaggatgaagctgatattaggggccaccgaaggacatacattggaagcatgccagggagacttattgatggactaaagagggtatctgtgagcaatccagtgatgcttctagatgaaattgacaagactggttctgatgtacgtggtgatcctgcatcagcactactagaagttcttgaccctgagcagaacaaagcattcaacgatcactatttgaatgtgccgttcgacctgtcaaaagtcatatttgttgcaactgccaataggatgcaacctataccccctcctctgttagacaggatggaaatcattgagctgccaggctacacacccgaagagaagttaaaaatagccatgaaacatctcataccaagggtattggagcagcatggcttgagtacgacaaatcttcagattcctgaggctatggtcaaactggtcatcgagaggtacacgagagaagctggtgtgcgcaatcttgagcggaacctagctgcattggctcgtgcagctgctgttaaggtcgcagagcaagttaaaactcttagacttggcaaggaaatacaaccaattactacaacccttcttgattcaaggcttgctgatggtggtgaagttgaaatggaagttattcctatggagcatgatatatcaaacacttatgaaaatccatctcctatgattgttgatgaggctatgctagaaaaagtacttgggcctcctagatttgatgacagagaagctgcagatcgtgtagcaagcccaggagtctcagttggccttgtctggacttcggttggtggggaagttcagtttgtggaggctacagccatggtgggtaagggtgacttgcatttgactgggcagcttggtgatgttattaaggagtcagcgcagctagctttgacatgggtgagagcaagagctgctgacctcaatttgtcacctacttctgatatcaacttattggagagccgtgatatccacatacattttcctgctggtgctgtgccaaaggatggcccttctgcaggtgtgacattggtaacggcactggtgtcgctttttagtaacagaaaagtcagagcagatactgctatgactggcgagatgactctaaggggccttgtattgccagttggtggtgttaaggacaaggtacttgcggcacatcgttatggaatcaagagagtaattttacctgaaaggaacttgaaggacttatcagaggttccattaccaattctctccgacatggagattctgcttgtgaagcgcatcgaggaagtactcgaccatgctttcgaaggccgatgcccacttagatcacgctccaagttgtagcacccaagtcgcgtttggtatggatgtttgcttgagaggatcatcgtcacagtaccacgaatggtcaacagtgtgagagtaagagcctagctctcttgccagcacaggtcttggcacgcccttttcggtttggcttcgcgtctggaatgtgtatacaggattactggtcagaattctgagaataacgagaagattctctgctgggatagtgggattccctgcatatttatgtgaaaccagctgtcggtatttatgcacagatgcaacagcaacacaaatctggtaggaacactggtgggtttctgtcgataatttgagtgtatatgtaatattatgtaatctattccagggaaacatagttaaaccgaggttgtgaaagccaaagagattgagaaatatcatacgtactttagggttgggtgacttgttacaaaatgtgcatattcacatttcttcaataaacaaccgaaaatgcaaacatttgctcgttaattaaaaaaaaaaaaaaaaacaaaaaaaaaaaaaaaaaccccccccccccggc

SEQ ID NO: 946 - DNA, 141 bp, Zea mays
  Clone ID: PAT_MRT4577_130728C.1
tttgcctgcgccgccgccaacacaacccttgagccccaatccctcacagcaacggtggggggcgctcaagaatacctctctctcgtgggcaccatgcgcggccacaacggcgaggtgacggtgatcgcgaccccgatcgac

SEQ ID NO: 947 - DNA, 943 bp, Zea mays
  Clone ID: PAT_MRT4577_130815C.1
gggtacctcgaggccggccggggccgtcacatcgcgaagacacactgggtaggaagagcgcagaaaaaggaagcagcagctttgatcgggtggagtttcttgctcactgatcgtcgagtgaagcctttgtggtccgtgacgatgtcgaggagagccgcagcgttgttgctcgcgtgcctcgtcgccgtgacagcggcggcgctggcggacggcgcgctgctcccgtggttcggcgacggccggcgcgggctcgacgaggcagcggtgaccgacgtgggcctcctggcggccgacccgttccggatcctggagcacgtccccttcggcttcgaccgggacgacgtggccatggtctccatggcgcgcgtggactggcgcgagacccccgacgcgcacgagatcgtggtcgacgtgcccgggatgcgcagggaggacctcaggatcgaggtcgaggacaacagggtgctgcgcgtcagcggcgagcggcggcgcgctgaggagcgcaagggcgaccactggcaccgcgaggagcgctcctacggcaggttctggcgccggttccgcctccccgagaacgccgacctcgactccgtcgccgccagcctcgacagcggcgtcctcaccgtgcgattcaggaagctggcgcccgagcagatcaagggcccgcgcgtcgtcgggatcgccggaggagacggtggcgccgaggcgaaggagagcatcggaactggcgccggagatggtcatcagaccaagaaggtggagctctgaacagtgaggtgggaattgggatgactcaatgacggagatggctctgcgcgtgtgcgtagttttactagtttatgtgttcgcgtttttcttttttgtgacagcgtatatgcacttgtatggagtggaagtgtgccatgttttactgaggaataaaaacctacagtactagtgtact

SEQ ID NO: 948 - DNA, 1091 bp, Zea mays
  Clone ID: PAT_MRT4577_130817C.1
cttctggctcgccgccagcgcgctccattctccaactacctcaccaccctataaatgtagtcgcctactcgcctctgcgccgtcaccatcgcgaagacacactgggtaggaagatccgcagaaaaaggaagcagcagctttgatcgggtggagtttcttgctcactgatcgtcgagttcctgttcgatcgaagttccaggtgcgcacgtacgcactgaagcctttggggtccgtgacgatgtcgaggagagccgcagcgttgttgctcgcgtgcctcgtcgccgtgacagcggcggcgctggcggacggcgcgctgctcccgtggttcggcggcggccggcgcgggctcgacgaggcagcggtgtccgacgtgggcctcctggcggccgacccgttccggatcctggagcacgtcccgttcggcttcgaccgggacgacgtggccatggtctccatggcgcgcgtggactggcgcgagacccccgacgcgcacgagatcgtggtcgacgtgcccgggatgcgcagggaggacctcaggatcgaggtcgaggacaacagggtgctgcgcgtcagcggcgagcggcggcgcgcggaggagcgcaagggcgaccactggcaccgcgaggagcgctcctacggcaggttctggcgccggttccgcctccccgagaacgccgacctcgactccgtcgccgccagcctcgacagcggcgtcctcaccgtgcgattcaggaagctggcgcccgagcagatcaagggcccgcgcgtcgtcgggatcgccggaggagacggtggcgccgaggcgaaggagagcatcggaactggcgccggagatggtcatcagaccaagaaggtggagctctgaacagtgaggtgggaattgggatgactcaatgacggagatggctctgcgcgtgtgcgtagttttactagtttatgtgttcgcgtttttcttttttgtgacagcgtatatgcacttgtatggagtggaagtgtgccatgttttactgaggaataaaaacctacagtactagtgtactaaaaaaaaaaaaaaaaaaaaaaaaaaaaaggcttagtacgcggcaggacgt

SEQ ID NO: 949 - DNA, 319 bp, Zea mays
  Clone ID: PAT_MRT4577_130847C.1
ggcaacaccaaaaagcaccattttttccttaagattaacttaaaaaaaaccctgccgggggtaacaaaatccatcgatccccaatccatgctgtttgatgcatgggtcctcttaaaccggggataaacacaatccttacaattgacacaaatggaccttggaataaaaaacacagatgggcaaaaacaaacacgacccgaacgaaaataaaccctttggactagggtaaacatcacggtagcaaacaggataacttggccgggcgggccccaccgtttaattcctccaattcccgtgggagttgccctaacccccccca

SEQ ID NO: 950 - DNA, 348 bp, Zea mays
  UNSURE (1)..(348): unsure at all n locations
  Clone ID: PAT_MRT4577_131110C.1
  unsure (1)..(348): unsure at all n locations
cttccagaaggccaatgtcaaaggaacccggaaacttccggggcaactgcctggaatagcctaattgggggtgattgatcaagctacttgagctccgatcctcgctagctagttagtttaccgttttaccacaagtcttcttcacaagttaaggattgacagcaacaaaaaatctcaatggcctctgccaccgcgctcaagtcctccttccttcccaagaagtccgaatggggcgccaccaggcaggccgccgcgcccaggccgtccaccgtctccatggtcgtncgcgccttcggctacgccgatgagctcgtgaaaaccgcgaaaacgatcgcgttgccggggcgg

SEQ ID NO: 951 - DNA, 1261 bp, Zea mays
  Clone ID: PAT_MRT4577_13125C.1
cctcgaggccggccgggccgggactcgagccaaaccccctcaactcaactgctgaacgcagagttcgatctagcacgcgcagcggcggccgctgcccacaatggcgtcccttttcaaggacccgagcaagctctcagcgtacagggaccgccgattcaagggcacacaggaggagtatgaggcaacgctgcatgcgtcgacaacgctgtacattgggaatatgtccttctacaccacggaggagcaggcctacgagctcttctcccgcgctggcgagatcaagaagatcatcatggggctcgacaagaactctaagaccccatgcggtttctgcttcgtactgtactactccagggaggatgctgaagatgctgtcaaatacatcagtggaacgatgcttgacgatcgtccaatccgtgttgatttcgattggggctttgaagaaggcaggcaatggggccgtggacgaagtggtggacaagtgagagatgagtaccgtacagattatgatcctggtagaggtggttacggtaagatggttcagagggaactagaagcacaaagagaactagttgactatggtggatctttccaaccaaatgcaccacctccctatgagagaggtgagcggaagagaggatacggggactctcataggaatgccagaggagattaccagcggaaacgctaccggagcagcgatgaccggtcagcaccagaggagtccaagagagcgcctgactctgatccagcggataagaatcctagatttcgcgagaaaggtgactctgatgaagaagatgatgactacgacaagagacgtcgtcgctaaagctgtgtggaacagtcgttgctacatgcagctgttctggtgtccagtcgctgcagaagagtccacagcgagcagcagtatccggatttcgccctgctgtgcctgtactgttcctccttttcgggctagtttggagccacaaaagtagagcagattggagggcccaaaatacacttcttattcaaaatttgaataataagtggatttttgtttctccaatcccttccggttttatggctcccaaactagtccatctagtgcgtcggttttacatgtggttcaagtggggtactgtgtgctaacagatacaacaacgaggcttgtctgtatgtctgctgacactagagaccaatgcatataatgattctaatttaggccccgtttgatgattctaatttaggctccgtttggtaaggcttcggtttcttt

SEQ ID NO: 952 - DNA, 1214 bp, Zea mays
  Clone ID: PAT_MRT4577_13127C.1
ctcgaggccggccgggaacgggaggcatcctcgcaggtcgccaaaattcccacgcccggcggttctacggtcgagccaagccccctcaactgctgaacggagagttcgacctagcacgcgcggccgccgccgccgccgcagcccgcaatggcgtcccttttcaaggaccccagcaagctctcggcgtacagggaccgccggttcaaggggacgcaggaggagtatgaggcggcgctgcttgcgtcgacaacgctgtacatcggtaatatgtccttctacaccacggaggagcaggcctacgagctcttctcccgcgccggcgagatcaagaagatcatcatggggctcgacaagaactccaagaccccatgcggtttctgctttgtactgtactactctagggaggatgctgaagatgctgtcaaatacattagtggaacgatgcttgacgatcgtccaatccgtgttgatttcgattggggctttgaagaaggcagacagtggggccgtggacgaagtggtggacaagtcagagatgagtaccgtacagattatgatcctggaagaggtggttacggtaagatggttctgagggaactagaagcacagagagaattagttgactatggtggatcttttcaaccgaatgcaccacctccttatgagagaagtgagcggaagagaggacacggagattctcataggaatgacagaggagattaccagcggaaacgctaccggaacgatgaccggtcagcaccagaggagtccaagagagcaccggactctgatccagcggagaagaatcctagattccgtgagaaaggtgactctgacgaagaagaggatgactacgacggcaaacgtcgtcgctaaagctgtggaacagccgttgctactacatgcagctgttctggtgtccagtcgttgcagaagagtccacagctagcagcagtatgccagtatccgaatctcgccctgttgtacaacagatttaattcttcggtcggccattcctccttttctagtgctcctatcatctgttaatctgaatgtgcgtcggttttacatgtggtccaagtggggcactgttctcacagatacaatgagccttatctgtacgtttgctgctgctgaagcttgagaccagtgcatatattaattctaacagattgttaccgaaaaaaaaacccacgcgtccgcggacgcgtggg

SEQ ID NO: 953 - DNA, 358 bp, Zea mays
  Clone ID: PAT_MRT4577_131301C.1
aagcctttcttaaactaacgttgttgctgaccaaaaaaaaaaaaaaaaaaaaaaaaaaaaaaaaggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggccgccccttttaaagaacccaactttacttccccttccttccaacttaaaaccttttttatagtgccccctaatttaaattaattgcccttcttttaaaaacttcttaactggaaaaaccttggctttcccaaatttaatccctttgaaaaaaatccccttttccccaattgccttaataccaaaaagcccc

SEQ ID NO: 954 - DNA, 190 bp, Zea mays
  Clone ID: PAT_MRT4577_131328C.1
gctgcgaacaaaaaccttgctcattcttctctcgtctcgttttatagcgggagcaaacaatgggaacaacaggggtaccaacacctaatccaaaggttgaacggacactaacacggtgacagatgcgaacgggaacacgattctatagatagataatataacttggtcgaagccaggatgggtccacaca

SEQ ID NO: 955 - DNA, 245 bp, Zea mays
  Clone ID: PAT_MRT4577_131498C.1
cgcgaagatgggggcccgcggcatgcaggcgttcggcaagcactgcaagtccctggcgcggctgcggcgggtcatgcacccgatcgccctggcggacagggcgtgccagcacgacgacgcgcacaccatcgcgtggagcatgtccatgctgcagcacctggagatggggtacatgctggtggcgacggaggcggtggccgagatcctgaggcggtgccgcgagctcaggttcctgggcgtgcgcg

SEQ ID NO: 956 - DNA, 3529 bp, Zea mays
  Clone ID: PAT_MRT4577_131516C.1
gcatccgtccgggcctcctcgtctccccagccccgccgccgccgggtcctgacctagcctccagcgccgcccgctgccatctgctctagcatcacaccaccgctgtggagggaccgagggagcagagcaccggagtagccaccgccgctggtggagtaccagtcacctggagtagccacgcagacaagcaacgaaggcgagcagcagcgcgtggtagaggccctccgacctccgatttgacctccgtccggctctctgcactgccgtccaaatccaggttttgtctcccaaatatcttgcctttttgttgcattggactcttctgtggttagaatggcagcacccaagcccatttctcgtcttatttctcatgtcattcttgatttggatggcaccctcttaaacacagattttgttgtaggtaaggtagtaaaaccatttattctaaagaatggaaaaacgtgggatagcaagaaagctcacaagctagttgggaagacaccttatgaagctgcagctgttgttttagaagactatggactcccttactctacagaagagttcctctcgatgattactccgatgttcagtgagcagtgggcatccgtccgagtttcttgaatgctaatttgaaggaccagtcacatctctctcagtgagctggaatgcatgtgcctgacttgtgggggcatggttttgaaattctcaggccaactttccttcactcgagagcttgatagagagaattcacgaggatggaagagtagcagagaagacactggacctgccaatgtatgccaagtacaaagactcgccttatctgagaaacccttcgaagcacgggagtactatcggtgggacccaggctgagatggattccaagtgagaagccccctggagggccactagataatctgttacttatttgccctatggtaaatgcgtcggtgttgatgcagaaacaattggactcattgtgagcttactcgcttcttttcgaaagtagttagtattcctcgaagtggtgtttttaccttgtaataaaggcaaaacagtattgttacgcggcggtcggggcgctctcagcgtgcacgaggttaggtgcattggatttgggatgacaggcggttgaaatagtgcactaggatgaggtccttgacaacccagtcctgggcactgcactgatcaatatgtatgctaagtgttggagcacaagagaggcatggatggtgttccagcagatgttggagagggacatcattgtttggaatgcgatgatcatggggcttggcatgattggccacgagaagattgcatttgtgcttgttggccagatgaagaactcgggtgtgaagctgaatgataataccttcattggattgctctgcagctgcacacatactagccttgtgaatgatgggcggcggtattttcataacatgactcatgtatacagtataagccctaggattgagcattatggttgtatggttgacctgttgagtcgtgcgggattgctggaggaggctcatcagctgattggtgacatgccaatgctggcaaatgccgttgtatggggagcacgcctcggtggttgcaagatccatcggaatgctgaccttgctgaatatgtgctgaagcagctcatccgactggagccatggaattctgggaactatgtcatgctttctaacatttactcgaacagtggaagatgggaagatgctgcaaagcttaggttggaaatgaaggcaaaggggattgagaaggtcgctgcctctagctgggttgagcttgatgataaggtccacaagttctatgttggggacgattcacatcctctttcagataagatctatgcaaagcttgatgaattgggccacggcataccttgtagattgagcccatagcagcccatatatgaagaatgccaatgtatgccaaggacaaagactcacctagtatcagaaacccttcgaagcacgggggtagtaccaccggtgggaccccgtttgagatggattccaagtgacaaccccccttcagggcccctagataatctgtaacttattttccctatggtaaatgcgtcggtgttcatccataaacaattggtcgctctgtgagcttactcgcttcttttttcggaagtagatagtattcctcgaagtggggtttttactttgtaatatagaaaaaattaaagtgaggctggatttggatggcaccctcttaaacacagattctgttgtaagtaaggtagaaaaccatgcaacttaaaaccacttccaggagctaatcgactgataaaacatttaaagactaacggggtgcctactgctttggcttcaaactcaccaagatgtaacatagaagccaaaattttcttccaacaagggtggaaagagtctttctctgcaattgttggtggagatgaagtagagaaggggaagccatccccgaatatatttttggaagctgcaaagagaatgaactgtgctccttcaaattgcttagtaatagaggattccttgccaggtgttacaggtggaaaagctgcagaaatgcatgtcatagctgtaccttcaatacccaaaaagactgctgagttcagttctgctgatgaggtgatcaattccctccttgatgtgaggcctgaaaagtgggggttgccaccatttaatgattggattgaaggtaccttaccaatagaaccatggtttattggtgggcctgtgatcaaaggatttggccgtggttctaaagtactaggaataccaacagcaaatttacccgcggagaatttttccgacgtagtgtcagaacatacatcaggggtatactttggctgggcaggactttcaacgcgtggtatatataagatggttatgagcattggctggaacccatatttcgacaataccgagaagacagtagaaccttggctgcttcatgatttcggcgaggacttctatggcgaggaggtgcgccttgccatcgttggctacataagacctgaggccaactttccttcgctcgagagcttgatagagagaattcacgaggatggaagagtagcagagaaggcactagacctgccaatgtatgccaagtacaaagactcgccttatctgagaaacccttcgaagcacgggagtagtactaccggtgggacccagtctgagatggattccaagtgacaacccccctacagggccactagataatctgttacttattttccctatggtaaatgcgtcggtgttgatgcagaaacaattggactctctgtgagcttactcgcttctttttcggaagtagatagtattcctcgaagtggtgtttttactttgtaatatagaaaaaaataaagtggggttgttgaaacttgagagtcaaattccgagacgttatgcacgttttgatttctgaattaatcgattggtatcacttgtactgtttttataaaaaaaaaaaaaaaaaaaaaaaaaaaaaaaaaaaaaaaaaaaaaaaaaaaattatatttttt

SEQ ID NO: 957 - DNA, 3101 bp, Zea mays
  UNSURE (1)..(3101): unsure at all n locations
  Clone ID: PAT_MRT4577_131643C.1
  unsure (1)..(3101): unsure at all n locations
nattcggcttcctgttctgttcgcaccgcctccgcccccctccctccctagtccctccctccctctccccttccggactctctgctctcctctgctgcggccatccattaatctcctctcctcgccatcgctgcactcactctacgcttccctcctcaagcccgagggcttctccgggaaggaatcgccgcgccgggttcctgcaacgccccgccctttgcgcacccggagcaactgagtcgtggctatcgaggatgatgccgcgtttcagataacagagactgtgagagtgcacgacacacttgacatgcagagatgaagatcagtgcgcttctcacctccgcgggcatcaacattggcctctgtgttctattcctgtcactctactccgttctcagaaagcagccggccaatgtcagggtctactttggccgcaggatcgctgaggaacacgatcggctccgaggggcatttatcttggagaggtttgtcccatccactggatggatagtcaaagccctgcagtgtactgaggaagagatcctggctgctgctgggttggatgctgttgttttcaatagaattctagtattcagcatacgcatcttctcccttgccgcagttctgtgtgttttcgggattcttccgctcaattattttggacaggatatacaccatgttcgaattccttcagaatcactagatatatttacaattggcaatgtagaagtgaaatcaagatggctctgggtccattgtgtaaccctgtacataatttctgcagtagcttgcattcttctatacattgagtacaagcacattgccaggttgaagctccttcatcttacaagcgcaacaccaaaaccaaaccattttacagttcttgttcgtggaataccaaaggcagataaagaatcatgcagtgatgttgttgataatttcttcacaaagtatcactcatctagttatctcttccatcaagtagtttacaaagtcgggaaagttcagaagataatgactggcgcaaagaaggcatataagaagttcaaacatttcacagatgaaactgtcgatcaaggttgcaggacagttacctaccgctgttgtctgtgtggagcttcttcaaattctttcaagttgttgaacactgagtgtgagcagaacaaggggaaagcggacaataaatccatcttggacttagacgatgaggaatgcacaactgcttttgtatttttcaaaactcggtatgcagcacttattgcgtcagaaatacttcaaacatctaaccctatgaattgggttgctaatcttgctccagaaccagaagacgtgtattggtccaatctttggctaccctataagcaactttgggctcgccgtattgctacactcctaggctctatctttttcatgttcatatttctgataccggtgacatttatacaaggactatctcagctagagcagttgcagcagaggcttcctttcctaagaggaatattgaagaagaaatactacatgactcagctagtaactgggtaccttcccagtgtcatactgcaaatcttcctgtacattgttgctccaattatgatgctgttttctacattggagggccctacatctcacagtgaaaggaagagaagtgcttgctgtaaagtgctgtactttacagtttggaacatattctttgctaatgtattatctggtactgtcattagtcaattgaatgtgttatcaagcccaaaggacatacctgtccagcttgctaaagctgtacctggacaggccactttcttcatcacctatgtcctgacctcaggatgggctagtttgtcatctgaagttatgcaactctttggtctgatatggaactttataatcaaatacgttctgagaatgagagaagatacagaattcgttccctcgtttccttaccacacagaagtaccaaaagttctgttgtttggactattgggcttcacattttctgtgctggctcctctgatcttaccttttctgctggtgtacttttgtcttggttatgttgtataccgcaatcagttgctcaatgtgtatcgaacaaggtatgacacaggtggtttgtattggccaattgcatacaacacagtcatattctcacttgtgctcacccagatcatctgccttggtgtatttggccttaaagaatcgccggtagctgcaggcttcactgtacctcttatcatccttactcttttgtttaaccagtactgcagaaaccggcttcttccattattcaagacttttccagcacaggatttaatcgacatggacagggaagatgaacgatcaggaagaatggatgaaattcaccacggacttcattctgcttattgccagttcgctgacactgtagatgtgcccttggataaaattgaaatcgttggtggggatgaggagcaaggctctagctcgggtcagtccagtgttaaagaaacgtgcgaggatcccaagaagcacctggctcaccctacactaaaaggactccctgttaaccgcctccggcatgccgtgaggtcggttactttcctgatcagattgcagaaaagaggtttatcagaacagaaaatcggataattagttagccgccaaccccctttgcttgttggctatataaatgtacagaggcatacatgcatatacgatcgttcccttagaagagagaagggctaatgtagaagtctatgggagaacatcatcatgagtgttgaggtgcaattttgttttgtcgcatggatgagtttgttggttctgcgggttatctggcagattcagctacccaaaccttagccttgcacgttgatgaaattaatgctcatggttttgttgtaagagattaatgtggccaaagtgatctagatgtataatgtcctcctctccattggtttgtgtttgagcctcgcaactttagcaggtctgttagtcttcatgcgccaatcatattgaggtattgagaattatactaattggtttgtctgacaagctgtaagcatgttagtccatgctgtcgagcagcaggtgtggaggttcttaacatgtagcattgagctggtatctgc

SEQ ID NO: 958 - DNA, 2431 bp, Zea mays
  Clone ID: PAT_MRT4577_131768C.1
cgagttccgccagagccacacgttttcactgctcccacgaaggcacaccgcacacagccgcggcctgcaggcgacggtgacggcggcggcggcgctccatcctccgccccttcccttactcgcgttcggcacgcaggcgacggtgacggcggcggcgctcaggatcgggctctcagcgacggcggcggcggttttccctcccggctctcgccagtcgcctcgcgctctcgcctccggtcctccgaacgccggccggtgaccctgctggatgacatgagcacactaaatacaatcctgatgaagatggcaggattagcttcctgctgagttttgtcctacaagattgcaaagggcagaatgtcagctagggattctaatcattcatataaatgttcggatgattctcaaatgccgtactacaataactcagcacctgtaggagaaaatggtaggatccatatggcagaaaacagtctaggacatcattactcatcctccgatattggatcacaaaggatcaacaattccaaccctcaagtatttgaagcacagtactgcactctggaatcatcctcagcaaatggtgtttatcctgcacaaagctccacatcttctcatagcatctcccctttaagtgggagccccctgtctcagcatgacagccactcagaccacacatatagttctcctccaagtgcttcctgtctaactgaggttgcagatctcctgatccaacaaaaagaattagagaattccattgttggacctggactggacattagttctgactgctctcggagcttgttgcaagcccatgttccagtgagaccagacaactggagacaacttctgggaattaatggaggagacttgatgcaagtagtcatagcatgtggtaaggctgttgcagagaatgatgtctttgcaacagaactgttaatatctgagcttggtcacctggtatctgtatctggagatccaatgcaacgacttggagcctatatgcttgaaggaattgttgctagactttcttcctccggcagtatgctatataaatctttgaaatgtaaagaacctacaagctctgagctcatgtcatatatgcatctcctttacgagatctgcccattctacaagtttggttacatgtcagcaaatggtgccattgccgaggctattaagggcgagaactttgttcacataattgatttccaaattgctcaggggagccagtgggttactctgctacaggcccttgctgcaagacctggggggccaccatacattagaatcactggtatagatgactcaaattctgcttatgccagaggaggcgggcttgatatagttgggaggacgttgtgtgatgttgctaattcatgtggtcttccttttgagttcaatgccgttccagctgctagccatgaggttgagcttcagcatcttgctataagacatggggagattattgctgtgaattttgcctatcagctacatcatgttcctgacgaaagtgtaagtacagaaaatcatcgggataggattataagaatgatcaagagcatcaatcctagggttgttactctcgttgaacaggagtcaaatacaaacacagctccattcttcccaaggtacatggaaactctcaactactatacagccatgtttgagtcgatagatgttgctctcccaagggatgataggaggcggatgagcgcagaacaacactgtgttgcaagggatattgttaatttaatcgcatgcgagggtgctgaaagggttgagaggcacgagctgtttggaaaatggaagtcaagatttgcaatggctggatttagaccgtacccactgagttcagttgtgaacaacactatcaacacattgttgcatacctacaacagctactacaggcttgaggagagagatggtgtcctttaccttggatggaaaaacagagtattggttgtatcttcggcatggtgttgacatttcctctgcaggttccatcgcactttggcctccatctgacgtttctaaggcaccattatgcttgtctggtatactcagtatatgcttgtatgtaatttgcaaccataccttacccaatggttatcttaccaactagatcttcatggcaaggtgaagtgtcacttaaaatctagaagttgtaactgtcgtgttgacgctagatatagatagttctgctttggtttgacatatgcagatgtgctgtaatgctcaggggttatgctaggcaggcccaagagggtgcctgtttgttatctatcaggctactgtgttgccgcctgctttgtgtgtgcatatatatttggaatgctactgtcctttctctgggatgaagtggattgctaaagtgtcatgtttttcgtaaatactatatccattctcaaatatttgtttgttgtcagct

SEQ ID NO: 959 - DNA, 2198 bp, Zea mays
  Clone ID: PAT_MRT4577_132012C.1
accctcgggcctgcctgggcattttcaggtggacattttactagtataattagacttttactttattgtagatggggtaacaatgtcaaaaaaaccttaagctatattattagcttgctcgcgttcttaattactagaccaacgcattcttatattttgtagccattgctatctccagtgtcaccacgcgttcttattaatgcgagtacgcaaagccagcaactggaccgcgtcgggcatcggttcctgttctgtgctatactgctatcccctcccccaagccgtcaccagcccaccaccagcagcggaaccccccgccctcgttcctcccccgccggcgagagatctacgagatggtgctgtcacacggcgtcggcggctccgatgagtccgtccactcgacgttcgcgtcccgctacgtccgcacctcccttcctaggtaccggatgccggagcagtcgatccccaaggaggcggcgtaccagatcatcaacgacgagctgatgctggacgggaacccgcggctgaacctggcgtccttcgtcaccacgtggatggagcccgagtgcgacaagctcatccaggcctccgtcaacaagaactacgtcgacatggacgagtaccccgtcaccaccgagctgcagaaccggtgcgtgaacatgatcgcgcatctcttcaatgctcctctcggggacgctgaaacggctgttggagtgggcaccgtcggctcgtccgaggccatcatgctggctgggctggcgttcaagaggcgttggcagaacaagatgaaggcggccggcaagccctgcgacaagccaaacattgtcaccggcgccaacgtccaagtttgctgggagaagttcgcgcgctacttcgaggtcgagctgaaggaagtgaagctgagcgacggctactacgtcatggacccgcagaaggcagtggacatggtggacgagaacaccatctgtgtcgcggccatcctcggttccacgctgaacggcgagttcgaggacgtgaagctgctcaacgacctgctcaccaagaagaacgcggagacaggctgggacacgccgatccacgtggacgcggcgagcggcgggttcatcgcgccgttcctgtacccggaactggagtgggacttccgactgccgctcgtgaagagcatcaacgtcagtggacacaagtatggtctggtctacgccggcatcgggtggtgcatctggaggaccaaggcggacctgccggaggagctcatcttccacatcaactacctcggcgccgaccagcccaccttcaccctcaacttctccaaaggttccagccaggttattgcacagtactaccagctgatccgccttggctttgaaggttacaagaacatcatggagaactgccaggagaacgcgacggttctgaagcaaggtctggagaagacggggaagttcaacatcgtgtccaaggacaacggcgtgccgctggtggccttctccctcaaggacagcagccggcacaacgagttcgagatctccgacttcctgcgccgcttcgggtggatcgtgccggcctacacgatgccccccgacgcgcagcacgtgaccgtgctccgcgtggtcatccgcgaggacttcagccgcaccctcgcggagcgcctggtgctcgacatcgagaaggttctgcacgagctggacgcgctgcccgcccgtgtccccagcggcgacctagccgcgctcgccgcggccgagtccagcgagagggagatggagaagcagcgccaggtgatctcgctctggaagagggccgtcctcgccaagaagaagaccaacggcgtctgctaagcagccgagccgacgcatttctggccgtattggcatggggtgaaatttgtctgagtacgcgtttgcagtttttacccgggtgaagattgttatgtgtcgaggttgagttttagaggacggaattgctccggctcggtgtatgtagcgagtgttttacgtgctcaacaactctcagacttccctcccctcttgcatgtaagctgtaagtcgatgcaaataatgttgcgtgtcgagcgacgattagtaatagtacctgatggggtacttgtattagtattgatatttgaattacactatacattatgtgacatactattaatattgctcgacaaagtaatattatcggctcctgtttgattttct

SEQ ID NO: 960 - DNA, 2584 bp, Zea mays
  Clone ID: PAT_MRT4577_132084C.1
attaacagtaacgcgtggaggggggggggggtgggggggaagcacagtcaagataattgtatcttgcccgctttcctctttctttaaccagagggtacaatatataggctgtgatagctaacaaactaatcaactctatctaggatttccaaactaatgcttatccatcctaaacaggcggatgggatacttatccatctaaacaaactaactggaactagctgattttattagggctgttggtcataacagtttcactctacatgtgaaaatgtagatatacatatgaatggacaacatgactaactgtcttgttgcttgcttgttgcagagacgcgagaccaagacaaaagcagccagcggaaaagaggggaagcctcgactcattcccaccagttccatccccaattccatttctccatccatgacagctcgccatttccccacctgttcctacgctaccgccacctaaaaaaattccaggcactatccatttcaatcttgctcaaaggtcatttcattccggccggtgcctattttaggccgattggagggaaggctggtctgtgttttgttttcctgctgcgagcgctttcttgggcgagttgaatttgggcgcctcttgctccaggcagtatttttatcgagctagaatctggtacccggtgattcttgcttggtccaggcgccaaggcgaggaattgggcctagccccagctcaaatctgtgccttgttgcagacagaaggatttctgcatgggcgaccataactaagatgtgagatttggtggcgtcagctcggctggtgggtgattcttggtgcgtacacagacacatccctggaggcctggaggtttggcgaggaggacagtgcaggagagagatgtctttcaggagcctgattcaggacatgaaggacgagttcgggagcatctcgcggcacagccttggcggtcccggtctcaccgctccgccgggaacgcggcgcgggcggtggccgcgggaccgtcggaggcgatggatcagagctgctggtcgcagctgccccccgagctcctgcgggaggtgctggtgagaatcgaggcatcggagagctggtggccagcgcgcaaggacgtggtgtcaggcgccggcgtctgccggacctggaggggcatcatgaaggaggccgtgcgcgtcccggaggtgtcagggaagctcacgttccccatctcgcttaagcagcctggcccaagggatggcactcttaaatgtttcatcaggaggaatcgaactactcagacatattatctgtatattggattgacagaagcattggctgatgatgggaagtttctacttgctgcacgcaagtgtcgtaagcccacctgcacagactacctaatttctcttgataaggttgatatgtcaaagggaagcagcacctatattggcaagctaagatcaaacttccttggaacaaagttcactgtctatgatgctcatccaccatatgatggagctgcggtctcaaagagtcgctctgcacgtgtggttggtttgaagcaggtctcccctagagttccggctggaaattatcccgtttcacatatttcttacgagctgaatgttctgggctccagaggtccaagaaggatgaactgtgttatggattccatccctgcatcagctgttaaggaaggagggaaaactcctacacagactgaatttccacttagcagccttgactctttcccatcatttccattcttcagatctaaatcagctcggatagacagttcaacgtcgcaatcatccagtcagagggaagataggttggtgctgaagaacaagtctcctaggtggcacgaacaactgcagtgttggtgcctgaatttccgtgggcgggtcactgttgcctcggttaaaaacttccagttggtggcttctgaggacaatggaccagagagccaagagagtgacaaggtgattctccaattcggaaagatcggaaaagatttgttcaccatggactacggttatccaatatcggcatttcaagcttttgcaatttgtctgagcagttttgatacaaaaattgcctgcgaatgaggcaaggtgattttcccccttctctattccccttgcttgtattatggacatgcagtaaaattttattgaacatgcaatttccaatgtcaaggatgattggatgaagctctcccaacgtgaaaaaaaaaaaaaaaaaaaaggaaggccgcccgctagtaaaggatcctagcgttactgctcgtgcatacaaaaacattttgccctctctccacctttaactcaacaatgcttttgtcctcgtctatctgcagaagctggatagcggtggcggatagcatgacagcaataggaggatagcatgacagcaataggaaaacggtcgcaaacgtatatttattcggtttgactttttttctttaattttgaataaataagatatataatgtgcaatacaaatttatatttttgtttttagcattgagtctgtaaaagttcataaaagataaatctcaaatttattataaattcacccaaaaaaaattaagggcggccg

SEQ ID NO: 961 - DNA, 1584 bp, Zea mays
  Clone ID: PAT_MRT4577_132172C.1
gggtacctcgaggccggccggggagatcggctgcctcgatttctcttcgagtgccaagcagtactgctagttctacttctgtacttcagcagtagtaggccgctgttgctacaattttgactgactgagatgggaatcctctgcctcggtgcttcctccacactgctctgcggggaggacaggaacaacgtactcggcctcggctgcggcaacgagctggtggaggtggggagcggccatgacggcttggactccgtcgtcggcgccgtgttccccgtggacacagatgaggccgtgcgggcgttgttggagaaggagacggaccacaagcctcaagacggctatgcggagaggctggagcgcggcggattggagtactcctggaggagagacgccatggattggatttgcaaggtccattcgtactacaggtttggaccactcagtctttaccttgctgtgaattacctggatagattcctctcctcatatgatctcccacacgataagccttggatgcgacagttgttgtcagttgcttgcctagctctcgctgtcaagatggaggagaccgtgctccctcttcctgtggaccttcaggtctgcgatgtgaaatttgagtttgaagcaaggactattgggaggatggagcttcttgtgctggccaccctgaaatggagaatgcaggctgtgacccccttcactttcatcagctacttcctcgacaagttcaatggtgggaagccgccgagtttggcactagcgtcacggtgcaccgatatcataattggcacactcaaaggctctacattcttgtcattcagaccatctgagattgccgcggcctcagctctagcagcagtttctgagaatcaggttgttggctcctcgagtgctctttcagcatctgaagtccctataaataaggagatgattgctagatgctatgagctgttgcaagagcaagcgctggtgaggaagacagggcacatcaatggaagcccttcagtgccgcaaagcccgattggcgtgctggatgcaacatgcttcagctttaggagtgaagatgtaagactaggatcatcgcaatcaaacaacatcagtagtagtagtaacgacaatcaagtttctaagaggagaaggctaagcatatcaccaatctgagtagatcaaatctctgttggcagtgtcgcattgtgcgcttggttatgcattgatcatcttaacctcagagcttgtcagagcaacaagtagtggtacaaaaggacccagtgaagcattgtaacaagcagaggatggtgacagtaataagttagaagcagcttcttgatctctgcgacgaaataggtgacgaggaacgtttcttcctctagtaactttgaatccccttcctccccggtccctttgttttattccttttcctttttatcggtatctcaaggcatttgtggggactggggagatatatgtggatatgagattggagacgtgaggattaaagagagagagagggagggagggagataaaaaaaaaacaggtttgttcctttgttctctgccaatatacaaaaaaactgtcgtgcg

SEQ ID NO: 962 - DNA, 436 bp, Zea mays
  Clone ID: PAT_MRT4577_132351C.1
taggggccttttttttttttttttttgaggaaatcagagttgcatacattttttcggacctcgtaccaggatcgtactccggcacttgcgtgcacacccgtatagatacgatagattacgtagccacgctgattcgtgcatcacgcgagcgcatacatacgaacgcgcgtacaacgcggagggggatcgatatcgctctctcacacgcacgcgtatgacgcggggagggacgacgatacgggaggatcagatcagccgaaaaagtggtgcttcttctcgccgccggcctcctcagggtgcttgcgggccttcttcttctcgtggtgctcgtggaaggcgaagccgcgggagccgaggggcggcgccgccgggacctcctcctcgatcttgtggaggtgcgcgtgctccggggccttctttgcctcgtgcttctcga

SEQ ID NO: 963 - DNA, 342 bp, Zea mays
  UNSURE (1)..(342): unsure at all n locations
  Clone ID: PAT_MRT4577_13259C.1
  unsure (1)..(342): unsure at all n locations
gacccacgcgtgncggggatcttacctttatcattcttgttttttcaacaatcatcanccctattgcatcagtgacctttgtttcatttattgtcacaaaacatcatgtcacaacaactacaacaacttgtgctagcaaaccttgctgcctactctcattaacttctcttttttacattcaaccaactaactgcattgaactctacttcttatttgctacaacaacaactaccattcagccagctacctgctgcctacctccatctttttctttcattcaaccatctgccaatattgaactctcctgtttattcacagcatcaacaactactaccattcatc

SEQ ID NO: 964 - DNA, 1437 bp, Zea mays
  UNSURE (1)..(1437): unsure at all n locations
  Clone ID: PAT_MRT4577_132612C.1
  unsure (1)..(1437): unsure at all n locations
cattgggtacctcgaggccggccgggttcgctattcgcttcgctgcccatctctcctcgtccaaagactccaagctcctgtgcggcctgtgttctgctgccgccgccgccccgtcgtctgccgacacctttagcgctgggaaggatcacaggggatcggcgcgaggcgggggacctgcggtttttgtcgcccggatggcggcggagcgatgacactggcgtcgggagcggcgcggcgttgggatgcggacgatctgcgatgtgtgcgagagcgcaccggcggtgctcttctgtgcggccgacgaggcagcgctttgccggccctgcgacgagaaggtacacatgtgtaacaagcttgctagtcggcatgtgagagttggacttgcagaccctaataaacttgtccggtgtgatatatgtgaaaattcacccgctttcttctactgtgagatagacggcacctcactttgcctgagctgtgatatgactgttcatgttggtggcaagcgaacccatggaagatacctgctcctaaggcaaagggttgaatttccaggagataaaccgggccatatggatgacgtgcctatggaaatccaagatcctgaaaaccagagagaccagaaaaagccacccaaggagcaaacggcaaaccaccataacggcgatgatccggccactgatggcaactgtgatgaccagggtaacattgattcaaaaatgatcgatcttaatatgcgcccggttcgtactcatgggcaagaatcaaattcccagactcagggggtaggtcttagtgtgaacaaccatgactctccaggggtggtgccaacaagcaattccgaaagagacaccagcaagtaaacgttggaagatcggaatgtacatttcaactacatatactgttctatacgagttcattttgtcgtgtgtgtgtgtgtggggtggggggggggggggcagagatgggtttattcagtggtttctctatcactaatttttactcaattctaaattataagtcattctaacttttttgaagaggtaaagtatctcaagtttgactaaaattgtagaggtaatcacaaagatttatgacatcaactaggtatatttttaaaatataattaattaaaaaactaataatacttatttggtatcatgaatgtgattgttttattatataaatttgatcaaacttgagatgctttgtctctcttaagaaaattagaatgtactagtaagtatatttttggcagagttgtagctaacagccgcatctcaattggcttgtcatgacctagattggcaaaaccgccaaattactttcacatgaacttgttattgtcttacagacttttgaccattatacatatgattcaggaattccggtnaaaaaaaaaaaaaaaaaaggaaaaaaaaaaaaaaaaagggggcc

SEQ ID NO: 965 - DNA, 1517 bp, Zea mays
  Clone ID: PAT_MRT4577_132613C.1
ccggccgggagtcgcttcgctgccacatctctcctcgtccaaagactccaagctcctgtgcggcctgtgttctgctgccgcctctggtccacatctccccgccgccgccccgtcgtctgccgacacctttagcgctgggaaggatcacaggggatcggcgcgaggcgggggacctgcggtttttgtcgcccggatggcggcggagcgatgacactggcgtcgggagcggcgcggcgttgggatgcggacgatctgcgatgtgtgcgagagcgcaccggcggtgctcttctgtgcggccgacgaggcagcgctttgccggccctgcgacgagaaggtacacatgtgtaacaagcttgctagtcggcatgtgagagttggacttgcagaccctaataaacttgtccggtgtgatatatgtgaaaattcacccgctttcttctactgtgagatagacggcacctcactttgcctgagctgtgatatgactgttcatgttggtggcaagcgaacccatggaagatacctgctcctaaggcaaagggttgaatttccaggagataaaccgggccatatggatgacgtgcctatggaaatccaagatcctgaaaaccagagagaccagaaaaagccacccaaggagcaaacggcaaaccaccataacggcgatgatccggccactgatggcaactgtgatgaccagggtaacattgattcaaaaatgatcgatcttaatatgcgcccggttcgtactcatgggcaagaatcaaattcccagactcagggggtaggtcttagtgtgaacaaccatgactctccaggggtggtgccaacaagcaattccgaaagagacaccagcaagtaaacgttggaagatcggaatatacatttcaactacatatactgttctatacgagttcattttgtggtgtgtgtgtgtgtgtcactaatttttactcaattctaaattataagtcattctaacttttttgaagaggtaaagtatctcaggtttgactaaaattgtagaggtaatcacagatttatgacatcaactaggtatattttaaaaatataattaattaaaacactaataatacttatttggtatcatgaatgtgattgttttattatataaatttgatcaaacttgagatgctttggctctcttaagaaaattagaatgtactagtaagtatatttttggcagagttgtagctaacagccgcatctcaattggcttgtcatgacctagattggcaaaaccgccaagttactttcacatgtacttgttattgtcttacagacttttgaccattatacatatgattcaggaattccggtaatctgtcgggtgtcccggtgatactaaatgatcccctttatttgttcccaagctggatgcccgtacgttgcaacgggaatatataatatcagtatactacgataacttatatacaaaatctatgttatattgttatgagaaaatgtttcataatcaatttgtgatcctagccatc

SEQ ID NO: 966 - DNA, 1728 bp, Zea mays
  UNSURE (1)..(1728): unsure at all n locations
  Clone ID: PAT_MRT4577_132614C.1
  unsure (1)..(1728): unsure at all n locations
attggagctaataactgcatctctgccagaaatcgcttactagtaataacagagagaccattgggacctcgaggccgggggacatccaaacatatacctcttccgccgtgtcgtcgcccttcgctagtcgcttcgctgccacatctctcctcgtccaaagactccaagctcctgtgcggcctgtgttctgctgccgcctctggtccacatctccccgccgccgccccgtcgtccgccgacacctttagcgctgggaaggatcacgggggatcggcgcgaggcgggggacctgcggtttttgtcgcccggatggcggcggagcgatgacactggcgtcgggagcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatattctgttctataggagctcctgggggcagaaatggggttattcagtggtctctctgttatcactagtaagcgtatttctggcagagttggagctaataactgcatctcaattcggcttgtcgtgccctagacggtattgctgtccaattgcattctctttgcgattgttagaactctgtatagaagcgcagcggctgccgcctgtgctctggagccggagtattgtgtgccattagaaactgtacaaaagattaatagaccgctcatttttctctggtcgcacaagttcaattcagttcnnnnnnggcggcgaattcgaggggtgactacttccagagtgaagcggttatcctatccatcatccctggtgctgcgctgcgttgcgttgcgtgcgtgctcgccgctatcgaacctttgctgttgtatcgtcgatgtaatgtatgatgctacttttgagcattatacatatgattcaggaattccggtaatctctcgggtgtcccggggatactaaatgatcccctttatttgttcatttgctcagaatcattacagatagcattgcattattacaatagttgatcagcctgttcgcttagtattaatatgtatcggtttttattgcttctacaatgttgtctctatagattgtagctgcagcagtccgaacatgttttaatctgaagttacatcagagagtaaagtgagtgtgggggt

SEQ ID NO: 967 - DNA, 1143 bp, Zea mays
  Clone ID: PAT_MRT4577_132616C.1
ttcggtcctgccccagcagccacaactacgacagcgccgtggacaagctggacaatacacagtggtacgttgtgtggaacaaggatatgaacacgaggatccttcccgaatacgtggtcagcttcaagtgctccaagctgcagctgacgcaagaattatcagaagcgacctcaaagctgaagaagccgtcacgagtggctcgcgacatgttcccgacgcttcttgcagagatcgagaagatcgtgccagacaagtgcgatctgttgcaggagtcatacagcagattcaagatgggtcggattaagaaagaccagttcatccgattcctccgcaattacgtcggagacaaagtgctgaccaccgtggccaagaaactacgaggatgctaaatttctagtgcgcgtgtctccttggtttcgccgtcttggtggtggcctacgtggtggctctgactacagcgattcaagcttgtctacgtgctagatgtctgcagtagtaccaaatagagatgaggagctttacttttgtttctgtttattcaagtttctgccaagggcgtatgcgtataaaggttttgcagcgatgcagatactttaataaacagaaaggataggtgcagtttctgatcatgagacgtttcagttcttctgtgtcctgcagcctgtggatataatctgtgcagactgaaatgatttgatgaaaccattgttgaaccgcccaatcgcttcaaagttttgccgttcagagtgagcttgtttgggcttgtcagggagaagaatattctctccctttcttgttttttctaagtttaacttctctatatctctgaatattgacaattctaatattcagtcagcataagaaaatctagtgaatctcaccaggcatgtactctcaggcaaggttcacagtttcgttttgggtcaaccgattttttgttttgttgaccaaaatttaacttttgtattttatattttgaattgaaatctatttgaaactggaccgaaattcgtttttcgcttagtagcgaaaacgaaaacacacaccagttttcggtgaaaaaaaaaaaaaaaaaaaaaagggcggcggccgacgagagtacatcgtcgacccagaaattaattcacggagcggcgccgcagg

SEQ ID NO: 968 - DNA, 309 bp, Zea mays
  Clone ID: PAT_MRT4577_13264C.1
tctgacgagaccaccacgggcgtcaagaggctccaccagacgcaggagaccggcgccctcctcttccctgccatcaacgtcaacgactccgtcaccaagagcaagtttgacaacccgcatggctgccgccactcgctccccgacggcccgacgagggccaccgacgtcacgatcgccggacaggtcgccgtggtgtgcggacacggtgatgtcggcaagggtcgtgctgctgccctcaagcaggctggcgcccgtgtcaccgtgaccgacaccgaccccatctgcggcctccaggctctgacggagggt

SEQ ID NO: 969 - DNA, 155 bp, Zea mays
  Clone ID: PAT_MRT4577_132703C.1
tcaacaatgccacagcaatagtttctggcatacgtggaactaattaccctggaaaccgtctccaattatgtccacaaaatccagtcctattcaccagatctaaacgagctttagggcctccacagcatccgttcctggcaaatccagttaaccac

SEQ ID NO: 970 - DNA, 584 bp, Zea mays
  Clone ID: PAT_MRT4577_132831C.1
aaaatcaacctcatcatattttattgtgtaaaattgtagaccttgcatagtatccatgcaatccattcatacatcgatgaaaaacaaggaacttgtctggtaaatccaaagctttgttgccgataatgcgactagaaggcagagccggaaaatgcgtctgcgtctggggttgctctgtatctagcccgggcagtttgatattgttctggtaaacatacagttccaaggctccatcatcccgaaaaatttttgctcgacaccctcgagagtgtagtggtcctacagactcttcgtcaacaagaacagcaataaccttctctttcccgtgtctaccatcaggaatctcaaacattgcttctgtcaaaatgtcctccattatagaccgcagtcctcgggctcctgtttcttttgcgagtgccttctttgctatcatcctcaaagcattatcagcgaaatgaagcttgaccttatggaggaaacatgaacataaataactttcttggttataaattatcgtttaaagtaaaaaaaaatcggccaaatgttgcaattatttcgttggccaaaacgaatcacaaactaac

SEQ ID NO: 971 - DNA, 3827 bp, Zea mays
  Clone ID: PAT_MRT4577_132874C.1
cccttttgctctccgccgcctggtgcttcgcccccctcgctctcgcacgactggtgggccgccggcgccggtgccgccctcccgcagttgggccttcgttggcctcttcgccggccttttcgccggtgacgagcagccactaggaaagcttctgttgctctgcatgcaacgatgaactgacgattgtagttgataacggaaatgtgctgttaggttttgtacacatgtgaccatgtgcagtcaaagatttctgcaacctgcatagcactgattattcttagagaactactgcagtgattactaatatattgtgctagcccctaggtaatctaacatttctgcaacgataccagcttctcttcttgtttacatggagtgcaacaaagatgaggctgctagagggaaagttcttgcggaaagaaaaatgctggacaaggactttgttgatgcaaaaaagttaattatcagggtgcagcaactcctccgaggagtggaagatattgacattccaaaaatggtaactgtctgtgataatcattgtgctatttaagcaaaagtaaatactgtgcctgttaggtatgtaatactgtaaatacctgtaaatactaagggaccattgaaattgaatcagtatgataaccttgcccttttgctatgcgctgacaagagcgtatcttgaggagcggagcaccggatccgacttctttcggcctggaactatcctcgcaaagacccataacagggatatagctatgatctgatcaaagccaagctcagcatcggtacgtcgagaggcaatccgtaacgtacaaaatgctctgccactgacatttggagtgctaaaccagtagaaagatacaatatgcaccaggcaaagccacgataaatttcagttaaaactggcccggaaactaggacttagacttttcgtccaactagttgcgtgtcttagcagtattaactgtcgatagtgaataaatctgtgctctggcagagcaggtttattccagacattgaagatgaatggatgcaccaagctattccttccggtgcaattcatcgatctgataggttatggaagtggcaaggttcaacacaaaactgagcaggacctcaaataaatgtcagaggactgtctcgactgactgcatctgcaataaactatatcaaccacaaatctggtcccttcatggtaagaagaaactgtaactgagatggtatcgcaggtggactgaaaaacaaaatgaaatctgcccaggccaccaggaaaccttcaaaagcttcatcaactgctggattgaaaaggggcaggagggcggtgtttgaatctagtgaatctagcatatcagaaactgacagcgacggtgaggtagagattccaaaacatggtcctgctgaaaatagtgcagggccaggtcaacaaactcgcagatctagcaggcagaagcaagaagttaagtataatgaggatagtgatgatgataatgatgatgtggaagatgatgataacacggttgaggatgattttgttgattctcctgcgttgaaaaggctgagaaaaggtggcatgttccatggtgatcacagtactaaaacagcaaagctgaatgaagacaccgctggccataatagtgtgaatagctggggtaacataaaagataaaaagaacggtggtatgccatgtgaagagaaaacttccaatggggttgagcagatgaagagagaaacaatgcatgttggagaaaatagtgatggcaaagaagagctatttcattctgtcagcaacaatggccttggtctaaacgatgatgatgcttcagatgataacaaattcactttcccagatcctgaattttttgattttgacaaacttcgagatgcaagtcaatttagagccaaccaggtctgggctgtctatgatgatcaaggttgtatgcctagattttatgctcgaatcacaagggtaaaaatggttccaaagtttatgctacaatttgtttggttggagttcaatcctgcaaataaagcggaggaggcatggtcttacaggggtctgcctgttgcatgtggacactttacgcatggactgtcagagacaactagtgaaactggtatgttctcccggattatatcattagagagaagcaagacaaagaacttctatgaaatatatccaaggaaaggtgaagtttgggccctttttaagggatgggatattggttggagctcagatgctggcattcacaaaaaaatgaaccatcgctatgaagttgttcaagttctttctgatctcaccacgagcactagcattattgtcatgccacttgtgaagttaaaaggctatgttagcttatttgtgcagtctggagaggcagctccatatgtgatacctcaggttgacacactaaggttttctcattgtgtcccacattatttgacgagcggaactgaaaaagaaggcattccagaaggatctcttgaacttgatcctgcagcgcttccctccaacttggaagaggcttttccttctgctaacccagaatgcagttcagcaagaagccaggagtctgactccaaaaatgctggtttgtccagtggaaatcgcaaaggatccatgaatgtggggcaggggcaacataaaatagccgcgaatggaagggtttgtacaaagacaacaaaggtagagaatatcaagcataacattgatctgtctgaagtcggcgatgtcgatgacgatagcatttgccaaacagagtatgtatgcgctgaatcagaattctatgatttttcaagaataagatttctccaaaagttttcatctgggcaaatctgggctctctatagtgatatagataaattccccaattactatgcatttatacagaaagtagatctcaagaatgataaagtacaagttagatggcttgatgtctgtcctcaaggagaagtggagaaaagattgtcccaagatcggaccattggcattggaacctttagggttggctacatccacgacatgatgacttacactggtacagatgccttttctcatcttgttgaggccagacctactggcagaaaaggtgaatatgaaatacttcctcgtctcggtgagatatgggcagtttacaaaaattggagcgctggatggactgcgcaggattttgaaaaatgtgaatacgaactggtggagatatttggctatactgattcctccatacaagttcagcttgtgaggaaggtggatggttataagatggtatttatgtcatatagagcagggggtgtgaagacaatacggagggatgagtacccgaagttctctcaccagattccatgctttcacttgacacatgaaaaaggtggcaagcttcgaggctatttggagctcgatcccctatcactaccagaggaatttctctgctgattcgatctgagataaaccttatctacatcaaatctggagcctccggtaatgaagtttctggaacatccacaatttcgtagcactgacgttgttacggtggactcgatctgcacaactaaggcattggcttttggacttttttgctggatggctgtcctgcagctgcaattcacatgtctagtatttttttttttgcagtaactatttgttgttagcattagctgtatctacggtttgagttctagtgtaaaaattgctacttttaacatcttgcagtgtactctaaattgcagtactgtgtttgaactgtgaggtgctagcctgattaatttcctggaactgaaaaatgaaatcgagccagcaaggttaggctcatcgatcattatatgtatttttaatt

SEQ ID NO: 972 - DNA, 625 bp, Zea mays
  UNSURE (1)..(625): unsure at all n locations
  Clone ID: PAT_MRT4577_132927C.1
  unsure (1)..(625): unsure at all n locations
atttccggaagggggcaaggagcagaccaaggaagatgagcaagactgccctcctcaccccctacaagatgggaaggtttgatctttcccacagggtagttcttgcaccactgacaagggagcggtccttcggaaatgttcctcagcctcatgccatactgtattatcaacagagaacaaccaaaggaggccttttgattgctgaggccactggagtttcagacactgctcaagggtacaaagacactcctggcatttggacaaaggagcaagtagaagcatggaaaccgatcgtgaatggggttcacgcaaaaggaggaatatttttctgtcagatttggcatgtaggaagagtctccaatcacacttttcagcctaacgggcaggctccaatttcgagcactgataagccactcaaacctgtagttagagccgatggcatagatgtgcctacaatttcaactcctaggcggctacagactaatgagattcctttggtaatcaacgattttagggctgctgctagaaatgcaattgaagccggatttgatggtgttgaaatccatggagctcatggttatttgattgatcagntcttaaaggaccaagtcaatgatcgcactga

SEQ ID NO: 973 - DNA, 326 bp, Zea mays
  Clone ID: PAT_MRT4577_132953C.1
acagaacacaataattacttaatttaacattacccaaactggcattttgacaatgtttgccggtggtgaccacaatggaaacagggttttaggtacaagcgggcccctttgctggctggcaagggtgaccacacccaaacacaccagaccagaggcggaaccacccggcaggggcgccaacggggagcgctttccgtgtttgcaccgcaaaagtaaaaattaaacatcacgatggggagggaaactgaataattttggtacatggatataaggttcttttttgggaacgccacggggccttgtttagccgctccattgggggatga

SEQ ID NO: 974 - DNA, 1722 bp, Zea mays
  Clone ID: PAT_MRT4577_132954C.1
gagcacaacgcacacgtccggccatcttcttcttgcacaagtcgagggccaccgctccgcatccgcatcttcttccagagcaagtcgagcgcggcggccacaaaacccagtcccatacgcacccgtccgttccgcgcgatcagccgagcgatgtcgtcgtcggcgcccgcaccggccgccatggccgtggacgacgcggaggacgaccagctcgcctccatgtccacggaggagatcaccagggcctcccgtctcctcgacaacgagatccgcgtccacaaggacgagctgcagcggtcgaacctggagctggagtctatcaaggagaagaccaaggagaaccaggagaagattaagctcaacaagcagctgccgtacctcgtcggcaacatcgtcgagattttggaaatgaaccctgaggatgaggctgaagaagatggtgctaacatcgatctggactcacaaaggaaaggaaaatgtgttgttctgaagacatccaccagacaaaccatattccttcctgtaattgggttagttgaccccgataagctaaagcctggcgatttagttggagttaacaaagacagctacttgatactagatacattgccttcagagtatgactcacgggttaaggcaatggaagtagatgagaaacctactgaggattacaatgacattggcggacttgagaaacagattcaagagcttgtggaagcaatagtgttaccaatgacacacaaggaccgatttcaaaaattgggcattcgtccccccaaaggggttcttttgtatggaccccctgggactgggaaaacgctcatggctcgtgcatgcgctgcacagacaaatgcaacatttctgaaattggctggtccacaacttgtccagatgttcattggtgatggagctaagcttgttagagatgcttttcagcttgctaaggagaaagccccgtgcatcatctttattgatgaaattgatgccattggaacaaagcgttttgacagtgaagttagtggtgatagagaagtgcaaaggacaatgttggaattgctgaaccagcttgatggatttagcagcgatgagaggataaaggtgatagctgcaacaaatcgtgctgatattcttgatcctgctctgatgagatctggtcgtctggaccggaagattgagttccctcatccatcagaggaagcaagagctagaatcctgcagatccactcgaggaaaatgaatgtgaatccagatgtcaactttgaagagttggcgcgttcaaccgatgatttcaatggcgctcagctaaaggctgtttgcgtagaggctggcatgctcgctctacgccgagatgctacagaggttacccacgaggatttcaacgaggggatcatccaagtgcaggcaaagaagaagtccagcttgaattactacgcgtaagggcttgttcggttataccccaatccatagggattgagggggtttcaatccccaataagtcaaaatcccctccaatccgtatcaatccccttcaatccatatggattggaaataaccgaacaagccctaaggggggaacgccccgtacttggtgatcattcagttgtttgtgacactgccattgtctgggcaggctaacttactatttgtactataagcaagctgttgcttttgagtcttactccgtatgagagtatcatttatgaaatattaaccaagtctgcc

SEQ ID NO: 975 - DNA, 1750 bp, Zea mays
  Clone ID: PAT_MRT4577_132956C.1
gagcacaacgcacacgtccggccatcttcttcttgcacaagtcgagggccaccgctccgcatccgcatcttcttccagagcaagtcgagcgcggcggccactgaaccccgtcccacacgcacccgtccgttccgcgcgatcagccgagcgatgtcgtcgtcggcgcccgcaccggccgccatggccgtggacgacgcggaggacgaccagctcgcctccatgtccacggaggagatcatcagggcctcccgtctcctcgacaacgagatccgcgtccacaaggatgagctgcagcggtcgaacctggagctggagtctatcaaggagaagaccaaggagaaccaggagaagattaagctcaacaagcagctgccgtacctcgtcggcaacatcgtcgagattttggaaatgaaccctgaggatgaggctgaagaggatggtgctaacatcgatctggactcacaaaggaaaggaaaatgtgttgttctgaagacatccaccagacaaaccatattccttcctgtaattgggttagttgaccccgataagctgaagcctggcgatttagttggagttaacaaagacagctacttgatactagatacattgccttcagagtatgactcacgggttaaggcaatggaagtagatgagaaacctactgaggattacaatgacattggcggacttgagaaacagattcaagagcttgtggaagcaatagtgttaccaatgacacacaaggaccgatttcaaaaattgggcattcgtccccccaaaggggttcttttgtatggaccccctgggaccgggaaaacactcatggctcgtgcatgcgctgcacagactaatgcaccatttctgaaattggctggtccacaacttgtccagatgttcattggtgatggagctaagcttgttagagatgcttttcagcttgctaaggagaaagccccgtgcatcatctttattgatgaaattgatgccattggaacaaagcgttttgacagtgaagttagtggcgatagagaagtgcaaaggacaatgttggaattgctgaatcagcttgatggatttagcagcgatgagaggataaaggtgatagctgcaacaaatcgtgctgatattcttgatcctgctctgatgagatctggtcgtctggaccgtaagattgagttccctcatccatcagaggaagcaagagctagaatcctgcagatccactcgaggaaaatgaatgtgaatccagatgtcaactttgaagagttggcgcgttcaaccgatgatttcaatggcgctcagctaaaggctgtttgcgtagaggctggcatgctcgctctacgccgagatgctacagaggttacccacgaggatttcaacgaggggatcatccaagtgcaggcaaagaagaagtccagcttgaattactacgcgtaagggggggaacgcccggtacttggtgatcattcagttgtttgtgacactgccattgtctgggcaggctaacttactatttgtactataagcaagctgttgcttttgtgtcttactccgtatgagagtatcatttatgaaatattaaccaagtctgcctgccgtattgctttctttctcctcacggagaggagctcggccttccacgactgcacatttgctctgttttcagaagttcgtgtgtttaatgataaaaaatcaggtgggaaagctttcccatttgactaaaaaaaaaaaaaaaaaaaaaaaccaaccc

SEQ ID NO: 976 - DNA, 343 bp, Zea mays
  Clone ID: PAT_MRT4577_133024C.1
cggacgcgtgggcatctagcagcatagtagggacaatactgtgccaacaatggcagccaaaatatttagcctccttatgctccttggactttctgcaagtgctgctacggtgaccatttgcccacaatgctcacaagctcctatagcttccccttcttcccccatacctgtaaccatcggtgtgttaagaatgagaaatcccaatttttcagccctataggatccaacaggcattcgcagctggcatattacctttatcaccctctgctcctccaacactcattagcaccattacagtaggtacctttggtggatttattggcacagaacatcagggcacaac

SEQ ID NO: 977 - DNA, 794 bp, Zea mays
  Clone ID: PAT_MRT4577_133069C.1
ccgggttatggagaggcagaaaggatgctaaaggaggtcactgtatggtagcctgggaaaaggtttgtaggcctctacatatgggaggcctcgggatttctaacctgactaagctttgttgggctctcagaatgaggtggttgtggctgcaaaaaactgattcttcgaggccatgggtggacctacccattcaggtcccaagtattgccaggtccttcttctctgcagtattgatgtcagaggttggcaatggtgcgaatactcttttttgggtggataaatggattaatgggaaaaaggtagctgatatagcaccaagattgttctgcaccatatcaaaaagaattgccaataaaagaacagttcaagaggcaatggacaataggagatggagaggtgatattaggggcgctctctcagcaggggccttgattgattttctgcatctctgggaagctttaacggattttcagctgcatcctgatattgaagacagacacatttttaccatagcgccagatggtaactactcagcaaaagttgctcatgaagggctcttccagggatcgtgctcctttcttcaccacaaaagaatctggaaatcctggatgccacccaagtgccatttcttcctgtggctggtggcacatgataaatgctggactgctgataggctgcagaaaagaggcatgaaccatccggctaggtgccctctttgtgatcaagaacctgaaagcattaatcacctgctgggttcctgtgtgttctcaagagttttctggtataggcttttg

SEQ ID NO: 978 - DNA, 1471 bp, Zea mays
  Clone ID: PAT_MRT4577_133091C.1
ccccccgcccacgcgtccgctcgtacgccgtcgcttcctgcggtacgtactctctgtccgcagcgttcctccagctagtagcagtagcagctagctagctagctagcaactggccatcggggctgctagcagcgtacgtacgtggcgcgatggctcctccagctcatgataggctccgccgcctggtgctgctcctcgtcgttgccaccgccgcggcggctttgcttctggcgccgacgacggcggatgctgcgctgccgcgggtgcagcacacgcccaccaaggccgacgggtcgctcgccatcctcgtcgtcggcgactggggccgccgtggacagttcaaccagaccttggttgcccagcagatgggcgtggtggggcagaagctggacatcgacttcgtcatctccaccggcgacaacatctacgacgacggcatcgccaacactagcgaccccctcttcaaggaatcgttctccaatatctacactgccaacagccttcagaagccttggtacctggtccttggtaaccatgactacacgggaaacgcgctcgcgcagctcgaccctgccattcgcaaagtggatagccggtacaccgccattgccaagtccttcattgtcaactcaggggttgcggattttttcctcgtcgacacaacgccgttcattgtccactactggaacaacaccaagttcgattggagaggcgtcgctcctcgagacacctacatcgcgaatctcctcaaggacttgaagtgtgcactgacagcgtccaaggctccctggaagatcgtcgtgggtcaccaccccatcagcagcgcctgcgggcatgggaacaacactgagctggaggagttgcttctcccggtcctcaggacacacggggttgacatgtacttgaatggccatgaccactgcctgcagcgcgtcagcagcagagacagtcgtcttcagctactaaccagcggcggcgggtccaaggcatgggctggcaagttcaagcccaccctcgacaaggtggagttcctctacgacggccaggggttcatgtcgatgcgcctgagcaggacggaggcccgcctcgcgttcttcgacgtcgctggcagcgtcctgcactgctggaccatgcatgcccaaaaattaaagacgacgacgacgacgactgctgctgctgctgcagccgggcactaaagctttgctggatcggagttattaatgttcgttgctgcctcgcggcggtacgatgagttgatgatgcaattaattatttggttttgtcgtcttttcgtgcgtgagagggaagcaataataattatttgctgctgcttccgttgtgtgcacatgcatgtgagggtgtcaagtatgttcagcctcttgcaagataaaatctctcgtcttctatggaataaactgggaaaagagttttttttggttaaaaaaaaaaaaaagaaaagagagtgagagtg

SEQ ID NO: 979 - DNA, 1707 bp, Zea mays
  Clone ID: PAT_MRT4577_133158C.1
ccggccggggtggatcggaaaccagctgacgctgagtcgtctttctcggcagcaggacccgccgccgcctcctctccatctctttctctctctctcgccatatcgattccattggggacgcaagcaccgccccagacccagagcttctcttctcaaaagatgcaggagcaggacgtggacgatggcggcggcaggacgacccagcagcaggagaagtcgatcgacgactggctccctatcaactcctccaggaaggccaagtggtggtactccgccttccacaatgtcaccgccatggtcggcgccggcgtgctcggcctcccctacgccatgtccgagcttggctggggccctggcatcgcggtgatgatcctgtcgtggataatcaccctatacacgctatggcagatggtggagatgcacgagatggtgcctgggaagcggttcgaccggtaccacgagctcgggcagcacgtcttcggcgacaggctgggcctctggatcgtggtgccgcagcagctggcagtagaggtgagcctgaacatcatctacatggtcaccggcggccagtccctcaagaagttccacgacgtcatctgcgacggcggcaggtgcggcggcgacttgaagctctcctacttcatcatgatcttcgcctccgtccacctggtcctctcccagctccccaacttcaactccatctccgccgtgtcgctcgccgccgccgtcatgtcgctcagttactccaccattgcgtggggcgcgtcgctgcacagagggaggagagaggacgtggactaccacctgcgcgccacgaccaccccagggaaggtgttcggcttcctgggaggcctaggggacgtggcgttcgcctactcggggcacaacgtggtgctggagatccaggccaccatcccgtccacgccggacaagccgtccaagaaggccatgtggaagggcgcctttgtcgcctacgtcgtcgtcgccatctgctacttccccgtcacgttcgtcgggtactgggccttcggcagcggcgtcgacgagaacatcctcatcacgctctccaagcccaagtggctcattgccctcgccaacatgatggtcgtcgtccatgtcattggcagttaccaggtttatgccatgccggtgtttgacatgatagagacggtgctggtcaagaaaatgaggttcgctccgagcctcacgctccgtcttattgcccggagcgtctatgttgcgttcacaatgtttctaggcatcactttccccttcttcggtggattgctcagtttcttcggcggattagccttcgcaccgacaacttattttcttccctgcatcatgtggctcaaggtttacaagcccaaacggttcggcctttcatggttcatcaactggatctgcatcgttattggagtgctgctgttgattctgggtccgataggagggctccggcagatcattttgtcagccaccacatacaaattctaccagtaaaatcgatcaactggagtcgtatggcgtggctgttttgttagcattacatttcttagggtggattggcttttaatgtacacgagcgagtgagattgatgctagtagctcctaggagtatatatatttctatcatccacagagcttaatgtatcttgtagttgggacattaaaagagcaagtaggctttactcggtgatctttcgttag

SEQ ID NO: 980 - DNA, 780 bp, Zea mays
  Clone ID: PAT_MRT4577_133328C.1
atcaactctcatttcgcattcgtccaaactcgtgagcactttctcctcgtccccgacaagccactcgaagccgagatacggccatggactccaccggcaccggagcagcggggaagggaaagaagggagcggccgggcgcaaggtcggcgggccaaggaagaagtcggtgtcgaggtccgtgaaggctgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagctcgggaagctgctgggcggcgtgaccatcgctcacggaggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgcaagttgtcctttgctatttagaatggaagaagaaatgccttgtttctctgaggttgcaatgtcttttccctaatttcatttatgcactgctgtgatttctgatatct

SEQ ID NO: 981 - DNA, 902 bp, Zea mays
  Clone ID: PAT_MRT4577_133332C.1
ggccgggccgggcaaaaaaaaaaaaaaaaaaaaaaaaaaaaaaaaaaaaaaaaaaaaaaaaaaaaaaaaaaaacctcacaattccgcattcgatccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgctggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtgtggggagcaaggaggcaaagtcgcccaagaaggccgccaagtcccccaagaaggcatagactgactgtctggagtgatctgatgtttagcagtaccttgttaccagtatgcggtgatgcgtaggctgtagatgggtcgaatgtgcttgtgtgtgtatgtgtcctgctgcaagttgccctttgctatttaaaatggaagaagaaatgccttgtttctctgaggttgcaatgtcttttccctgatttcatttctgcacagctgtgatttgtgatattcaacctgggcgacactgtttactgagattttcgattagaatttgctgtgcccg

SEQ ID NO: 982 - DNA, 1009 bp, Zea mays
  UNSURE (1)..(1009): unsure at all n locations
  Clone ID: PAT_MRT4577_133333C.1
  unsure (1)..(1009): unsure at all n locations
cattgggtacctcgagccggcgggatgttttcgcttggttattattttctctttgtttccagactagtttggtcgactgttgtcacgttagtttgtatcctgctgcagaataacttgcttgtaattgtatactgattagttggtatatagtgatatattatatatactaaatgcattaatgcaggttatgattttgctaaaaaaaaaaaaaaattatcaactcgcaattccgcattcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgctggtaatgctgccagggacaacaagaagactcgcattattccgcgccacgtgcttctggcgatccggaacgacgaggagcttgggaagctgctgggcggcgtgaccatcgctcacggcggtgtgctccccaatatcaaccctgttctgctgcccaagaagacggcggagaaggcgtccagtgtggggagcaaggaggcaaagtcgcccaagaaggccgccaagtcccccaagaaggcatagactgactgtctggagtgatctgatgtttagcaggaccttgataccagtatgcggtgatgcgtaggctgtagatgggtcgaatgtgcttgtgtgtgtatgtgccctgctgcaagttgccctttgctatttaaaatggaagaagaaatgccttgtttctctgaaaaaaaaaaaaaaaaaaaaaaaaaaaaaaaaaaaaaaaaagggcggccgccaccgcggtggagtnccag

SEQ ID NO: 983 - DNA, 978 bp, Zea mays
  Clone ID: PAT_MRT4577_133334C.1
cccacgcgtccggcgccccagggcccgtgccattggctcagcccgcccggccgacgcgccgcggcgggccgcctcgaagctcccttcccacgggcggcgtgctgaatcctttgcagacgacttaaaacgcgacggggcattgtaagtggcagagtggccttgctgccacgatccactgagatccagccccgcgtcgcacggattcgtaccgagacgattacccgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgcaagttgtcctttgctatttagaatggaagaagaaatgccttgtttctctgaggttgcaatgtcttttccctaatttcatttatgcactgctgtgatttctgat

SEQ ID NO: 984 - DNA, 346 bp, Zea mays
  Clone ID: PAT_MRT4577_133459C.1
cctccccctccggttcgggttcggggtggtgaggttctactgcgttcgggttcgtgggtgagcggatcgagatggcggggtctgatggggagtaccgatggttcagaggaggcctcgcctggggcacggacgaccactctgttcacaacgccttaaggaactaccgcgaggtcctcgagtccaagatcattctacattcgggagacgcacaggtcccgcggcttaggcttaggcaccttatgcacggaggaggcgatgcggaacgccatcgagggcatgaacggcaaggagctggacggtcgcaacatcaccgtcaacgagggccagtcccgcggaggacgtggag

SEQ ID NO: 985 - DNA, 290 bp, Zea mays
  UNSURE (1)..(290): unsure at all n locations
  Clone ID: PAT_MRT4577_133550C.1
  unsure (1)..(290): unsure at all n locations
ggcaagatngaaactgagctcaccaagatctgtgatggcatccctaagcttctcgaatgtgaagttgtgccgtcttccaccggtcccgagtccaaaggcctttattttaagaagaaaggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcaggtgtctactatga

SEQ ID NO: 986 - DNA, 323 bp, Zea mays
  Clone ID: PAT_MRT4577_133579C.1
cagtagaacacgaccagaagttcaccacaaatgcttatatctagaatagcagcaccaagagggggtcttttataaaaacatgggtgcgatcaccacgattgtggggctgaacatgaataggttatagttgttgtagtataatgagcgagatggaatcagagtaacatagaggcactgtcatcatgttaggcattatcattgaagacaccatgctcggcatcatcatcggtggtatcatacttggcatcataatcggtgagataatactcggcgtcattagcgaaagcatcatactcggtaatatcattggtgaaaccatgttt

SEQ ID NO: 987 - DNA, 329 bp, Zea mays
  Clone ID: PAT_MRT4577_133649C.1
caaaggaagaacagagttttgaaccatggagcagttgggaagaccaacatgactggggaaaaaaaggacatgggatttgctcttttgtgaacactgctactaggaatgttcacctatcatggctttggaataatactggggatcaccacatccaccatcaaaaggcactccggttgccaatgaggaggcagcctgagacagcccctgagactgaggttgcctaccaatcggaaccctgaaaggggagcaagaaacgtaatccaacccatccttggggaagaaggccccaaaagaaggctcctctccgtgttattcacaaatgcccacct

SEQ ID NO: 988 - DNA, 1633 bp, Zea mays
  UNSURE (1)..(1633): unsure at all n locations
  Clone ID: PAT_MRT4577_133839C.1
  unsure (1)..(1633): unsure at all n locations
cctcgaggccggccgggggtgataacttgggagatgctgagctcccctcttcctccctctttccgactttccctccctactcgcccccgcgccgcgccaatctttttccctcttgacggcgcacataaatccgcgccaaatcgtcaaaccaaaaccaggccgcgcccgcctcgtcagtcctcagtcctcactttcgggccgagctccggatatccagcggcggcaatggcagccgaagccagcgccgtccagcagctcgctggcctcctggaccaagtggacgcgccgctgaagaagacatttgagaatgtgcatcagggctacccaacagagacattattgcgtttccttaaagctagagagtggcatgtgaataaggctcacaggatgcttgaagattctttgaattggaggatgcaaaatgaaatcgatagtatattggagaaacctattatcccagtagatttgtatagatcaattcgtgatacacagcttattgggttatcaggatactccaaagagggcattcctgtatttgcagttggtgttgggctgagtacatatgacaaagcttcggttaactactatgtgcaatctcacattcagatcaatgagtaccgagatcgttttattttgcctacagtgacaaagaagtatgggagacctattaccacctgtataaaggttctcgatatgactggtctgaaattgtcagcactacaccaaatgaagattgtgactgcaatatctacagttgatgatttgaattaccctgaaaagactgagacctattatatagtaaacgctccatacatattttctgcatgttggaaggtcgtgaagcctctgttgcaagagagaacaaggaagaaagttcatgtgttgcgtggctgcgggagagacgagcttctacagatcatggactactcctccctcccccatttctgcagacaggagggctcgggctcatccaaacattcgtcaggcgacgccgataactgcttctctctcgaccacccgttccaccaggagctctacagcttcatccaggagcaggcgctgaaccaggagctcatcaagcagggctccttgcacgtgaaaatccccgagcaggaccctgaggacgcaaagatcgtggaggtcatcgaggccgagttccacaagcttggcgtgcagaacgggtccgccaatggcatcgaccaagcatagcacctttgtctaataaggccagcctgattcaaccgagacgttgcttgccacttctgatgcaactaatcctactgtttattttttttggtggggtgggcccacccccgttgctgtttcctggggggaggggggtgattggtattggtggtatacatagcaaagtcatttgcagatccatccatgatgcaggactgagatagacgatatcacctgtgtaaacttgcagatttgcaatgtgtcctcatctcatatgtatgctgagttgagatgaaatgaataaatcatcctacaaaaaaaaaaaaaaaaaaaagggcggccatacgactagtgagctccctcctcttnttcntgtatgataggtaaggtatatgactcgtcgatgtcgntgtngcggacatgtggctggcagcgcgtnagtcgtgat

SEQ ID NO: 989 - DNA, 1036 bp, Zea mays
  Clone ID: PAT_MRT4577_133893C.1
cattgggaccctcgaggccggccgggggatcgccgcaactgcccgtctgctcctgcttttcatccagtcgcaaaacaaagagaagagatctccgcgtccgcaaccgcatcgcttccctcccggcacaagaagaagattcggttgggttgtttgtctcttgcaaactgcaatggctgctgctgccactgctattgctactccgtccgtggcgccggaggccggcgaccggaaggcggtggcaccgccggtcgacgcggtggatctggagctggagctggagctggaggagaagcacgtgctggcggtggacgacagctccgtggaccgcgcggtgatcgccaagatcctgcgcagctccaagtacagagtgacgaccgtggattcggcgacgcgcgcgctggagctgctggcgctggggctggtccccgacgtgaacatgatcatcacggactactggatgcccgggatgaccgggtacgagctgctgaagcacgtgaaggagtcgtcggcgctgcgggccatcccggtggtgatcatgtcgtcggagaacgtgcccacccgcatcagccggtgcctggaggagggcgccgaggacttcctcctcaagcccgtccgccccgccgacgtctcccgcctctgcagccggatccggtgaccgcccgcgcaaggatggaggatctggttgcgcgctctgacttaattagaggagttgttaggatccaattttttgtgtgttcgttcgttcgttcgttcttttctttctttcttcttggacatagatctgctgccgccgctgctgccgtcgactgaaacaagaagctaacttagttttagggtccaggttgttgttgttgttgttaggaaggcgagtcgttgggggcattcacggatgttcttcctcgtttcccctccctccgtgcctgaggctgcaaaaatatgccccccagacatgaaaaaaaaacaagacctgttaacagttccaagatcagagccttcgcttcttttctttaaaaaaaaaaaaaaaaaaaaagcggcc

SEQ ID NO: 990 - DNA, 259 bp, Zea mays
  Clone ID: PAT_MRT4577_133896C.1
ggtgcaccgagcgctgcctcgactggggcgaggcgggcgagcccgacctcatcgtcgacgacggcagcgacgcacgctgctcatacacgacggtgtcaaggccgctgtggattacgagcagaccggcaagatccccgacccggcgtccaccgacaacgctgcgttcaagatcgtgctcaccatagtccgcgacgggctaaacgctgaccccaagaagtaccgcaagctgaacgagaggcttgtcggcgtctctgaggag

SEQ ID NO: 991 - DNA, 2058 bp, Zea mays
  Clone ID: PAT_MRT4577_133990C.1
ctcgaggccggccgggagcccagcttgcctgccacctggtcttgaccctctcctggataggaggagcagcagccagagggacatcaaactgtgctgcctgcgtgtgtgtcttctttcttgcctctcccttcttcaacctttgctagcttgccagggagggagtccatgaattccagcagaagcctcctctcttcgcccctctttgctagctcgtctccaaacttcaggagcagtgcttccgtctcctcctccccatccccatcccgcaccacagcagttccaatgatacatgacaccagcagcagcagagcatccacggcgtgccactactcgccgtcgcttgtggcagaggagcagcttcacggctccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcatgtacggagcttctgaatttattagcagtgaagaggatgatgatgattctgtttcggagagctcttcagcatcattggccaaaccagctggaacattggatcttggcaagctgacagaggaaccacagttggatgtaccacagcctcaccgccgcagtgtggatccaaaccattcgtatgatcaagtgtttattagatccactcggttactggagaggagatccaagaaacgcaacggcggccacagggctttggataatggtgtggcgtgcagtggtgtgaactcaaagagaaaagacaagtttggcagagttcttgatccagacgagcctttttaggttgtttctacgggatcgagagacgacagagttcttgacagcgaaagaggagaaacagatgttcagtcaaatacagaatcttatgaagctggagggggctcagcgtaacctgcaagctcagtgtggtcgtgaaccaacagttgaagagtgggctcaagccgtaggaatgagctgcagggagctgcaatcctgtgtgcgcaccggaagacggtgccgagagaagatggcccgctccaacttccgccttgtgatacatgttgctaggaaatatgaaggatgtggccttgacattcaggacctggttcaggatggatgctgtgggttgatgaaaacctttgagaagttcaacccgagcaagggatgcagattcccgacctacgcgtactggtggatacgccagtcgatcaaaaagtccatcttcaagaattcaagactaatccggttgccgggagagtgtgtatgcacttttgaggaaggtgggcaaagcgaggatggaatgcataatggacggggagcagccgacgaacgaggtggtggcaaggcgtgctggcatcacgattgaaaagctggcgaaactgagagcgaaaaccaggaaagtacggtccatgcaggatcgagtctggtcagacgacggtgtgacataccaggagatcaccgaggaccccaacattgaaggtcctgaggtgagcgtggacaggctgatgatgcggcagcaggtgcgcagcttcctggcggggatcctgagcccccgggagaaggagatcatcgagcaccggttcggcatccacgacggccagcccaagaccctgcatgtcatcggcgacatgtacggcctgtccaaggagaggatccgccaggtgcagaacaaggccctggacaagctcagaaacagcatctcagcacagggcttccacgtctactttgatttgctaacttaagactcttcaacacgcaaacattacatgtacaatgacattccattctgccaatgggtatattatgtatagatagacgaagaattcatgtttttttcctttcccttttgccatttgacattcattcatccttgtactcaacaatggatactcatacatggttgtttgaggagcaaagcttactttaaatgtatggatgtacgtttaagtgcacatatgtttatgaaaccttctttgtttc

SEQ ID NO: 992 - DNA, 255 bp, Zea mays
  Clone ID: PAT_MRT4577_134019C.1
cccagcgttcgcctttccccttccctccctggctctccacacgggccgtcggaggcgatttcgccctcgattggaccccgattactccgaccgcgaccgggattccctgctccaagcgcggatctgaacgctgcgctccgtgtcgccgatcgaatgcgccatgaacgggggcaaatccaagggcgccgccaaggccgatgccaagctggcggggaagagcaagggggccgagaaccccaccaagggcacgaaaag

SEQ ID NO: 993 - DNA, 457 bp, Zea mays
  Clone ID: PAT_MRT4577_134122C.1
atatgtggtttttttatacatttttcggtgaaaagaaagctcagggcatcattcttctaggattagatttactagttcaagcaacaactgcaacgggagggcacaacgcctccaccactgcagtcctagagtagattacggggcacaagcagcaggaacaaaaacgacactcgggacagcttgacgtatttacattgacacagggggcaaagccaccagccactgagggcaggccggcctacaaacagcaggggggtaatacgcaaggacctgggcatgggggtcaacacaaggctaaaaaatctgccatcacccgataagcgccctcgggaaagggaggcgcgaacaaaatgtaccactacggcctggccatgagcatgaggttctggcccgtccaagaggctctggacccctgcacccatatgtacctcaacgagggcatgtggagcacggtcac

SEQ ID NO: 994 - DNA, 257 bp, Zea mays
  Clone ID: PAT_MRT4577_134246C.1
ctctcctcctctccttacacaaccgtccatcgacgctccctccggtctgcgctcccacagcctcacccctgcggtgccgatgattcgcgtcgccctttgttggaatgacgatggagcagaccttcatcatgatcaagcccgacggcgtccagcggggcctgatcggggacatcatcagtcgcttcgagaagaaagggttctacctcaaggggatgaagttcatgaacgtgcagaggtccttctcgcgaagaattagg

SEQ ID NO: 995 - DNA, 2056 bp, Zea mays
  Clone ID: PAT_MRT4577_134280C.1
tcaaccgggcgtgtaacttctcccaacgatagcaacatttggtggtccagtgctttagtagcaaagaatagcaacccaagatatgtgctagcctcaaagtgtgcacgcgagcctcctacaatgtgggtagagaatagattgagtacttcatggggttttaagtgctctaagctctctatcgttaggaatgcacttccttcgaaaacacctaaggcgtctgtctcttggaagtccaaggatgattcgaatgccataccaagacacctagagcaatctcactgtaaaaagacatctagagcaactcgaactcacttcaaggcgatgccgaatttgattcacaaggcaaagaatgttgatacctcaaatctaaacgatggtacctcgggttcaagttggaggggtcaggcggatgcatataagggagaggacataaatatcgggaaggaatgcactaaaacttcagagttgttgaaaagtagagaagcctcaagaaaatcaaacatcctagtggtagatcggaaggatcctaacaaagatgagccagacaaagtgaaaggaatccaagatgaagttatgaccaaagaagagggagtgaaaggccatacctgtgaaggtcgtgcgacgtgttggagttgtcttaagcaggcgaacaccacaaagacaaatgatgctccaaatttaggttcattgttggttggtaacgaacacatgcaaggcctcatgagtaatttgagagataattcatcccatttgtttgaaaagaatcattcaagacaccaaagggatgatccatgtgaatatagagaaacaaacttgaagtttcctaataggatccaatcagttggaggcaatgggaaaaccaatgatgtcacatctaggaggaaacgactcttgttagaagaaaaggctagcgcacacgtgcaaaatgatcttacttatggaccgatgaagaggcggaggtacatagaagccaacgaagatgaagaagagcaaaatgatcttacttatggaccgatgaagaggcggaggtacatagaagccaacgaagatgaagaagattatgtcggcgaccaccatccggtgcatattgaagatgctaccactgaattgacaccgcaggattctatttcaaagcattgcgttgagcgacaatgctattgttgctcaaagcctattgacatacctagatggagtggaacctttaagatagatggaaaggaacacatatcactggctggacatttgtcatccaaatcttgtgagaaagtgtggaaattgtcatcattgccgaaggtggttcaagtgacaaaggttcctagaatggcagtgtggcctaagatatttaaagcatcagaacccagtggtgacaatattggcctatatttcttccctcctgaaatgaggcacgatgaagaactagatcaactagttaatgaagtcatggataaagatttgatcttgcgagctattattggtgaagctgagatgctgatattcccgtctgttctactacctgaaagatatcagacattccaaaccaaacactacctatgggcggccttcaaagcaaaggaggataaaggtgatgcaattgtagaggaggaggttgagaagggaaattgcgtttcaaaccagccagacaaggtacagtctgataatgcttcatttccttcaaaccatggactggaccgtccaagcatggaagctccccctcaaagcagtagcagtgtctttggtattgttgtccgacaagctccaaatcttgaaccagaagtgaagcgatttatccaggagatggaacgcaaaggtgcgttggtaacggttatgaggggggaggcaattggtggagggccatagccaagcaacaccacgaccactatgcattagttgtagagagagtagagagtaaaccatgtcaaactatgctgtagttgtatagagagtctgacacataacgtcgtggacttgagctcttgttcagtttttttgtaaggtacctacaagtttggtcatatgataatttctccggaacggcataccttagcacctgttttct

SEQ ID NO: 996 - DNA, 484 bp, Zea mays
  Clone ID: PAT_MRT4577_134332C.1
ggttagctcgtttcatcgtccgatctgatctacagaaaaagcaggggcagggcagctagccatgattcagatgaacatgaagcagcctctcgtgctgcccgcgcaccggggcaatgtcatcggcttgcgcctggcgtcgtcgccctctgcagcggcggcggcggccagcaggcggaggggcgtcgtgtcctccccccgctcccggccccagcgccacatgcggctgccgaggatcagctgcagcgccaccgaggaggccagcggccgtgggtcgggccgtcaccgtgtagaagatgctgacggtgacggcctcggtgcaggcggcgccggccatcggtcagatgtacttccagcgcgccctcgacgacgccggcgacttcttcggcaagacgctgctgatggaactcgtcagttccgaggtcgacgcaaagacgggtctggagaagcgcgggtgaccggcgttcgctcacaagacgctggggga

SEQ ID NO: 997 - DNA, 2017 bp, Zea mays
  UNSURE (1)..(2017): unsure at all n locations
  Clone ID: PAT_MRT4577_134409C.1
  unsure (1)..(2017): unsure at all n locations
gtgcggcgctcgaggcggccccggccgggggactctccccccgtcgagcacacaacacaccctcctcgtcctccaatccaatcaacctggtagactcgcttcgcttctcccccagccgtcggacggagctcctcgcagtcgcagcagccgccgatcagcctgcgctcgggctcagcgctggaaggtgttggaagagaataacctgaaggttcacagtaaccttcatctgtcggaagatgtatcgggctaagagggctgcattgtcaccgaaggtgaagcgccgcgtcggcaagtacgagctcggacgcaccattggggaagggaccttcgccaaggtccggtttgctaagaacactgaaaacggggaacctgttgctatcaaaatccttgacaaggagaaggttaagaggcacagattggttgagcagattaagcgtgaaatttgtatcatgaaattagtaaggcaccctaatgttgttcgactgtttgaggtgatgggaagtaaagcaagaattttcatcgttctggaatatgttaccggcggagagctttttgaaatcattgctactaatggaaggttgaaggaagacgaagcacgtaaatacttccagcaactgattaatgctgttgattactgccacagtaggggagtgtatcacagagacttgaagctcgagaatttgctgcttgatgctgcaggaaatctcaaagtttctgactttggtttaagtgctttaaccgagcaagtgaaggctgatggtctgcttcatacaacatgtggaacccccaattatgttgcccctgaggtgatcgaggatggaggctatgatggtgcaactgcagatatttggtcttgcggagtaatcctctttgttcttcttgctggatatttacctttcgaggatgacaacatcatcgccctatacaagaagatttcagaagctcagtttagctgcccctcttggttttcagctggggccaagaacatgattaccagaattcttgatcccaatcctacaactagaatcacgatttctcagatactggagcatccttggttcaaaaaggggtacaagcctcctgtttttgacgagaaatatcaaactagcttggatgacgtggatgctgcttttggagattcagaagaccggcatgtgaaagaggaaactgaagatcagccaacctcaatgaatgcattcgaactgatttctctaaaccaggcactgaatctggagaatttgtttgaagcaaaggaggagtataaaagagagacaagattcacctcacagtgccccccgaaagagataatcacaaagatcgaagaagctgcaaagccgcttggctttgatgttcagaagaaaaaatacaagatgcggatggagaacccgaaagcaggtagaaagggcaatctgaatgttgcaactgaggtcttccaaatagccccatccctgcatgtagtcgagctcaagaaggcgaagggggacactctggagttccaaaagttctacagaagcctgtcgacccagctgaaggatgttgtgtggaagtgcgacggcgaggtggacggcaacagcgcggcagcatgaaagcgccctttgaactttccactggacggcgccggttttcctttgtacatagcttctctttcggatgatcccgtgtccattgcagagtcggttttgcaagcaagttctttggtttatttgttgacggcgagtaagcccggtgaaacaaccgccctggaggctgttgtggatgagcttactggcgtgtttagttcgtttcatggtcgggaggttggatggaatgggaaccacaatcaaggctgtagtagtgtgtgtagtaacgaggtatcgaggtagatacatcagatggtgtaagggagtaccagctgttagttcatggcttcaagcttagccccccttcaatttgttcgatgatgtattacttcccaataaacattattacttagatgtaagagaaaaaaaaacttgtctttcacctctanaggatccct

SEQ ID NO: 998 - DNA, 2463 bp, Zea mays
  Clone ID: PAT_MRT4577_134410C.1
ggtaccctccgaggttcgcccggggtcgagcacacaacacaccctcctcgtcctccaatccaatcaacctggtagactcgcttcgcttctcccccagccgtcggacggagctcctcgcagtcgcagcagccgccgatcaacctgcgctcgggctcagcgctggaaggtgttggaagagaatagcctgaaggttcacagtaaccttcatctgtcggaagatgtatcgggctaagagggctgcattgtcaccgaaggtgaagcgccgcgtcggcaagtacgagctcgggcgcaccattggggaagggaccttcgccaaggtccggtttgctaagaacactgaaaacggggaacctgttgctatcaaaatccttgacaaggagaaggttaagaggcacagattggttgagcagattaagcgtgaaatttgtatcatgaaattagtaaggcaccctaatgttgttcgactgtttgaggtgatgggaagtaaagcaagaattttcatcgttctggaatatgttaccggcggagagcttttcgaaatcattgctactaatggaaggttgaaggaagacgaagcacgtaaatacttccagcaactgattaatgctgttgattactgccacagtaggggagtgtatcacagagacttgaagctcgagaatttgctgcttgatgctgcaggaaatctcaaagtttctgactttggtttaagtgctttaaccgagcaagtgaaggctgatggtctgcttcatacaacatgtggaacccccaattatgttgcccctgaggtgatcgaggatggaggctatgatggtgcaactgcagatatctggtcttgcggagtaatcctctttgttcttcttgctggatatttacctttcgaggatgacaacatcatcgccctatacaagaagatttcagaagctcagtttagctgcccctcttggttttcagctggggccaagaacatgattaccagaattcttgatcccaatcctacaactagaatcacgatttctcagatactggagcatccttggttcaaaaaggggtacaagcctcctgtttttgacgagaaatatcaaactagcttggatgacgtggatgctgcttttggagattcagaagaccggcatgtgaaagaggaaactgaagatcagccaacctcaatgaatgcattcgaactgatttcactaaaccaggcactgaatctggagaatttgtttgaagcaaaggaggagtataaaagagagacaagattcacctcacagtgccccccgaaagagataatcacaaagatcgaagaagctgcaaagccgcttggctttgatgttcagaagaaaaaatacaagatgcggatggagaacccgaaagcaggtagaaagggcaatctgaatgttgcaactgaggttttccaaatagccccatccctgcatgtagtcgagctcaagaaggcgaagggggacactctggagttccaaaagttctacagaagcctgtcgacccagctgaaggatgttgtgtggaagtgcgacggcgaggtggacggcaacagcgcggcagcatgaaagtgccctttgaactttccactggacggcgccggttttcctttgtacatagcttctctttcggatgatcccgtgtccattgcagagtcggttttgcaagcaagttctttggtttatttgtagtaagcccggtgaaacaaccgccctggaggctgttgtggatgagcttactggcgtgtttagttcgtttcatggtcgggaggttggatggaatggaaaccacaatcaaggctgtagtagtgtgtgtagtaacgaagtagatacatgcatcagatggtgtaagggagtaccagctgttagttcatggtttcaagcttagccccccttcaatttgttcgatgatgtattacttcacaataaacattattacttagatgtatgaggtgagcacacttggtcttttgtcctctttgtgctattttgcgtgataattgaattttagcaggggcggattcaggtagccaatcatgtcctcgttcctaacagtcgttagctggaccatgtgatttcctttcgtcaaaaatcgaaaattcgagaccgtcacttacatctttcgatcaaagacagcgtggagaatgaattctcttccttggaggcgcccgtgtcagcttgggagcataggaagatgtaacttcaattaagcaacgatactatgcctgcatatttgcatggcatcgagatatatccacatggtggtcttccagttcaagtcagactaccaactcagtatgttcgttctcctggtgccctgagctgtttccagctgcagtctcaactttgagcaaattgaacacttcagtgtggatgactgtttccgctggcttcagtttgcacactacagtatatgccatcatcagtgctctggtaggcggccgtttccgcagttccactgtag

SEQ ID NO: 999 - DNA, 684 bp, Zea mays
  UNSURE (1)..(684): unsure at all n locations
  Clone ID: PAT_MRT4577_134413C.1
  unsure (1)..(684): unsure at all n locations
cctcgaggccggccggggtctccgtcttctcaccaccgctgcctccgcggtttcgcttccccccgtcttcccaagcctttgcttcgctcttcgcttcggattccctctgctcatggccgggagagggaaggcgatcggctcaggggccgccaagaaggccatgtccaggagctccaaggccgggctccagttcccagtgggaaggatcgccaggttcctcaaggccggcaagtacgccgagagggtcggcgccggcgcccccgtctacctcgctgccgtgctcgagtatcttgctgctgaggttctcgagcttgccgggaacgcggctcgggacaacaagaagacccgcatcgtcccgcgccacatccagctcgccgtccgcaacgacgaggagctctcccgcttgctgggcacggtgaccatcgccagcggtggtgtcatgcccaacatccagtgccaaggctgcggctggtgatgaggactagaccgaccacgcctagcctttcatccggtggtggcacctcttgtggatgctgccgtatcaacttgtgcctgtgtagtacgctctagaaatgccttaagtgttgcgttgtagttcgngatgtgtctccctgtaccactgccaaggattagttctgtatattttgcctataagagngcatccttttggacgacctgtttatc

SEQ ID NO: 1000 - DNA, 1401 bp, Zea mays
  Clone ID: PAT_MRT4577_134423C.1
ttgggtactctcgaggccggccgggccgtcccgtccgctggctctgcatatcccgcgcccgactcccgttgctgcgtgcggcggcccgactagtcgcgccgcgctgcgctcggcttgattgaaccggccgggatgggggtgttggaggacctcgtggcgagagcgggcgggtgcgcggtcatcgacggcggcttcgccacgcagctagaggcgctcggcgccgacatcaacgacccgctctggagcgccgcttgcctcatcaccaggccgcacctcgtcaaggaggttcatatgcagtatcttgaagctggtgcggacgtcatcatttcatcatcttaccaggcaacaatcccgggtttcatagctagaggaatgtctgtcgctgaggcagaagatttactgcgaacaagtgtaaaactggccaatgaagctcgagatgaattttggaagtcaacactgaggaagtccaaacctatttacaaccgtgctctggttgctgcatccattggtagctacggagcctatcttgctgatggatcggagtacagtggatcatacggtgctgacatcacagccgagaagctgaaggacttccacaggcgccggctgcaggttcttgcaagtgccggtcctgacctgattgcgtttgaggccattcctaaccaaatggaggcacaggcattggttgagcttctggaggaagagaaagtccagatcccttcctggatctgcttcagctccgtggacggtaagaacctgtgctctggggagagttttgcggactgccttaagatcctcaacgcgagcgagaaggtggccgttgtaggcgtgaactgcacacctcctcagttcatcgagggcatcatatgtgaatttaggaagcaaaccaagaaggcgattgcagtttacccgaacagcggcgaagtttgggacgggagagcgaagaggtggctgccggttgagtgcttgggtcacaaaagcttcgacgctctcgcgaagagatggcaggaggcgggggccagcctcatcggagggtgctgccggacaacgccttcaactattagggctgtttccaagatcctcaaaggaaggacggggcattgatttgtttattataattgagctgttgttgcattatgtcactagccagaataacattcagaatatgtatcctgttgctcttccgttcccctttctaaaataaggtatcaatataattttgcagtgtaaaaaaaaaaaaaaaaaaaaaaaggtaaaaaaaaaaaaaaaaaaaaaaaaaaaaaaaaaaaaaaaaaaaaaaaacgtaatactagtttgtagcgctgacccccagtattgcttagtctccgattatgttgtttgggtatggttcccaagttaagtatggatttaaccaagcct

SEQ ID NO: 1001 - DNA, 2263 bp, Zea mays
  Clone ID: PAT_MRT4577_13464C.1
gaatctgatctccttttcctcccgcacccaacccaaccacggacgcacgccgaggagggagaaagcgggtgtggaggggcgggcggccggcctcgcatgtttgacgacgcgggggccgtggcggtgaagcggatgaggctgtgggaggaggacgaggtggaagtggaggaggaggggatggaggtggacgcggagccgggatggccgtggggaacgccggcggcggggctctccagggctgcggcgatcgtcgtggcggacgcggcggagcccgacttccccgtcatatacgtcaacgccgcattcgagtccgccacggggtaccgcgcccacgaggtgctcgggcgcaactgccgattcctgcaatttcgggatccacgagcccagaggcgacatccccttgttgatcccatggtcgtttcagagatccggcgatgcctcaacgaggggattgaattccaaggcgagctgctaaatttccggaaggatggcgctccactttacaacagattaagtctcattccaatgcacggggatgatggctacgtgacacatgtgattggaatccaactattctccgaggcaaacatcgatctcagcagcgtgtcgtatccggtgtacaagcaacagaccaacaacaggcccatcattcaagatctgaactcagcttcccatgagcatgctccgaaagtccagagtgcagaccactgcggtatgcttcagttgtcagacgaagttctcgcacacaacattctgtctcgcctgtcacctagagatgtcgcatccattggatccgtctgtaccaggatgcatgagcttaccaagaatgatcacctgaggaagatggtctgccagaacgcgtggggaagggatgccactgtcaagcttgagatgagcaccaagatggtaggatggggccgtcttgcgagagagctaactactcttgaggccgcctcgtggaggaagttcacggttggagggcgcgtcgagccttcccgatgcaacttcagtgcctgtgctgttggtaaccgcttggtccttttcggaggggagggtgtcaacatgcagcctatggacgacacctttgtgcttaacatggaggctgcaaggccggaatggcgccgcgtgaaggtttccgcctccccaccaggccggtgggggcacactctgtcgtggctgaacgggtcatggctggtggtatttgggggctgcggacagcaaggtttgctcaatgatgtcttcgtccttgaccttgacgctcagcagccaacgtggagggaggttgcaagcgagggtcctccactgccacggtcctggcacagctcatgcaccttggatggttcgaagctggtcgtctccggtggctgcaccgagtctggcgttctcctcagcgacaccttcctgcttgacctcaccaaggagaagcctgcgtggagggaaattcccacatcttggtcacccccatcccgcctcggccacaccatgtccgtctacggtacgactaaactgctcatgttcggtgggctggcgaagagcggctcgctccggctgcgctccagcgacgcctacacgatggacgtcggcgaagatagtccgcagtggaggcagctggcgacgaccggattcccaaacgtcggcccaccgccgaggctcgatcacgttgcggtgagcctgccctgtggacggatcatcatattcggtggctccatcgcgggactccactccccggcgcagctgttcctggtcgatccagcagaggagaagccgacgtggaggatcctgaatgttcccggcaaaccccccaagttcgcctgggggcacagcacctgcgtggttggcggcactagggtcctcgtcctcggaggccacaccggggaggagtggatactgaacgagctacatgagctctgcctggcaagcaggcccgacgacgacgacgatgaccgctactgactagtttcgttgcacatggtgttttatatgctattgttcgtaactacttccagtctgttgttgggtaatcggtatgacaaaaaatagcggaaaattaattaaaaaagttagcctagaagatttcagtgtattttatcggtctagatagattctatatggtctatatatttgtatattttttgtctaaaagatcaaaaaaaaaactgaaacaactgcattgtagattcgcatggcaaagtcgccagttccaatgtcttgtactcttatttttaatcatatgtaaaatatagcgctgcttcagtttgtaggt

SEQ ID NO: 1002 - DNA, 646 bp, Zea mays
  Clone ID: PAT_MRT4577_134651C.1
gcctgcagatgctccttcgtctgtcggcaagtgctgctacggcgaccattcatcccggaatgctctcaagctcctatagcttgccttctgccgccgtacctcgccgagccggtggcttcggtgtgtgcaagcgggagtcttcaaccctacaggatccaacatgcaagcgcagctgggatcttacctttatcacccctggtactgcaacaatcatcagccctattacaacggttaccctttggtgcatttattgggcacaaaacatcagggcacaacaggtacaacaacttgtgctaccaaaccttgctggcctactctcaagaacagcagtgtcttccattcaaccgactaggttcattgaactctgcttcttatttgcaacaacaacaactaccattcagccagctacctggtgcctacccccagcaatttcttgcattcaaccaaactagcagcattggaacttctcctgcttatttacagcagggaacaactactaccattcagcccgctagctggcgggagccctgctaccttcttgacacaccccaggtggtggccggtctaccagcacgttggcgccataacgctggcaccctcttacaactgcaacaattggtggcattcaaccaacttgctttgacaa

SEQ ID NO: 1003 - DNA, 477 bp, Zea mays
  UNSURE (1)..(477): unsure at all n locations
  Clone ID: PAT_MRT4577_13487C.1
  unsure (1)..(477): unsure at all n locations
aaacataagggcacatcaactacgacaactagtgctaccaaaccttgctgactactctcagcaacagcagttacttccattcaaccaactagctagattggaactctgtttcttattcgcaacaccaacaactaccattcagacggctacctgtagcctacccccagcaatgtcttccatgcaaccaactggcaggattgaactctcctgcttatttacagcagcaacacctactaccattcagccagatagctggtgtgagccctgctaccttcttgacacaaccacagatgatgccgttctaccagcacgctgagcctaacgctggaaccctcttacaactgcatcctntgctgccattcaaccaactcgcttcgacaaacctagcagcgttctaccaacaacccatgatcagggggggccctcttttagattgcttatgacttatagctcaataataaagttgttaagatgatg

SEQ ID NO: 1004 - DNA, 314 bp, Zea mays
  Clone ID: PAT_MRT4577_135032C.1
ctgatccgttggtgcttgaccgatccatggacaccgatatcggatccgtggacggggcggcgtcgaaccagacggttggctgcccggcgtcggcgccggggtgcccgatggcgtccacgccggcgcagcccgcggcgaccctgtcggcgggggaggcgtcgctgcggcgccactcttcgcgttgcctggtgcaagtcggcgtcaacgatgtattcgcggtttcgggggacttaaacctaacgctggtcgaccacctgatcgacgagcccggcctgctccttgatgggtgctgcaacgagctcaacgccgggtac

SEQ ID NO: 1005 - DNA, 195 bp, Zea mays
  Clone ID: PAT_MRT4577_135057C.1
cgctcatcttgtcgcggtgagagcctctagaatttcccccactcgccagtcgcagcagcacctgtagcagccattgacgcgagcggagccggtagcaaggtgtataagggggctgccgtgcgcaaggcagtcggccccaggaataagtcggtgacgcggtccgtcaaggccgggcttcagttccccgtcggccgg

SEQ ID NO: 1006 - DNA, 316 bp, Zea mays
  Clone ID: PAT_MRT4577_135079C.1
gggcataaaccaaagcagtttttaacgcttccaggttgcccaatcgaattacaacgcgcagttgctcataattcaacaaacccgggacacaacattcagaccgcccgggacttttgacttggaaccaaaattaacccggtcgtaccacgttttaaacaagcgtgaacactcagtggcaggcacgcgattcacctttaaaaggacacggaccttgaccaggcgatccaccttgaaacaaacttttggtaaaagcaaaacaataccggacccacaagccaacgctcggtacgttttgatcgcccaagggccggccacg

SEQ ID NO: 1007 - DNA, 402 bp, Zea mays
  Clone ID: PAT_MRT4577_135081C.1
aaccaaacaggccacgccttaaaaggcattatgttccaccaacccgaaccattcaattatacaaacagggagctgtttgccggattaaacacccaggattaaagttccagagatcccccttgattacaagccgccaaggggaaattaacaacaactttccgggggaactacaagccttgcttagacccttcattgaccggcccacccttggggaatcaggaacaaaaattccaaaaaaatgtccttggcccgcaacactgaaatatactcccacggcccgacgatgggatgggcccccaaaggggtccatgggagggggtagtttataaaccggggggaaaaatgtcgcggccatgaaagggccccccattaaaaagaaacgtttttttggggggggaagct

SEQ ID NO: 1008 - DNA, 2355 bp, Zea mays
  Clone ID: PAT_MRT4577_135170C.1
cattggcctcggaccccgaccgtcggctggtcggcacgcactctcgcaagcaaaactacaagctcgcttttttaaattctgtccctgcaattctctcctctgtttcccactcgtagatcccgccgcctcccgcgtctagccgtcgacgagcaccgcagcctgacacagccgcgggcgaaccatcgcgtgcggcctcgcccgggatggcgaccatggagagcctgatcgggctggtgaaccgtatccagcgcgcgtgcaccgtcctcggcgaccacggcggcggcggcggcgagggctccctctgggaggcactcccctccgtcgctgtcgttggcgggcagagttccgggaagtcgtcggtgctcgagagcatagtggggagggacttcctgccccgtggatctggcattgtcacgaggcggcctttagtgctgcagctccacaagacagatggtgggcacgagtatgctgagttcctccacgccccgcggaagcgtttcaccgactttgctgctgtgaggaaagagattgctgatgaaacagatcgcataactgggaaaactaaagctatttcaaacgttcccatccatttgagtatatattcaccacatgttgttaacttgacacttatcgatcttcctggactgacaaaggtcgctgtagaggggcaagcagaatctattgttcaagatattgaaaacatggttcgagcttatgttgacaagccaaattgcatcatcttggctatctccccagctaaccaagatattgcaacgtcagatgctatcaagcttgctagggatgttgatccttcaggtgacaggacatttggagtcttaacaaagcttgatttaatggacaagggtaccaatgctgttgatgtgcttgaagggaggcaatatcgcttacaacacccctgggttggaattgttaatcgctcacaagctgatatcaacaagaatgttgatatgctttcagcaagacgcaaagaaaaagagtactttgagagtagtcctgaatatggtcacttggcacataaaatgggtgcagagtatcttgccaagcttctgtcacagcatttagaggctgtgatcagggccaaaattccaagtattatagccttgattaacaaaacaattgatgaaatagaagcccagttggatcgacttggtaggccaattggaggtgatgctggggctcagttgtacacaatcttggatatgtgtcgggcatttgaccgtgtctttaaagagcacttggacggcgggcggccaggtggagatcggatttatggtgtctttgacaaccagttacctgcagcactgaaaaagcttccatttgaccggcatctttcaatgcaaaatgttcgtaaagttatttcagaggctgatggttaccagccccacttgattgcccctgagcaaggatacagaaggcttatagatagttctctaagctactttaagggtccagctgaagcatctgttgatgcggtccatttggtcttgaaggagcttgttcggagatctattgcagcaacagaggaattgaagcgattcccaacacttcaatcagatatagctgctgctgcaaatgatagcttggaaagattccgtgaggatggacgaaagactgttcttcgtctagttgagatggaagccagctacctaacagtagagtttttccgtaaacttcctactgaaccagagaaagcagctgataagaacactccagtgagtgataggtatcaggacaatcatctcagaagaatcggatcgaatgtgtcatcttatattaacatggtctgtgagactctgaggaacacggttccgaaagccatcgtgcattgccaagtgaaagaagcaaaaagaaatttgcttaaccgtttctatgctcatgtgggaagcaaggagaagaaacagctgagcgcgatgttggatgaggaccccgctttgatggagaagagggatgccttggtcaagaggctagagctgtacaaatctgcaaggaatgagatcgactcggtcgcatggaaatgattggcttgtgacagctacatctggaatgtatgtaaaatgtacaaccgcagcagcacacgtgtgattgcagtagaatgttcaattcttttttacatttgaatttaccctggaggccttgtacgcagttttcactcgagtcttttgccggacatgcttatttggccgtcttggccttaacacgattgtgttatgcgtggatgatctggtctccggttgatataagagtgtatatgtattcttttgttgattttattactgccttgatgatatcaatagttttttactgccttgatgatatcaatagtttttaccacag

SEQ ID NO: 1009 - DNA, 359 bp, Zea mays
  Clone ID: PAT_MRT4577_135239C.1
cctttcaccagcggtatctccggtatgtgaaaacccgaggcttctttcatacaggatccaaccgcgcaatctcagctggcatcttaccttaatcaccctagttcctccaacaatcatcagccctataacagcagttacctttggtgcatttattggcacaaaacatcagggcacaacaacttcaacaacttgtgctagcaaaccttgctgtctactctaagcaacaacagtttctttcattcaaccaactagctgcattgaactctgcttattatttgacacaacaaactccattcagccagttagctgctgtcttcacccagcaatttcttccattcaaccaactggaagtattcaac

SEQ ID NO: 1010 - DNA, 233 bp, Zea mays
  Clone ID: PAT_MRT4577_135272C.1
gcttctcctccccctcttaccaagtcctcctcgggttagggttccttagggttttgtggaggggcgatggcggcggctgatgtggagtaccgtcgcttagtctagcggacttgcctgggccaccagcaacgagtcgctggagaatgccttcacctcctacggagagatcctcgactgcaaagtcatcaccgaccgtgagacggtgaggtaccgcggcttcaagtgagttacct

SEQ ID NO: 1011 - DNA, 1033 bp, Zea mays
  Clone ID: PAT_MRT4577_135567C.1
ctcggccggccttcgcaagcgaagcaaagcgcttcgcaagcacaggcagtgatcggcaaccaaatccggacagtcttgagctctctcagtctcagcatttcagttcccagattcacatagccccagccccacaagtagcgaaatggcagctgctccgttcgcgattgccggccggctctcccccgttgcgcgcctcccggtccgcgcctggaggccggcgcacgggtttgcgtcgtccgggagagcccgctcgctcgccgtggcgtccgcggcgcaggagaacagggacaacagtgtcgacgtacaggttagccagaacggcggcaacaggcagcagggcaacgccgtgcagcgccgcccgcgccgcgcgacagcgctcgacatctccccatccccgttcgggttagttgatccgatgtcgccgatgcggacgatgcggcagatgctggacacgatggacaggctgttcgacgacgccgtggggttccccatggggacacggaggtccccggcgaccaccggcgacgtacgcctgccgtgggacatcgtggaggacgagaaggaggtgaagatgcggatcgacatgccgggcctcgcgcgcgacgaggtgaaggtgatggtggaggacgacacgctggtcatccgaggggagcacaagaaggaggagggcgcggagggcggcagcggtggcgacggcgacgggtggtggaagcagcgcagcgtgagctcctacgacatgcggctggcgctgccggatgagtgcgacaagagcaaggtgcgggccgagctcaagaacggcgtgctcctcgtcaccgtgcccaagaccgaggtggagcgcaaggtcatcgacgtgcaggtccagtagacaaactgagctgtcacgacgggtctttgtgtagcactagcgtgggttgggctcttcgcgccgaccgtatcagtactcgtgacccaacgtgtggaataatgtgaataaataaacgcttcaattctgctattccaagaatctagctcaataaaaaaaaaaaaaaaaaaa

SEQ ID NO: 1012 - DNA, 457 bp, Zea mays
  Clone ID: PAT_MRT4577_135894C.1
agaggaaacttgttttattggtaaaaaggggccacccccgagggcatggcaacccattattcgggccaacacaaatttttctatctagaaggccccccccacaaagggttgctggaaaaacatggggggaatcgccagggcccttggggggaacatgaaggggaaccgctggggcagcaaaatctgcgaaacggggtcgcagggacattggggcatcatcatttgcgacatcatgcccggcaagaccattggggacatcatgcccggcatcatcaagggggacatcgggttaggcgtcatcatcgggggcatcatcactggcatcggctgaagcgggaaggccaacagttgctgcagcatcagggacggaccccccatcaagctggcaagcccctggtgcatcatgcagaactgcatgcatgggttcatgggccccaatggcatgactgggggcaag

SEQ ID NO: 1013 - DNA, 2267 bp, Zea mays
  Clone ID: PAT_MRT4577_1358C.1
gccggccggtcacaacacaattcggcacgagggtcagtcagtcagcagccgcaacctcgtacaatcacgaaagcagcacacgagtccacaacagcaccccgcctctttttcttcacgtgcgttgcgtgccctgcccccatggagaccctcctggctggcaaccccgccaacggcgtggcgaagccgacgtgcaacggcgtcggcgccctgcccgtggccaactcccacgccatcatcgccacgccgccggctgcggcgacgctggccccggctggcgccacgctcggccggcacctggcgcgccgcctcgtgcagatcggcgcctccgacgtcttcgccgtcccgggggacttcaacctcaccctgctcgactacctcatcgccgagccgggcctgaccctcgtcggctgctgcaacgagctcaacgccgggtacgccgccgacgggtacgcgcggtcgcggggcgtcggcgcctgcgccgtcacgttcaccgtcggtgggctcagcgtgctcaacgccatcgccggcgcgtacagcgagaacctccccgtcgtctgcatcgtgggcgggcccaactccaacgactacggcaccaaccgcatcctgcaccacaccatcggcctccctgacttctcccaggagctccgctgcttccagacgatcacctgctaccaggccatcatcaacaacctggacgacgcgcatgagcagatcgacacggccatcgcgacggcgctgagggagagcaagcccgtgtacatcagcgtcagctgcaacctggccggcctctcccacccgaccttcagccgggatccggtgcccatgttcatctcgccgaggctgagcaacaaggccaacctggagtacgccgtggaggcggcggccgacttcctcaacaaggcggtgaagccggtgatggtgggcgggcccaagatccgggtggccaaggccagggaggcgttcgccgccgtcgcggacgccagcgggtaccctttcgccgtcatgccggccgccaagggcctggtgccggagcaccacccgcgcttcatcggcacctactggggcgccgtcagcaccaccttctgcgccgagatcgtggagtccgccgacgcctacctcttcgccgggcccatcttcaacgactacagctccgtcggctactccctcctgctcaagcgggagaaggccgtcatcgtgcagcccgaccgcatggtggtcggcgacggcccggcgttcggctgcatcctcatgcccgagttcctccgcgcgctcgccaagcgcctcaggcgcaacaccacggcgtacgacaactaccgccgcatcttcgtccccgaccgcgagccgcccaacggcaagcccaacgagccgcttagggtcaacgtcctcttcaagcacatcaagggcatgctgtccggcgactccgcggtcgtcgccgagaccggcgactcgtggttcaactgccagaagctcaggctccccgagggctgcggctacgagttccagatgcagtacggctccatcgggtggtcggtcggcgcgacgctcgggtacgcccaggcggccaaggacaagcgtgtcatcgcgtgcatcggcgacggaagcttccaggtgacggcgcaggacgtgtccacgatgctccggtgcgggcagaagagcatcatcttcctcatcaacaacggcggctacaccatcgaggtggagatccacgacggcccgtacaacgtgatcaagaactgggactacacgggcctggtcaacgccatccataactccgagggcaactgctggaccatgaaggttcggacggaggagcagctcaaggaggcgatcgccatggcgacgggcgacaagaaagactgcctctgcttcatcgaggtaatcgtgcacaaggacgacacgagcaaggagctcctcgagtgggggtccagggtctccgccgccaacagcaggccgcccaacccccagtgatgagcccgtcgatcggtctcgagcgttcctgcaatggcgcctgcgtctgcgtctgtctgccctgaaattttttcgggtcgtttactcgttttcagtcagttactcagtttgtccgtcttcgtcgagcagaactacatccctgctgagggaagctgccaatctttatcctacgatgataatgtctgcaatttcacttgcttccaattgagttctgttacaaatttttgcaacattttttcccgcatcaataaaattcgttcgcgacgccggtctcctaaaaaaaaaaaaaaaaagcggcc

SEQ ID NO: 1014 - DNA, 3175 bp, Zea mays
  Clone ID: PAT_MRT4577_135914C.1
aattcggcacgaggcctcaccgaagcacaagcacagcgcaatacacagactcgcagggctcctagaaaagagaaagtagacgaccaaaagaaactggagaaaaagagaggagctcaaaagcaaggcgaggcctcctccgcccctttttctcccctcccaattcacacaggattcttcactcgcccgcccagttgtttcttttagtgccgcccccattccgctctgatccgagcctttcgctcaaagcctccagcttttgcaattgtttggtcacttcgggaatcaaggaataagttcttgcgctgtgcgcgatagagagcctgatccatctttccccatcctcttcccgtggcatttcggtgtgcttgcgctctgtgcgtggccactgcagggggaggattttggcctggtttctgtcttcttggggttccaaaatttcgggcgagatcttcgcctcaaggaggttccttgcttttctggtattggcgcctcttgttgctccctacaagtccaaggaaagaatttggaggccgtggggggtcccttgcgaccggttctggtcgatttttcgggctgctgaattcaatatgccgctgtgacccaccgctgcctggtttcttggaggaagtttgcttcaattgggcgtcgttgagctagacccctcctccagctcttgatccggtccatggggctctgccatggcaagccgacgcaaatcccggaggccgaggcggaggaggatccccatgtagctcggagcgggtgacagcggggacggggcgacctcgccgtcggcggcggcgcccacggcgaagccgggcacgccgaaacagcccaagttcccgttctacctgccgagcccgctcccgccgtccagctacaagggctcgccggcaaactcgagcgtctcgtccaccccggcgcgcggcgggctcaagcgcccgttcccgccgccgtcgcctgccaagcacatccgcgctctcctcgcgcggcggcacggctcggtcaagcccaacgaggtgtccattcccgagggcggcgagccggagctcggcctggacaagagcttcggcttctccaagcacttcttcgctaagtacgacctcggcgaggagatcggccgcggccacttcggctacacgtgctccgccaaggccaagaagggcgagcacaagggccaggacgtcgccgtcaaagtcatccccaaggccaagatgacaacagctatcgccattgaagatgtgagaagagaagtgagaatactgagttctctgacaggccacagtaacctagtgcagttctacgatgcttttgaggatgaagataacgtgtatatagttatggaattatgtaaaggaggtgaactgctggacaggatattggctaggggtggaaagtactctgaagaggatgcaaaggttgttatggtacaaattttgagtgtcgtatcattttgccatcttcaaggtgttgttcatcgtgatctgaagccggagaatttccttttctcttcaaaggatgaaaactctcccttgaaggtcatagattttggcctgtctgactttgtgaagccagacgaaagactaaatgatattgttggaagtgcatactacgttgctccagaggtgctccaccgatcttacggcaccgaggcagatatgtggagcatcggagtaatcgcctacatcttgctatgcgggagtaggcctttctgggcgcgcacggagtcgggaatcttccgagctgtcttgaaggcggaaccgagttttgatgaggccccatggcccactctcacggctgaagctaaagattttgtaaaaaggcttcttaacaaggattaccgcaagagaatgacggctgcacaagctctcagtcatccatggatccgtaattctcaacaagtgaaggttcctttggatatgataatctataagctaatgagagcgtacatcagctcgtcttcgctgcggaagtctgctttgagggccctagccaagacgctgacgacggaccaactcttttatgtgagggagcagtttgaattgctgggcccgaacaagaatggttacatctcattgcaaaatctgaaatcggctctagcgaagaactccacggatgcaatgaaggactccagggttgtcgattttgttaacaccgtgtgcgctcttcagtacaggaaactggatttcgaagagttcgccgcttccgccatcagcgtctaccagatggaagccctggagacctgggagcagcacgcgaggcgcgcgtacgagctgttcgacaaggaaggaaaccggcccattgtgatcgaagaacttgcgtcggagctcggacttggcccgtcagtgcctctccacgttgtcctccaagactgggtcagacacgccgacgggaagctgagcttcctggggttcatcaagctcttgcacggggtctcgtcgcgctcgatcccaaaggcctagcattgtacaccatccatccatcgtcgttgttgttgtagttgtactgaagtaaagctgttgtgtagacgagtgtacagatgaggatagggaaaagaaatgaacatgatggaagactggaagggccgtaagatttgcggctgctgtttgtcaatgccaaattgccattgcctgccctgcccatccatatccatcaagaaccaaggagatgatgaccggtggctaagccagtctctggctggtgcgtgcgtgcgtgcgtcccgtgtgtattgtgttctgttcgagagtggctggagggtggtggacggcctgaaaccgttgcatgatgaggagagatgcttggtagtcctgtgaggtaaagaggcagttagaaggctggtgcctgtgccttgtaccacttgtaccccatcccttgccacgtggattgctggcggcggcggcgtcgtcgtcgttgtactgaagtaaggtgctgtgtagacgagtgtacagatgatggaggataggagaaaatgagtactacgatggaagggccgtaagatttgcggctgctgtgctgtttgtccgtaggttgctaggagactttggcaaactgttgcatatttgtatcactgacctggaattttatttatgttacactggcgctgagcatagactagcattggataccatgactattacttcctccacttccggtttggacaggcattagcgggatt

SEQ ID NO: 1015 - DNA, 1341 bp, Zea mays
  Clone ID: PAT_MRT4577_135917C.1
gaaaactctcccttgaaggtcatagattttggcttgtctgactttgtgaagccagatgaaagactaaacgacattgttggaagcgcatactatgttgctccagaggtcctccacagatcttatgcctacatcttgctctgtgggagtaggcctttctgggcgcgcacggagtcgggaatcttccgagctgtcttgaaggcggaaccgagttttgatgaggccccatggcccactctcacggctgaagctaaagattttgtaaaaaggcttcttaacaaggattaccgcaagagaatgacggctgcacaagctctcagtcatccatggatccgtaattctcaacaagtgaaggttcctttggatatgataatctataagctaatgagagcgtacatcagctcgtcttcgctgcggaagtctgctttgagggccctagccaagacgctgacgacggaccaactcttttatgtgagggagcagtttgaattgctgggcccgaacaagaatggttacatctcattgcaaaatctgaaatcggctctagcgaagaactccacggatgcaatgaaggactccagggttgtcgattttgttaacaccgtgtgcgctcttcagtacaggaaactggatttcgaagagttcgccgcttccgccatcagcgtctaccagatggaagccctggagacctgggagcagcacgcgaggcgcgcgtacgagctgttcgacaaggaaggaaaccggcccattgtgatcgaggaagtttggtcggagctcggacttggcccgtcagtgcctctccacgttgtcctccaagactgggtcagacacgccgacgggaagctgagcttcctggggttcatcaagctcttgcacggggtctcgtcgcgctcgatcccaaaggcctagcattgtacaccatccatccatccatatctatatccatcgaccgagggagacgagtgatggctgagccagtctctggctgcaggtgcgtgcgtgtgtgttcagcgttctgttccccggtggacggcctgaaaccaaacgcaaagaccaagagaaatgcctgacgatagtcctgtgtaagaagagtaagtaaggcagcacagggtctggtgcctgtgcaccacttgtaccacatcccttgccacgtggatagatgacgtcgtcgtcgtctttgttgtagttgtactgaagtaaagctggttgtgtagacgagtgtacagatgaggatagggaaaagaaatgaacatggtggaagactggaagggccgtaagatttgcggctgctgtttgtcaatgccaaattgccaatgcctgcagctgcagtagctgtgtctggcc

SEQ ID NO: 1016 - DNA, 402 bp, Zea mays
  Clone ID: PAT_MRT4577_135919C.1
cccacgcgtccgcccacgcgtccgcccacgcgtccgcccacgcgtccgatttggaggccgtggggggtcccttgcgaccggttctggtcgatttctcgggcagctccagctgaattcaagatgccgctgtgacccaccgctgcctggtttcttggaggaaggaaattttgcttcaattgggcgtcgttgagctagacccctcctccagctcttgatccggtccatggggctctgccatggcaagccgacgcaaatcccggaggctgaggcggaggaggatccccacgtagcctccggcgcgggcgacggcggggacggggcgacctcgccgtcggcggcggcgcccgcggcgaagccaggcacgccgaaacagcccaagttcccgttctacctgccgagccc

SEQ ID NO: 1017 - DNA, 256 bp, Zea mays
  Clone ID: PAT_MRT4577_135990C.1
aaagcatgaccaaggagcaccagcatttatttggggcgaacttagaacaaatactgacaggagtaacaccatacatcaatccacagtccatgctgtttgacacatgggtctgctgtagccggggatgaacacatcactaacaactgacacatagcgaccttgctatctgaaccacaggtgggcgccaacacactagactaactacagataaaccctatggactagggtaaacatcactgctgcgaacatgataact

SEQ ID NO: 1018 - DNA, 2638 bp, Zea mays
  Clone ID: PAT_MRT4577_136067C.1
gccggccggtccaggtcgttccattgcaaccacctcccgttctgatttctgcgggcggaattccataaggccctcccccctcccctatcctcctccccttgccactccaattcctctgcaaaattttctcatggcagccgacgtttccatccgcactcgatccgcctcaaccacccgctaattcctcctagttctagacttctagtctcctctctctctctctctctctctctctcctgcgccgactcatcttcatcctcgtctcacctccctgctgctgctgacgctgctgccggcaagatcaaatcgttcaaaaggtgcggccttttctcctcgccggcgcgttcgttctaacgcaatctgcaaagatttgttgtttttttactgctatgtgttgatgtgggagacgccgtcctcacccgattcgatgtgggattgctccgcggaattttgggcgggactgaccctctctctctctctctcctgcgccgactcatcttcaccctcgtatcacctccctgctgctgctgacgctgctgccggcaagatcaaatcgttcaaaagaccctggatttcggcgaattctagatggatcatgtgttttaggtgattggtgctttcgacctcattagtgccttttgttcaattgctggacccaaggagcagagttctgtcgacatggcatctccaagaggaaggatgtcatttccccttcgttcctttctgatgatctgcctcatggctcagctgggagcttccaatgttgtactcatggcgaacaacactaccctgtcgttcgacgacgtcgaggcaatttttactccagcagtgaaaggttcaggtgtaaatggtgtcctttatgctgtggaacctatggatgcatgcagtccattgagaacaaaagcgataggaggctctgtctcaacatttgcgttggttataagaggcggttgccatttcgatgacaaagttagaaatgctcagaatgctggattcaaggctgctgtagtatatgatactgaagacaacggtatccttgtttcaatggctggaagctcgtctggagtccacatatatgcagtgtttgtctctaaagcgtcaggggaggagctgaagaaatattcaggccaaactgacgcagagttgtggataataccaacatacgcgaactcggcttggtcaatcatggcaatttcatttatatcactgcttgttatgtctgctatcctagccgcgtgtttctttgcgaggagacaccagataagacgggacagggctcgacttccccaaactcgggagttccatggaatgaacagccggttagttaaagcaatgccaagtcttattttcacgaaagtgcaagaagacgactgcacatcagcaacatgcgccatttgcttggaagactacagtgctggagaaaagataagggttctaccttgtcgacacaagttccacgcagcctgtgtggacctatggctcacctcctggagaacattctgccctgtatgcaagcgggacgcgaatgctggaacaccagagccccctgtatcagagtcgacgcctttgctctcatcatccgccattcgcttaccagaaccaaccgcttcggtttccttctggtctacagtggcagcagcagcagcagcgtctccccccaggccaatcagccggcatccgtcgccatcacggtccatatcccgcaagcactccgtttcaggttccagcatccctggcacccctatccccaggtttcacgcaagctcatcatctcctacctgcacaagtggaagcagtttggacctcgcaaacatgccgtcgtctccatggcctcgcgcttcgcaccttgcatctgctcactcttcgtgcggtggccgcctgtccccgccgatccacatcaggaatacctctgcagcgcacgtctcgcgctctgcctatggatctcccagccgttacgtaggctcgtcgcacatgtcccgtggatctccgagttgctactaccttggatcttcttcagggcagcagcatccttacctgaggcactgcaccttgtcaggcacgagcctgttcaccatggtgccccaatcaccgcaacagaaccagctgcagcacggtggagactcggaaaaagatctgtcagctgctgcaccattccgtcagctctactacctgcagcattgtccagattctggcacgtcgtctcagtcgcttccagggtgctgattcttcattcttgctgcaaaattcaccattttaaaaaacattgatggtggctccagtaaagcttccggccgtgaggaatcttacatggcaccgaattgacatgtggatttgagctcctcagttcaccatgatgatgagagaaaaaaggtgcgacagaattgcttgtaagaagagagaattgcaccccccagaatgtgtggcttcatcttgaagaagcaaatgcccatgtcgggcttcaccagcgtttagcgtgtactgatacagctctgtagtaattctagttgctgtttgtctatcgaggtttgagccggtagcattccttcctctcttttttgttttcctaattttgaattagttatatgacagacaaggttttcaagaaaagaaataacaagttttacccctgcatttttat

SEQ ID NO: 1019 - DNA, 2580 bp, Zea mays
  Clone ID: PAT_MRT4577_136069C.1
atattagtgtagccatcagtgtatttatatggtaccgtgagatcaaaccatagattctttcattcagctctgatggcttcgttccattgcaaaccacctcccgttctgatttctgcgggcggaattccataaggccctcccccctcccctatcctcctccccttgccactccaattcctctgcaaaattttctcatggcagccgacgtttccatccgcactcgatccgcctcaaccacccgctaattcctcctagttctagacttctagtctcctctctctctctctctctctctctcctgcgccgactcatcttcaccctcgtctcacctccctgctgctgctgacgctgctgccggcaagatcaaatcgttcaaaagggtttttctttttctttttgggcgatttcgtgctcaaattgacatcttctaaccagtccaatgcacttttcgtacccgtgtacaagaccctggatttcggcgaattctagatggatcatgtgttttaggtgattggtgctttcgacctcattagtgccttttgttcaattgctggacccaaggagcagagttctgtcgacatggcatctccaagaggaaggatgtcatttccccttcgttcctttctgatgatctgcctcatggctcagctgggagcttccaatgttgtactcatggcgaacaacactaccctgtcgttcgacgacgtcgaggcaatttttactccagcagtgaaaggttcaggtgtaaatggtgtcctttatgctgtggaacctatggatgcatgcagtccattgaaaacaaaagcgataggaggctctgtctcaccatttgcgttggttataagaggcggttgccatttcgatgacaaagttagaaatgctcagaatgctggattcaaggctgctgtagtatatgatactgaagacaacggtgtccttgtttcaatggctggaagctcgtctggagtccacatatatgccgtgtttgtctctaaagcgtcaggggaggagctgaagaaatattcaggccaaactgacgcagagttgtggataataccaacatacgagaactcggcttggtcaatcatggcaatttcatttgtatcactgcttgttatgtctgctatcctagctgcgtgtttctttgcgaggagacaccagatcagacgggacagggctagacttccccgagctcgggagtcccatggaatgaacagtcaattagttaaggcaataccaagtcttattttcacgaaagtgcaagaagacgactgcacatcagcaacatgcgccatttgcttggaagactacagtgctggagaaaagataagagtgctaccttgtcgacacaagttccacgcagcctgtgtggacctatggctcacctcatggagaacattctgccctgtatgcaagcgggacgcgaatgctggaacaccagagccccctgtatcagagtcgacgcctttgctctcatcatccgccattcgcttaccagaaccaaccgcttctgtttccttccggtctacagtggcagaagcagcagcagcgtctccccccaggccaatcagccggcatccgtcgccatcacggtccatatcccgcaagcactccgtttcaggttccagcatccctggcacccctatccccaggttccatgcaagctcatcatctcctacctgcacaagtggaagcagtttggacctcgcaaacatgtcgtcgtctccatggcctcgcgcttcgcaccttgcatctgctcactattcgtgcagtggccgcctgtccccgccgatccacatcaggaatacctctgcagcacacgtctcgcgctctgcctatggatctcccagtcgttacgtaggctcgtcacacatgtcccgtggatctccgagttgctactaccttggatcttcttcagggcagcagcatccttacctgaggcactgcaccttgtcaggcacgagcctgttcaccatggtgccccaatcaccgcaacagaaccagctgcagcacggtggagactcggaaaaagatctgtcagctgctgcaccattccgtcagctctactacctgcagcattgtccagattctggcacgtcgtctcagtcgcttccagggtgctgattcttcattcttgctgcaaaattcaccattttaacattgatggtggctccagtaaagctcccggccgtgaggaatcttacatggcaccgaattgacatgtggatttgagctcctcagttcaccatgatgatgagagaaaaaaggtgcgacagaattgcttgtaagaagagagaattgcaccccccagaatgtgtggcttcatcttgaagaagcaaatgcccatgtcgggtttcaccagcgtttagcgtgtactgatacagctctgtagtaattctagttgctgtttgtctatcgaggtttgagccggtagcattccttcctctcttttttgttttcctaattttgaattagttatatgacagacaaggttttcaagaaaagaaataacaagttttacccctgcatttttacagagaggtatgttgaactcaaaaaaaaaaaaaaaaaaggccccta

SEQ ID NO: 1020 - DNA, 200 bp, Zea mays
  Clone ID: PAT_MRT4577_136187C.1
ggttaggggcattattgtctgggctcgtttcatagcgggagcaaacaaagggaacaacaggggtaccaacacctaattcaaaggtagaacggacactaacacggggacagaagccaacggtaacacgttactatagacagatacgataactcggccgaaaccaggatgggcccatatattagtccctccaatcgatgacg

SEQ ID NO: 1021 - DNA, 843 bp, Zea mays
  Clone ID: PAT_MRT4577_136269C.1
gcgtacctcgctcccggccgggagcgacacaagtaacagcagcccgatcttgcatcagctagctaactaagcaagtaagctaagctagccctaggcaacgagccgagccgtcaagctcatcgcagaccacgagccatggcctccaccaacagctggactgttgagatcgcctcgcctgtcgccgcgccgcgcctcttccgcgccgccgtgatggactggcacaccctggcccccaaggtcgcctcccacgtcgtcgccagcgcccaccccgtggagggcgagggcggcgtcggcagcgtcaggcagttcaacttcacctcagccatgccgttcggcttcgtgaaggagaggctcgagttcctggacgtggacaagtgcgagtgcaagtccacgctcgtcgagggcggcggcatcggcgtggccatcgagaccgcggcgtcgcacgtcaaggtggagtccgcggcgggcggcggctgcgtggtgaaggtggactcgacgtacaagctgttgcccggcgtggaggtgcaggacgagatcactaaagccaaggagtcggtcaccaacatcttcaaggctgccgaggcctacctcgtcgccaacccggaagcctacaactagaccatgcatgcgatcggtcgatcgggaacggatttcttccttgccttttgtgttttctacggctaaaataaaacttgtctaaggtgtgtacgaacgtcggagagcgccgagcagagtatgcatgcaattgacaagtcccaaatgtgtgtgggtgtgttttgtaagctggatttattgtgagttgatactaccatgcttatgcttaaataagtacccgttgtggtc

SEQ ID NO: 1022 - DNA, 479 bp, Zea mays
  Clone ID: PAT_MRT4577_136321C.1
ctgtgggggggggggtgggttatttctgggaagccacagacctcaaacaaaaaactttattattgaactgtaactcataagaaactaaaatgggcaccgccaatgatggggtgttggtataacactgctgggtttgtcaaagcaagttggttgagtgggggggattgttgcagttgtaagagggtgccagcgttaggcgcagcgtgctggtagaacggcaacaactgtggttgtgtcaagaaggcagcagggctcacaccagctagctggctaaatggtattagttgttgctgctgtgaataagcacgagagttcaatgctgccaggtggtggaatggaagaaactgctgggggttggcagcaactatctggctcaatggcaactgctgctattgcaaataataaacaaagctcaatgcaactaattcagtgaatggaacaaacaatgtatcttagagtaggcagtaaggtttgctagc

SEQ ID NO: 1023 - DNA, 331 bp, Zea mays
  Clone ID: PAT_MRT4577_136356C.1
gcgcccacgcgtccgcccacgcgtccgcccactcgtccggggttggcttctcctccccctccggttaccgttgggattcctgagggtctccggggttccgcttcgtgcgtgagcggatcgagatggcggcctcggatgttgactaccgctgatttttcagaccgtctcgcctgggccacagacgaccactctctccacaacgccttgagcacctacggtgaggtcctccagtccaagatcatactcgatcggcgagacgcagaggctccgctgcttcagctacgtcaccttctacacggacgacgctatgctgaacgctcatcgacggcat

SEQ ID NO: 1024 - DNA, 2067 bp, Zea mays
  Clone ID: PAT_MRT4577_136542C.1
gggaccctcgaggccggccgggccgaggctccgatatttgttttttccccaacaaaacaccgccaccttttatagatccaatctccccacttccacaattctccccgcctccccctccgaccctcccaaatcagcaccacccataggggccacggccgcgcaatgccgccctctgccgacgcaatgccggcccccggagacgccgcgtgcgccggcgacgtgcgcttgatctcctccaaggagctccgcgagcacgcgtccgccgccgacctctggatctccatctcgggcgacgtgtacgacgtgacgccctggcttccccaccacccgggcggcgacctcccgctcatcaccttggcggggcaggacgccaccgacgccttcgccgcctaccacccgccctcggcgcgcccgctcctccgccgcttcttcgtcggccgcctctccgactacaccgtctcccccgcgtccgccgactaccgccgcctcctggcgcagctctcctccgcgggcctcttcgagcgcgtcggccccacccccagggtccagctcgccctgatggccgtcctcttctacgcggcgctctacctcgtcctcgcctgcgccagcgcctcggcgcacatgctcgctggggggctcatcggcttcgtctggatccagtccggctggatgggccacgactcgggccaccaccgcatcacgggccatccgctcctggaccgcgtcgtgcaggtgctctccggaaactgcctcactggcctcagcatcgcctggtggaaatgcaaccacaacacgcaccacatcgcctgcaacagcctggaccatgacccggacctccagcacatgccgctcttcgctgtctcccccaagctgttcggcaacatatggtcctacttctaccagcggaccctggccttcgacgccgcctcgaaattcctcatcagctaccagcactggaccttctacccggtaatgtgcatcgccaggataaatcttctggcgcagtccgctgtcttcgtcctgaccgagaagagggtgccgcagcggctgcttgagatcgccggtgtcgccgcgttctgggcttggtacccgttgctggtggcgtgcctgccgaattggtgggagagggtggcgttcgtgcttctcagctttaccatctgcgggatccagcacgtccaattctgcctgaaccacttctcgtccgatgtgtacgtcgggccacccaagggcaacgactggttcgagaagcagacggcaggcacgctcgacatcctgtgccctccttggatggattggttccatggcggcctgcagttccagattgagcaccatctgttcccccgcctgcctcggtgccaccttcggaaggttgcgccggcggtgcgtgacctttgcaagaagcatgggctgacctattccgcagcctccttctgggacgcaaatgtgcttacatggaagacactcagggctgccgcattgcaggccaggagcgccacaggcggcggcggcggcgctccgaagaatttggtctgggaggcattgaacacccatggatgataaacgggacgaggatatggctgaggggaaggcaacttctggtgtttcagctttgtgccgacgcgattgtctggttgcttctaatctcagttgtttagattgtattggtcattgaacccgtccgagtcgggctggaatttttgtgttgacaagtgaccgtctatccagttgaagagttcatgcttcaatagtctggttgttcacgggatgttctgttctccctatcacggtaactatatgatgatgatccttgctttaattcatgaacacttgtttcaagattatgtccattacattttgcttgcattgtcaagattgtggattcttggtgttcatgacgttgtaatgttaatgaacggctggtaacgccatgtggtactggtacccctgtattttcagttgctgtggcaccttggctctctctttgaaaaaccagtatgtatatgacaatgatcaatttattcatattcctacttcattcccattttctgatttgttcttaagacgggg

SEQ ID NO: 1025 - DNA, 270 bp, Zea mays
  Clone ID: PAT_MRT4577_136598C.1
tctgatttacgtgtataatccattacagtctcgtgatgtgccaagcaattcccgagttacattcgcggaggaccatgactaccgatcacatatggagtatctctggggaggagaaggtttaacgaattacttagttaagtgggctccttgagtcgtagaaagaatgaggagaactgaaaagtaagtgctctttgaagatatcgtacactctacaacatattgactggcatgtagagtggctaatgcaaatcatatgcctcctttgaagga

SEQ ID NO: 1026 - DNA, 1550 bp, Zea mays
  Clone ID: PAT_MRT4577_136624C.1
aatccctttaaaacgcacaactccagaaaccctggcggacaaagccacttgctcacaccagaaccctctccgcaatctccccgcctcgctcccgcctccacccaatggcgtctctccctaacggtggcggcgccgccgcctctggctcatgcggcgcgcgccctgtggacaaggaggtggacttcgccaactacttctgcacgtacgcctacctttaccaccagaaggagatgctctgcgaccgcgtccgcatggacgcgtaccactccgccgtcttccgcaacgcgccccacttccagggcaaggtggtccttgacgtgggcaccgggagcggcatccttgctatctggagcgcgcaggccggggccaggaaggtgtacgccgtcgaggcgactaacatggcggagcacgcgcgcgagcttgctcgcgccaacggcgtcacggatatcgttgaggtgatacagggcaccgtggaagacgttgaccttccggagaaagttgatgtcattatatcagagtggatgggctactttcttttgagagagtccatgtttgattccgtcatttgcgcacgtgaccgctggttgaagccagatggtgtgatgtatcctagccatgctcggatgtggctagcacccataagaactggtttgggtgacaagaagagggaagattttgatattgctatggatgactggagcctgtttgttcaggacactcaaacttattatggtgtcaacatgaatgctttgatcgtgcagaacatgaaaaatactatttgaagtcttcaatatggaacaatcttcatccaaaccaagttatcggtcaacctgcagctatcaaggaaattgattgcttgacagccactgtcgatgagatccgagaagtcagagcacaagtcacattgccaatcagaatggaagctagattatcagcactggctggatggtttgatgttcattttcgaggtagtgctcaaaaccctggggtggaggaagttgaattaactacagcgccagatgagcatggtggaactcattggggtcagcaggtattcttgctgactccacctctgagtgtgactaaaggagacaacgttaacgtttccttctcgatggttcgctcgaaggaaaatcatcggcttatggatatggagttcacatatgaattgcacgagttatctggcaggaagcacccagcagtcaaaaccaagatgtacttagagtagaacaagatggaaagacggaacctcacgacgccgttgctgaaacctttgctcagaagctgagcatgtagtgtgcttgttacacccatgatgggtacattgagaccatttatgttgtattagtaatatattgtttgattgcccaattaacggggtgagccattgtttcatcacaacatcgatgtgttagcagataaccacatcgccgttttaagcaaacattgagtgcggaattttgttgtctttgtgaagtccgaataaagcatcttcttctgatcaaaaggatagagtgcgttggattaatatagaagtcttcacaataatc

SEQ ID NO: 1027 - DNA, 1807 bp, Zea mays
  Clone ID: PAT_MRT4577_136625C.1
cctaactaaaatttatgtagggctaagctaacaaatagattacaaaacattttctcgtacaatataatacatatttatacataagttgcaatacaagagcacttacctagtatcttattaaagggacgaaactaagaaatgggaccctgtcacgtactcacgtccaaacatatatccatccgcagccaatgacgacacgccgggtggttcactcgctgcccggaccggaggtagctttggtgacgctggtgaagacgacactgctgccgagcaggtccttgccgatgtcggcggtgaaggtgtcgtaacggaggaagagctcgacgaggaagagcctgccaacgagcaccacaaagttcttgccggggcactgcttgttgtcgacggtggggttctcggtctcgcggccgttggaccagtagacgtactgcagcagcttgctgccctcctcgccgaggaaccggccgggcacgaactccttggccgtggcgccgaacacgcgggggtccttggtggcgcacggctggtagccgaacagcatctcgcccttcttcacctggaacacggcgtcgtggctctggacctgcaggtctttcttggcgtggccgtactggaacttgacgggcgggtccaggcgcagcgactcccacacgaccgacttggccagctccatcttctccaccgccgcgagggtgaccttgccgccggcctcggccacggcgcctcgaatctcagccaccagccgctcgtggagcttctcgccggcgctggcgacgttggccaggatgcccgggaacagcaccttgaggccgccgtagctgttgaaggtggtggcgaagaggaggttgtggcaggcctcctcgcgcgacaggcccaggccctcggcggtgtccagcgcctgcttcgccaccgtggagaagtacttgtacagcgtcccgtagtcgccgctgacgaggatgggcgggaggtgcacggtgtggaggagcggctcctcgaggaccatggggaggccgagcgtcacgagcgggtggagctggaatatgagccacttggcggccttggtcgggccggtggtgcctaggtcagacgcggaggggagcacgccgaagtaggcgtcgccgatgaactcgaaggaggtggcgtcgttgagcgtgttgaagttggacttcttgctgagaacgggctgcgactcgacggtggcgaggagcgaggagaagtgggagcggaaggccgggatgaaggcgtccttgcgggaggcgaggagggagaagagcagctgcttgaccttggtgtgggtgggctcggaggggtcgaggtaggagcagacgcggaagccgccggtgagggaggtggagggcatgtaggtgccggtgaagaggttcttcttctcgaccttgtcgacgtcgaagagcacggggaagctcttggcgtcgagcacggcgaccacgcgcgggtcgcgcgccatgaacgggcccggcgggacgttgatgcggacgacggtggagccgtacttgtcgacgcgggactcgaagtacttgtcctggccctggaagtagtagaagtcgaggcggtcgcggatggccgagacgaacggcatgccgtagctgcccggcacctcccgcggcaccagggagccctcgtcgccgcctgccatgccgctccggttcgtctagctctgctgctggctggtttggtttggaactctggatctcgcgctctcgatgcagacaagattggagcgaggaggctttgtctgtgtgttgcgattttttttttttttttttttattttttcccggggcccggcc

SEQ ID NO: 1028 - DNA, 2492 bp, Zea mays
  Clone ID: PAT_MRT4577_136626C.1
atgaaaggcaaggctgctaagggattatagatttcttgggaaagataagatttttttttggggagcaatttatgcaacatgccatcctgcattataattattacaaaagcgacaaacacctccaatcacacgtgaaggtggggccgagggtgagagagaagtcttattagaaggaaggaggaaaatgacgaaattaagaaataatgggacactctgtcacgtccactcatcatatatccaacgacgcgcgccggccgggcggtttactcgctgcccggaccggaggtagctttcgtgacaccggtgaagatgacgctggtgccgagcagctccttgccgacctcggcggtgaatgtgtcgtagcggaggaagagctcgacgaggaggagcctgccgacgagcaccacgaagttcttcccggggcactgcttgttgtcgacgctggggttctcggtctcgcggccgttggaccagtacacgtactgcagcagcttgctgccctcctcgccgaggaagcggtcgggcacgaagtccccggcggtgtcgccgaacacgcgggggtccttggtggcgcacggctggtagccgaacagcatctcgcccttcctcacctggaacaccgcgtcgtggctctccaccagcaggtccttcttggcgtgcccgtactggaacttgacgggcgggtccaggcgcagcgactcccacaccaccgacttggccagctccatcctctccaccgccgcgagggtgaccttgccgccggcgtcggccacggcgccgcggatctcggccaccagccgctcgtggagcttctcgccgccgctggccacgttggccagcaggcccgggaacagcaccttgaggccgccgtagctgttgaaggtggtggcgaagaggaggttgtggcaggcctcctcgcgcgacaggcccaggccctcggcggtgtccagcgcctgcttcgccaccgtggagaagtacttgtacagcgccctgtagtcgcccttgacgaggaaaggcgggaggtggaacgtgtggagcagcggctcctccaggaccatggggaggccgagcgtgaccagcgggtggagctgccagatgagccacttggccgccttgctcggcccgcccttgccgagctcggtcgccgaggggcgcacgccgaagtaggcctcgccgatgaagtcgaaggaggtcacgtcgttgagcttgttgaactcggccttgccgcccttggccagctccgactcgacggtggcgaggagcgaggagaagttggagcggaaggtggggatcacgtcgtccttgcgggagagcaggagggagaagagcagctgcttcaccttggtgtgggtgggctcggaggggtcgaggtaggcgcagacgcggtagccgccggtgagggaggtggacggcatgtaggtgcccgtgaacaggtccttcttctccaccttgtccatgtcgaagaggacggggaagctcttggcgtccaggaccgccaccacccgcgggtcgcgcgccatgaaggggcccggcgggacgttcatgcgcaccacggtggagccgtagcgctccacgcgggactcgaagtacttgtcctgcccctggaagtagtagaagtcgaggcggtcgcgcacggcgcccaccagcggcaggccgtagctgcccggcacgtccctgcagggggcgctactgaaaccacgaacggaggtcgccatagaggaggctcgcaacaagttgcttcttccccggcaatggatcgcgctctgggtgcagttgctcaaattcgtcggtttgaaggcttacgaagaaggactggaggaggcgttgttacaggctccagtcatccatagcaatatcaaaatcttccctcttcttgtcacccaaaccagttcttatgggtgctagccacatccgagcatggctaggatacatcacaccatctggcttcaaccagcggtcacgtgcgcaaatgacggaatcaaacatggactctctcaaaagaaagtagcccatccactctgatataatgacatcaactttctccggaaggtcaacgtcttccacggtgccctgtatcacctcaacgatatccgtgacgccgttggcgcgagcaagctcgcgcgcgtgctccgccatgttagtcgcctcgacggcgtacaccttcctggccccggcctgcgcgctccagatagcaaggatgccgctcccggtgcccacgtcaaggaccaccttgccctggaagtggggcgcgttgcggaagacggcggagtggtacgcgtccatgcggacgcggtcgcagagcatctccttctggtggtaaaggtaggcgtacgtgcagaagtagttggcgaagtccacctccttgtccacagggcgcgcgccgcatgagccagaggcgtcggcgccgccaccgttagggagagacgccattgggtggaggcgggagggaggcggggagattgcggagagggttctgggtgagcaagtgcttt

SEQ ID NO: 1029 - DNA, 2402 bp, Zea mays
  Clone ID: PAT_MRT4577_136628C.1
gcggtacgggccatcccggacggccatagactcagagccacggcgtgcaggcgggcgggcgggcgagcgagcgagaggaaaagccaaggcggcagcagtaggcagccaccatcaataaagaaggccctacgcctcgctggagcgcaaggtgggggccccccgggccgggggggaaattcaccaaaccgaaatggccatggccaaccggcttagattgccgcttccccagtgcctcttcttgctgcattgctacgtcgttgttgcgattgtagcacacccgtccagcccagagcaagcatcccccaaggcgaaccaacatcctctatcatacaacaacctacgaccagaagattttccaaacgatcggctctaccgcgcttaccacgccattcaaagcttcaagagcacgatcacttcggatcccaagaacatcaccggcacgtgggccggcaacgacatctgcggcgagaagagctacgtcggcttctactgtgcaacaccgaccagccgagctaaggagctcacagtgacggcagtagttctcaatggcttcggtctgcgtgcaccgaagctgcaaggcttcgtcgaccagctccccgacgtcgcactcttccatgccgcctccaacaacttcggcaacggcggcatcccccgactcacaggccttgaatactcgtacgatcttagcgtcgacgacaatactgacctccaagttcaggactattctgaagttactgggagagctagagccaacattcactgtgttgctggaatgatcgagttaagatttcgtttgggaactggccctgataagggaggaggcatcattcctggagtcgcggatggcaaggctctactgttgaactacaacgacctgtccgggcaacttcctgcagatcttggcttctccaaactgagcttcctcgccctggccaacaacaggctaacaggcccaatcccgccatcagtagcgcaactgaaagactcccttctcgaggttctcctcctgaacaaccagctctccggctgtctcgcccccgagctcggcatgctcgccaaggcggcggtcattgacgccggcatgaaccagctcaccggcccgatcccgtcgtccttctcctgcctcatcagcgtcgagcagctgaacctggccggaaaccgcctctacggccacgtacccgacgcgctctgcaggctcgccgggcctgccggccgactcgccaacctcacgctgtccggcaactacttcacctccgtcgggccggcgtgcgcggcgctgataaaagatggcgtgctgaacgtaaagagcaactgcattcctgggctcgccaaccagaggcgcccggaggagtgcgctgcattcatccagagtcggccaaagacttgcccggccgcggcaaccactgagacgacgtgccccgccccagctgccaatgatgcggtggcgcagggggtgaggaaggtcagggactacttcagctatgtgacgtacgctacactgcatgagtgagctgtgtcggcatgagtaggagacaagtgcctcgatagtattttggctaattgttccagtactgtattcatgatgtgcacactgctctgtactactggtgtgcatgtgattgttgtacattatttgctcttcacgtgtgttgctgtcacatctagatgccaaggcggcagcagtaggcagccaccatcaataaagaaggtccgaaccaagcatgtcgggggtgtgggtgttccggaacggcgtggtgaggctggtggagaacccgacgtcggggaacgcggcggcggcgccgggcaagcgcaaggcgctgctgcacacgccgtccggggaggtggtcacgtcctacgcctcgctggagcgcaagctggcggcgctcggctgggagcgctactacgccggcggcggagacggcggcggcgccggcctgctgcagtaccacaagcgcacctccgtcgacctcatctcgctgcccaaggacttcgcccacttcggctccgtccacatgtacgacatcgtcatcaagaaccgcgacgccttccgcgtcatcgacgcctaattataagctagcggatgcagcagatgacagatactcacctctcctcgctcgctcctcgctccggccagtgcatcatctacctcgctgtagctacctacctaccctaatataatagcagctatagccttcgtcacccattgctcgatcgatttagttgccgtgtcgatctcagtgccgcgttggtctaaattaatatatatagatcatgtactgatgatttggtttgttcatgcatgttttctctattttacatctagtttgtgttgctgggtcctctgctttgtattcttcttcctcgcatcagtttcatcatctcctgccctgtgacccagctgc

SEQ ID NO: 1030 - DNA, 347 bp, Zea mays
  Clone ID: PAT_MRT4577_136636C.1
tgggtacctcgaggccggccgggattgtatccttaaccatttcttttttttttgacaacagcatctcaagccaccatcgatctgcaagtctcgctacgtagcagtgcaataaaaaaagcagccgcaatggcgagcagcaccatgggcctctcctccacggacttctccggcaagggcgtgaacgtgacgtcgtcgtcagacttcggcgaggtccgagcgacgatgcgcaagacttcgttgaaggccaagccagcgggggcgtccggtagcccgcggtacggccccgaccgcgcgctgtatctgtggccactgtcgggtgagcctacgacgtagctgtcgggaaaatt

SEQ ID NO: 1031 - DNA, 1946 bp, Zea mays
  Clone ID: PAT_MRT4577_136696C.1
ggggtgccccttttattgggatgtctcgatacttaggtagactataactttgggtagaaatttacaaatcacagatggggttcaatgttaatagttacgttccagaattaagatcactctgttataattttatcgattatttccatcattggcttggttaagccagcaccaaacagcaggacaggcgcttatttctcaacagggcaagactcgtgcttaagcgatctagaagattcacaatttatggatggttttcatgtctgctgccccctgcagagtcccttgctcgacatgatcccaccagcccatgagaaagttgtccaccaccagcctgaaccaaggggagagcttaacgccatcttccccggcatcagctttcctgagcagctccttcagctgatgccggttcatgtacttgacgtctgccaccttttcaggattcgggtcgagcttcacgtcacgaaccatgaacaagagggaatccaacttcgtgttcgccccattttccatctgaaggagccttgtaaagcatcctcccaagcggaatgaactggtcgacaggtaattcgtcagccactattcccagctcatcaaatagtttgcgctgggctgcatttctcacccctgaacagaataagagatggcgactgcacaattttcctcaatcaactctgactcgcggtagagaggatggctacagcaggtgtttgtccagacaagtggaaatgtcacttttgttgcagacctttgctgtagtagcaactcatatttggagttgaaaaggaaaacactgaaagctctgtgcagggcatttccagcttctatcttctccatgagatggcagttatacttggactcgtggccgatgacattgtcttgacaaacacctgctgtagccatcctctctaccgcgagtcagagttgattgaggaaaattgtgcaggggtgagaaatgcagcccagcgcaaactatttgatgagctgggaatagtggctgacgaattacctgtcgaccagttcattccgcttgggaggatgctttacaaggctccttcagatggaaaatggggcgaacacgagttggattacctcttgttcatggttcgtgacgtgaagctcgacccgaatcctgaagaggtggccgatgtcaagtacatgaaccggcatcagctgaaggagctgctcaggaaagccgatgccggggaagatggcgttaagctctccccttggttcaggctggtggtggacaactttctcatgggctggtgggatcatgtcgagcaagggactctgcagggggcagcagacatgaaaaccatccataaattgtaaatcttctagatcgcttaagcacgagtcttgccctgttgaggaataagcgcttgtcctgctgtttggtgctggaggaataatcgataaaattataacagagtgatcttaattctggaacgtaactattaacattgaaccccatctgtgatgtgtaaatttctacctaaagaccaaagaaaaagggggcacgccattaggttaggcaaattgatacatactaaaaggcaaaggccaaattggaagtgtcttgttcatccactaaaatgcactcgtcctcaaacatgagccgccgctggacggcgtccatcccggcgtcggcgtcaacgaccccggggcctggcttccccatcacggcgccccctgcggaggcggcgaacgagcggagcccgcggagcttggggagggccgacccagccgaagaggaagagacagccaagcgagcccacgaccgctgcccgacgccgagcgatgccgaggcagacgcgacgagcgcgagggatcgcgccgccgatgacgccatgaggggagggatggtcgcacggccacgcctggatttggtgagccgggcaactggtctggtcgtgctgttcggtgcgaccgaccatcccggccgg

SEQ ID NO: 1032 - DNA, 495 bp, Zea mays
  UNSURE (1)..(495): unsure at all n locations
  Clone ID: PAT_MRT4577_136782C.1
  unsure (1)..(495): unsure at all n locations
tccggccgaagnngatnttccccacccattcctcgcctgcgctccctcgccgccccagttccccaccccctgctcacccacccgtcccctcctgctcgcccatggctcccatcgctgtcggcgacgccctccccgacggccagctcgggtgggtcgacgagaacgaccagctgcagcaggtgtccgtccacgcgctcgccgccggcaagaagggcatggtgggtgggggttcccggggcctttaccccgacctggaggaaccagcatgtgccagggttcatcacacaggctgagcaactcaaagccaagggggtagacaagataccgcttatcagaggtaacgacccccttgtcatgaaggcgggggcgaagacctaccccgagaacaagcacgtgaagtttcttgccggcggatctggaggggacaccaaagcggcttgacttaagcttgatttcaccgacaaagggctgggcgtgggctcgaaaaaggttggt

SEQ ID NO: 1033 - DNA, 3236 bp, Zea mays
  UNSURE (1)..(3236): unsure at all n locations
  Clone ID: PAT_MRT4577_136850C.1
  unsure (1)..(3236): unsure at all n locations
aagtagggttaggaaggcggcggccagcggcgagaggaggaggggtgggtcagccatgacggggaaggcgaagccgaagaagcacacggcgaaggagatcgccgcgaagatcgacgcggcgacgacgaaccggggcggcggcaaggccgggctggcggaccggctggggcaggacaagggcgggcatgcgaagctggcgtgcccgctctgccgcaccccggcgcccgacatcaagtccatgcagatccaccacgaggcgcgccaccccaagctccccttcgagccggagaagctcctcaacctgcactcctccgcccccgctgctgctgttgccgtcgccgtcgacgtcgtcgccgctgccgaggccaccacctccaagcccaagcccggcgaattcggcacccgggagcgacgaagccaaaggaacacaccagcgcgcacgcacgcgcagcgtccggcgggcatcaccacctcctgtcctcctccctcctgccccgatccgccctccccgccgctcgccgcacccgatgtcggccgccgacccttccgcggctccggccgcggccgccgacccggacggccctgactccgtgcggctcacctggaatacctggccacggtcaaaggtcgaggccagccgctgcgtcgtgccgctcgccgccaccatctcgcccactcgcgtcccggatccctccgcggcatccccgccgccgctcccttaccctccgctccgctgcaagcctccctgttccgcgctcctcaaccccttcgcgcgcgtagacttcgctgccaagatctggatctgcccgctctgcttctcccggaaccactttcccccgcactatgctgccatatctgagtccaacgtccccgccgagctcttcccgcagtgctccaccgtcgactacatcgtcggcggagccggcatccctggggtaggcggcgcgccgccgcccccgccgcccgtatttctcttcgtcatcgacacctgcgtcatcgaggaggagctggagtacgttaagatggccatgcggaaggccgtcgcgctcctgccggagcacgcactcgtgggcctcgtcaccttcggcacgcaggtgcacctgcacgagctcggattctccgatctcagcaagatctacgtcttccgggggaccaaggagatctctaaggaccagattttggatcagcttggcctggcgggtgctgggcggccgggcttccccaagatgccacagcaaccgggcgggccacaggtgaatgggatgcatccgccgtccacggccggggtcaacaggttcctgctcccggtgtcagattgtgagattgctctcagcacgttgctggacgagttgcagcctgaccaatggccagtcgaggctgggaaccgtgcgatccgttgcactggtgttgcgctcagtgtagctgctgggttacttggtgcttgcatgcctggaacaggtgcaaggatcatcgcattgctaggtggtccgtgtactgagggacctggaatgattgtttcaaaagatttgtcagaaccagttagatcacataaggatcttgacaaggatgcagctcctcacttccagaaagcagttaaattttatgatggtcttgctaagcagttggtcagtcaaggtcacgtgttagatgtttttgcttctgctctcgatcaggttgggctagctgagatgaaggttgctattgagagaacaggtggccttgttgtcttgtctgaaagttttgggcattccgtattcaaggattctttcaaacgcatttttgagggaggtgaacagtctctaggactttctttcaatggcataattgaaataaactgttcaaaagatattaaagtccaaggtattattggaccatgcacatctttggagaagaaaggagccatgtgctctgacacagttgtcggtcaaggaaatacatcagcatggaaaatgtgtggtctcgatagaaatacttctcttacagtattttttgatgtctcaccgagtgaacgatcgagccagccaggaaaccaaaatccccatttgtatatacaatttgtgacaagttaccaacacccagaaggtcaaatgaggataagagttactacgatatgcaggaaatgggtagatggttccactaataccgaggaattagttgaaggttttgaccaggaaactgcagctgttgtgttggcaagatacatctctttgaaaatggagatggaggaagagttcgatgcaacccggtggcttgatagatctctcatacgtctttgttcaagatttggggattaccggaaggatgatccctcttcatttagcctgcattcaaatttctcattgttccctcagtttatgtttaatcttcggcgttcacaatttgttcaggttttcaataacagtccagatgagacagcttatttcaggatgttactcaatcgtgagagtatcactaactcggttgccatgatccagccttccttgatatcattttcttttgattcacctccatctccggtatttctagatgtggcatcaatagcagcagatcgtatactgctacttgatgcgtactttagtgttgtcatttttcatggaatgacaattgctcagtggagaaacatgggttatcagaaccaacctgagcatgagcaatttgcacaactattacaagcaccacatgaggaggcacaaatgataataaagggtcgatttccagttccaagactagttgtctgcgaccaacatggctcgcaggcaaggtttttgttggctaagctgaatccatcggccacatataactcagctcatgatgttgctcctggttctgacatcattttcaccgatgatgttagcttccaggtcttctgtgagcacctacaaaggctggctgttcagtcttgaggacctacctgtatgcaaaggttgtacaccctatttgatagttgctcataatgcactgggttcttaggttggagttgtgagaatttcccttttctgtttctctttggccatagttttctgagatcagacaattttttcgggaaactgccctaaaggaatgtgtaagttgcctacagaggtctattatctacatatatagtatatatacttatttatgttgacatcacccagctttcttctgcaaggtggttgcatgaattgagttgtgtgtcaagttcactttccagaaatcagaaatgtaagatcgcaaggcattatntaaaaaaaaaaaaa

SEQ ID NO: 1034 - DNA, 567 bp, Zea mays
  Clone ID: PAT_MRT4577_136888C.1
aattcggcacgagggaattatctcccctagccgccgtcgccgctcgtctccctgagaggtgccggcaccgatgaactggccgagtgctaggtccagaatccgttttgcttggctcaccacggcgtctgttgcgtctggtggtggggaaggggcgaaattcctgagagctgttccgggtcaggcgagcgagctcggcaatcacgagttgcacacatagcctctgtcgatccgaatttgatgtactactggaggctagagggggcaaaaaggctatcagtcttcggtccatgatgtatgaagctccccttgggtacagcattgaggacgttccacctgacgtaggcgtgaaaaagttccaggctgctgctgactccaactgtgcgaagaatctatcctgatattccttttgacttccttattctagctgtactatgatctcgtttatgacactttgattctgaccatatctctctggcctgctgcttcctgttaatcgaccagtttctcagatttgctccttgcactcctccctgatgcatctccagcattgtgttctgatgacctgct

SEQ ID NO: 1035 - DNA, 167 bp, Zea mays
  Clone ID: PAT_MRT4577_137243C.1
ggcagccatagaaaaggctggctacactggacaggtggtcattggaatggatgttgctgcttctgaattctgcggtgaggtagacaagacttatgatcttaatgtctaggtggctaacaacgacggctcaaacaagatttcaggcgacagctgcatagacctggaca

SEQ ID NO: 1036 - DNA, 721 bp, Zea mays
  Clone ID: PAT_MRT4577_137379C.1
aaccccgcacctcctccaaacgcgtattgcctcctacgcccccggatccgctgctccaccccccaactccgttgccacacgcccttgcacaagcgagcgagcaaccatgtcgccggcagagccgacgcgagacgagagcgtctacatggccaagcttgcggagcaggccgagcgctacgaggagatggtggagttcatggagcgcgtcgcgaaggccaccggcggggcagggcccggggaggagctatccgtcgaggagcgcaacctgctctctgtggcttacaagaatgtcatcggggcccggcgcgcgtcctggaggatcatctcctccatcgagcagaaggaggaaggtcggggcaacgacgcgcacgccgccaccatccgctcctaccgcagcaagatcgaggccgagctcgcaaagatctgcgacggcatcctcgccctgcttgattcccacctcgtgccatccgccggagctgccgagtccaaagtcttctatctcaagatgaagggcgactaccacaggtaccttgcagagtttaagtccggtgggggagaggaaggaagccgccgagagcaccatgaacgcgtacaaagctgctcaggatatcgccctagcagatttggctccaacccaccccatcaggcttgggcttgccttcaacttttctgtgttctactatgagatcttgaactcccctgaccgcgcctgcaaccttgc

SEQ ID NO: 1037 - DNA, 3470 bp, Zea mays
  Clone ID: PAT_MRT4577_137423C.1
aatggtagtaatatttgctgctgccaataaccagcgaggttcagtgcggccaattggttaaatggaaaaagttgttgttcatcagagtaggcagtagctagctggctgaatggtaatagttgttgctgcaaataagcagcagggttcagtgtagatagttggttgaatggaagaaattgttgttgctgatagtagggagaaaggtttgccagagctagtcggttggtcacaggcagcgatagagcacagacagtctgtcttctccccgtagcgctgtcacgatagcagccgtcagctcccggccaccaaatcctcagtagaagtcccgcaggctccaagcctcggagtgccagtagtgatagtaagctgtagcacggtgggggctcaactgaataacgtgaacgcattgccctttctgttacgtgttttattttattgtgtttctgtggtcgtatatctgttttgtgacgtgtcccttgcttctgcccatgtgaattccagaagaactatgagaaattcaggtgtggtgatcaaaaaaaaaaaaaaagggcggaactcacccccttcccttcctccgatccccccgcctcccccaaaatccgacgcgtaatcgccgccatggccgccgccggcaagctcctcctcctggtcgccgccgtcctggcggcttccctcgtcgccgacgcgcgcccgtgcggccacgcgcagacgctcctcgtctccttctcctccgtcctcaggccgaacccggaccccaccaacccgacgccgctcaccaccacagtcgtcaccgtcctccgcgtccgccgcctcggcccgcaccagatccgccgccccgtggcgctccccgccgtcgagtcggaggtcgccgcctcgtccgcccaggaccgcgccaaggacatcctccggcctcctcttatgattgggtacctcgaggccggccgggaccgacgccgaaccaaaccaacacacgtcaaagcagaaaacctcagaaaaccccaatatatcctcgtccaccactgcccccgctctgctgcaactccactcggcccggccgccctttccacccaccttgatcctctgatccgttggtgcttgaccgatccatggacacccacatcggatccgtgaacggggcggcgtcgaaccagacggttggctgcccggcgtcggcgccggggtgcccgatggcgtccacgccggcgcagcccgcggcgaccctgtcggcgggggaggcgtcgctggggcgccacctcgcgcgtcgcctcgtgcaggtcggcgtcaacgatgtattcgcggttccgggggacttcaacctcacgctgctcgaccacctgatcgccgagcccggcctgcgcctcgtcggctgctgcaacgagctcaacgccgggtacgccgccgacgggtacgcgcgcgcgcgcggcgtcggggcctgcgccgtcacgttcacagtcggggggctcagcgtgctcaacgccatcgcgggcgcctacagcgagaacctgcccgtcatctgcatcgccggcgggcccaactccaacgactacgggaccaaccgcatcctccaccacaccatcggcctccccgacttctcgcaggagctccgctgcttccagaccgtcacctgccatcaggcggtggtgaacaatctggatgacgcgcacgagcagatcgacacggccattgccacggcactgagggagagcaagcccgtgtacctcagcatcagctgcaacctccctgggctgcctcatcctaccttcagccgcgacccagtgcccttcttcctcacccccaggacgagcaacaagatggggctagaggctgcagtggaggcaactgtcgaattcctgaacaaggcggtgaagccagtccttgtcgccggccccaaactgcgtgtggcaaaggcaggaaaggcatttgtcgatatggtagatgccagtggctatgcctatgccgtgatgccatcggccaagggtcttgtgccagagactcacccccacttcatcggcacctactggggcgccgtcagcaccgccttctgtgcggagattgttgagtccgcagatgcctacctctttgcaggccccattttcaatgactacagctctgttggctactcattcctcctcaagaaggaaaaggccatcatcgtccagcctgagcgtgtgatagtggggaatgggccggcattcggatgtgtgatgatgaaagagttcttgtctgaattggctaagagggttaataagaacaccactgcctatgagaattacaagaggatctttgtacctgagggccagccgctggaaagcgagccaaatgagccactgcgagtgaatgtgctcttcaagcacgtccagaagatgttgactggtgatagcgcggtgattgctgagactggtgactcctggttcaactgccagaagcttaagctgccagaaggctgtgggtatgaattccaaatgcagtatggttcgattggatggtcagtgggtgcattgctcggatatgctcagggtgcgaaccacaagcgtgtgattgccttcattggtgatgggagcttccaggttacagcacaggatgtgtcaactatgctgcgatgtgagcagaacagcataatcttcctgatcaacaacggtgggtacacgattgaggtggaaatccatgacgggccatacaacgtcatcaagaactggaactacactggctttgtggacgccatccacaatggcttgggcaagtgctggacctccaaggtgaagagcgaggaggagctgacggctgccattgagacagcgctaggggagaagaaggactgcctgtgcttcatcgaggtgatcgcgcacaaggacgacaccagcaaagagctgctggaatggggctctagggtttctgccgccaactcccggccaccaaatcctcagtagaagtcccgcaggctccaagcctcggagtgccagtagtgatagtaagctgtagcacggtgggggctcaaccgaataacgtgaacgcattgccctttctgttacgtgttttattttattgtgtttctgtggtcgtatatctgttttgtgacgtgttccctgcttctcccatgtgaattccagaagaactatgagaaatttcaggttggttgtcactaaaaaaaaaaaaaaaaaaaaaaaaaaaaaaaaaaaaaaaactgtgttgtcactatttgtgctgcgttaccggtgtgattttactgatcaggtaaacatcgccggccagggagtgaatcaagcgttttagatgagcccgtcgatcggttttgagggttcctgcaaaggggcctgggtttgggtctgtctcccctgaaattttttcgggtggtttactcgttttcagtcagttactcagtttgtccgtttttgtcgagcaaaactacatccctgctgagggaagctgcccatttttttcctccgatgaaaaagtttgcaatttcccttgct

SEQ ID NO: 1038 - DNA, 610 bp, Zea mays
  UNSURE (1)..(610): unsure at all n locations
  Clone ID: PAT_MRT4577_137441C.1
  unsure (1)..(610): unsure at all n locations
ccggtgccgggaattcccggggtcgacgccagcgggcgcatcttttctcgtgtanaacctctaaaatttcccccactcgccagtcgcatcagcacctgtagcagccatggacgccatcggagccgggagcaaggggaataaggggcgggcgggcgcaagggaggcgggcccatgaagaagtgggggacgcgggccgtcaaggccgggctgcagttccccgtggggcgggatcgggcgctacctcaagagagggcgggacgcgcatcgcgtgggcactggggcccccgtgtacctcgccgccgtgctggagtacctcgccgccgaggggctggaggtggcagggaacgcggggaaagacaacaagaagacgcgcatcatcccgcgccacgggctcctggggatccgcaacgacgaggagctcgggaagcggctgggcggggtgaccatcgggcacggcggggtgctccccaacatccactccgtgctcctgcgcaagaaggcggcgggagaagcgggcagcggggggagcgaggagcccaaggcccccaagaaggggccaaggcccccaagaagggtanaaagtggggtcttcatttgcgctgtgtgctgt

SEQ ID NO: 1039 - DNA, 305 bp, Zea mays
  Clone ID: PAT_MRT4577_137459C.1
aacctcaactcacacgtctgatacggtctgggacagctccctcacgcctttgcccgcctgagcgctgttgtacgtggcacgtacatgctgtcacaagccatagtgcaaagtcgagtttggtggtattggtaaatcgtatggggtcacttctgagcgggagaccgccagatgcatgaagatcatctgcgatccttcgtatttgccatgcaaggtgaagaaagttggaagggtggcccacgccatatgcatcactaagcatccgatcccggacaccattgactcgcactccgtgcagatcatcctcc

SEQ ID NO: 1040 - DNA, 319 bp, Zea mays
  Clone ID: PAT_MRT4577_137464C.1
ccagcagcaccaccactgcgcggcattgcagcgagcgagcgggagggatctggggcatggtggcggtcgctgccgctgccgctcggatctagaggggcggacggtatccgccggcctcgtcggtgtcggtgtcggtgtcggtggagtgtgaatcggtgtctgtaggaggagcgcgaagatggcggccaacaaggggatggtggcaggctctcacaaccgcaacgagttcgtcatgatccgccacgacggcgacgcgcctgtcccggctaagcccacgaagagtgcgaatgggcaggtctgccagatttgtggcgacact

SEQ ID NO: 1041 - DNA, 4124 bp, Zea mays
  Clone ID: PAT_MRT4577_137469C.1
aagaggaatcgaagcagcagcagcaccaccactgcgcggcattgcagcgagcaagcgggagggatctggggcatggtggcggtcgctgccgctgccgctcggatctagagggccgcacgggctgattgccctccgccggcctcgtcggtgtcggtggagtgtgaatcggtgtgtgtaggaggagcgcggagatggcggccaacaaggggatggtggcaggctctcacaaccgcaacgagttcgtcatgatccgccacgacggcgacgcgcctgtcccggctaagcccacgaagagtgcgaatgggcaggtctgccagatttgtggcgacactgttggcgtttcagccactggtgatgtctttgttgcctgcaatgagtgtgccttccctgtctgccgcccttgctatgagtacgagcgcaaggaagggaaccaatgctgccctcagtgcaagactagatacaagagacagaaaggtagccctcgagttcatggtgatgatgaggaggaagatgttgatgacctggacaatgaattcaactataagcaaggcaatgggaagggcccagagtggcagcttcaaggagatgacgctgatctgtcttcatctgctcgccatgacccacaccatcggattccacgccttacaagtggacaacagatatctggagagatccctgatgcatcccctgaccgtcattctatccgcagtccaacatcgagctatgttgatccaagcgttccagttcctgtgaggattgtggacccctcgaaggacttgaattcctatgggcttaatagtgttgactggaaggaaagagttgagagctggagggttaaacaggacaaaaatatgttgcaagtgactaataaatatccagaggctagaggagacatggaggggactggctcaaatggagaagatatgcaaatggttgatgatgcacgcctacctttgagccgcattgtgccaatttcctcaaaccagctcaacctttaccggatagtaatcattctccgtcttatcatcctgtgcttcttcttccaatatcgtatcagtcatccagtgcgtaatgcttatggattgtggctagtatctgttatctgtgaggtctggtttgccttgtcctggcttctagatcagttcccaaaatggtatccaatcaaccgtgagacatatctcgacaggcttgcattgaggtatgatagagagggagagccatcacagctggctcccattgatgtctttgtcagtacagtggatccattgaaggaacctccactgatcacagccaacactgttttgtccattcttgctgtggattaccctgttgacaaagtgtcatgctatgtttctgatgatggctcagctatgctgacttttgagtctctctctgaaactgccgaatttgctagaaagtgggttcccttttgtaagaagcacaatattgaaccaagagctccagaattttactttgctcaaaaaatagattacctgaaggacaaaattcaaccttcatttgttaaggaaagacgagcaatgaagagagagtatgaagaattcaaaataagaatcaatgcccttgttgccaaagcacagaaagtgcctgaagaggggtggaccatggctgatggaactgcttggcctgggaataaccctagggaccatcctggcatgattcaggtgttcttggggcacagtggtgggcttgacactgatggaaatgaattaccacgtcttgtctatgtctctcgtgaaaagagaccaggctttcagcatcacaagaaggctggtgcaatgaatgcactgattcgtgtatctgctgtgctgacaaatggtgcctatcttctcaatgtggattgtgaccattacttcaatagcagcaaagctcttagagaagcaatgtgcttcatgatggatccagctctaggaaggaaaacttgttatgtacaatttccacaaagatttgatggcattgacttgcacgatcgatatgctaataggaacatagtcttctttgatatcaacatgaaaggtctagatggcattcagggtccagtctatgtgggaacaggatgctgtttcaataggcaggctttgtatggatatgatcctgttttgactgaagctgatctggaacctaacattgttgttaagagctgctgtggtagaaggaagagaaagaacaagagttatatggatagtcaaagccgtattatgaagagaacagaatcttcagctcccatctttaacatggaagacatcgaggagggtattgaaggttatgaggatgaaaggtcagtgcttatgtcccagaggaaattggagaaacgctttggtcagtctccaatcttcattgcatccacctttatgactcaaggtggcataccaccttcaacaaacccagcttctctactgaaggaagctatccatgttatcagctgtgggtacgaggacaaaactgaatggggaaaagagattggctggatctatggttcagttacagaggatattctgactgggtttaaaatgcatgcaagaggctggcaatcaatctactgcatgccaccacgaccttgtttcaagggttctgcaccaatcaatctttctgatcgtcttaatcaggtgctccgttgggctcttgggtcagtggaaattctgcttagcagacattgtcctatatggtatggctacaatgggcgattgaagcttttggagaggctggcttacattaacaccattgtttatccaatcacatctgttccgcttatcgcctattgtgtgcttcctgctatctgtcttcttaccaataaatttatcattcctgagattagtaattatgctggaatgttcttcattcttctttttgcctccattttcgcaactggtatattggagctcagatggagtggtgttggcattgaagattggtggagaaatgagcagttttgggttattggtggcacctctgcccatctcttcgcggtgttccagggtctgctgaaagtgttggctgggattgataccaacttcacagttacctcaaaggcatctgatgaggatggcgactttgctgagctatatgtgttcaagtggaccagtttgctcatccctccgaccactgttcttgtcattaacctggtcggaatggtggcaggaatttcgtatgccattaacagcggctaccaatcctggggtccgctctttggaaagctgttcttctcgatctgggtgatcctccatctctaccccttcctcaagggtctcatgggcaggcagaaccgcacgccaacaatcgtcatcgtttggtccatcctccttgcgtctatcttctccttgctgtgggtgaagatcgatcctttcatctccccgacacagaaagctgccgccttggggcaatgtggtgtgaactgctgatccagattgtgactcttatctgaagaggctcagccaaagatctgcccccctcgtgtaaatacctgagggggctagatgggaattttttgttgtagatgaggatggatctgcatccaagttatgcctctgtttattagcttcttcggtgccggtgctgctgcagacaaaatcatggagcctttctaccttgcttgtagtgctggccagcagcgtaaattgtgaattctgcattttttttatacgtggtgtttattgttttagagtaaattatcatttgtttgaggtaactattcacacgaactatatggcaatgctgttatttatacgcaaagactgatacattcttcggattgtgagcaaacagtcagaacactgtaatctcttaggacaactatataaggcagctgttgtatcatctctattgtttctaatggccgagggatatgtagatgtaaatcacttgcaacatcgtattgttggcagtctgtaatgtttgaaaagcatggagggactgatgcggcgtggtctttcatgaattggggaatcagatggcagtccggtagaacttctgctaccgtattttctgatggcattacctttccagctccaccaactgttcgtgtcgtttttgttggatatttaacctagtttaggtatgtctgatttaagaaatctaaattatgtctatacatttgaggatttctagat

SEQ ID NO: 1042 - DNA, 3958 bp, Zea mays
  Clone ID: PAT_MRT4577_137470C.1
gccggccgggccggggtgaagcggaagcagcagcagaagcactgcgcggcattgcagcgatcgagcgggaggaatttggggcatggtggtcgccaacgccgctcggatctagaggcccgcacgggccgattggtctccgcccgcctcgtcggtgttggtgtcgttggcgtgtggagccgtctcggtgggagcagcggggagggagcggagatggcggccaacaaggggatggtggcgggctcgcacaaccgcaacgagttcgtcatgatccgccacgacggcgatgcgccgggctcggctaagcccacaaagagtgcgaatgggcaggtctgccagatttgtggtgactctgtgggtgtttcagccactggtgatgtctttgttgcctgcaatgagtgtgccttccctgtctgccgcccatgctatgagtatgagcgcaaggaggggaaccaatgctgcccccagtgcaagactagatacaagagacagaaaggtagccctcgagttcatggtgatgaggatgaggaagatgttgatgacctagacaatgaattcaactacaagcaaggcaatgggaaaggcccagagtggcaactgcaaggagatgatgctgatctgtcttcatctgctcgccatgagccacatcatcggattccacgcctgacaagcggtcaacagatatctggagagattcctgatgcttcccctgaccgtcattctatccgcagtccaacatcgagctatgttgatccaagcgtcccagttcctgtgaggattgtggacccctcgaaggacttgaattcctatgggcttaatagtgttgactggaaggaaagagttgagagctggagggttaaacaggacaaaaatatgatgcaagtgactaataaatatccagaggctagaggaggagacatggaggggactggctcaaatggagaagatatgcaaatggttgatgatgcacggctacctttgagccgtatcgtgccaatttcctcaaaccagctcaacctttaccgggtagtgatcattctccgtcttatcatcctgtgcttcttcttccagtatcgtgtcagtcatccagtgcgtaatgcttatggattatggctagtatctgttatctgcgaggtctggtttgccttgtcttggcttctagatcagttcccaaaatggtatccaatcaaccgtgagacatatcttgacaggcttgcattgaggtatgatagagagggagagccatcacagctggctcccattgatgtcttcgtcagtacagtggatccattgaaggaacctccactgatcacagccaacactgttttgtccattctttctgtggattaccctgttgacaaagtgtcatgctatgtttctgatgatggttcagctatgctgacttttgagtctctctcagaaaccgcagaatttgctagaaagtgggttcccttttgtaagaagcacaatattgaaccaagagctccagaattttactttgctcaaaaaatagattacctgaaggacaaaattcaaccttcatttgttaaggaaagacgcgcaatgaagagggagtatgaagaattcaaagtaagaatcaatgcccttgttgccaaagcacagaaagtgcctgaagaggggtggaccatggctgatggaactgcatggcctgggaataatcctagggaccatcctggcatgattcaggttttcttggggcacagtggtgggctcgacactgatggaaatgagttaccacgtcttgtctatgtctctcgtgaaaagagaccaggctttcagcatcacaagaaggctggtgcaatgaatgcgctgattcgtgtatctgctgtgctgacaaatggtgcctatcttctcaatgtggattgcgaccattacttcaatagcagcaaagctcttagagaagcaatgtgcttcatgatggatccggctctaggaaggaaaacttgttatgtacaatttccacagagatttgatggcattgacttgcacgatcgatatgctaatcggaacatagttttctttgatatcaacatgaaaggtctggatggcattcagggtccagtttacgtgggaacaggatgctgtttcaatagacaggctttgtatggatacgatcctgttttgactgaagctgatctggagccaaacattgttattaagagctgctgtggtagaaggaagaaaaagaacaagagttatatggatagtcaaagccgtattatgaagagaacagaatcttcagctcccatcttcaatatggaagacatcgaagagggtattgaaggttatgaggatgaaaggtcagtgcttatgtcccagaggaaattggagaaacgctttggtcagtctcctattttcattgcatccacctttatgacacaaggtggcataccaccttcaacaaacccagcttctctactaaaggaagctatccatgtcatcagttgtggatatgaggacaaaactgaatggggaaaagagattggctggatctatggttcagtaacggaggatattctgactgggtttaaaatgcatgcaaggggctggcaatcaatctactgcatgccaccacgaccttgtttcaagggttctgcaccaatcaatctttccgatcgtcttaatcaggtgctccgttgggctcttgggtcagtggaaattctgcttagtagacattgtcctatctggtatggttacaatggacgattgaagcttttggagaggctggcttacatcaacactattgtatatccaatcacatccattccgcttattgcctattgtgtgcttcccgctatctgcctccttaccaataaatttatcattcctgagattagcaattatgctgggatgttcttcattcttcttttcgcctccatttttgccactggtatattggagcttagatggagtggtgttggcattgaagattggtggagaaatgagcagttttgggttattggtggcacctctgcccatctcttcgcagtgttccagggtctgctgaaagtgttggctgggattgataccaacttcacagttacctcaaaggcatctgatgaggatggcgactttgctgagctatatgtgttcaagtggaccagtttgctcattcctccgaccactgttcttgtcattaacctggtcggaatggtggcaggaatttcttatgccattaacagtggctaccaatcctggggtccgctctttggaaagctgttcttctcgatctgggtgatcctccatctctaccccttcctcaagggtctcatgggaaggcagaaccgcacaccaacaatcgtcattgtctggtccatccttcttgcatctatcttctccttgctgtgggtgaagatcgatcctttcatctccccgacacagaaagctgctgccttggggcaatgtggcgtcaactgctgatcgagacagtgactcttatttgaagaggctcaatcaagatctgccccctcgtgtaaatacctgtcacctgaggaggctagatgggaattccttttgttgtaggtgaggatggatttgcatctaagttatgcctctgttcattagcttcttccgtgccggtgctgcagcggactaagaatcacggagcctttctaccttgcatgtagcgctagccagcagcgtaagatgtgaattttgaagttttgttatgcgtgcagtttattgttttagagtaaattatcatttgtttgtgggaactgttcacacgagcttatattggcaatgctgttatttatacacaaagactacattctttggaatgtgtgcagacagtcagaacactgtaatctattagcacaactatataaggcagctgttgtatcatctctattgtttctgatgggccctggggatatgtaattgcgaatgactagcaacattatattgttggctgattatcagctgttacatgtaaatataa

SEQ ID NO: 1043 - DNA, 884 bp, Zea mays
  Clone ID: PAT_MRT4577_137504C.1
cacccatcccgcaacggacctccccccactcctccctattcctatccccccagcctccccccacgaacccacagcgcgcacccgagatccgcagccgaagcccgtgagaacagcgaagcgcgagaggaaaggcactgaactagtttgcaacaaagaagagggaaaatgtctaccgctgaggcaacccgtgaggagaatgtgtacatggccaagctcgccgagcaggctgagcgttacgaggaaatggttgagttcatggagaaggtggcaaagaccgctgatgttggtgagctcactgttgaggagcgcaacctgctctctgtggcttacaagaatgtgattggtgcccggagggcttcctggaggatcatctcctccattgagcagaaggaggagagccgtgggaacgaggcctatgttgcttcaatcaaggagtaccgtaccaggattgaaaccgagctcagcaagatctgtgatggcatcctcaagcttctggactcccaccttgtcccctctgccactgcagcagagtccaaggtgttctatctgaaaatgaagggtgactaccacaggtaccttgcggagttcaaggcgggtgctgagaggaaagaagcagctgagaacactcttgtagcatacaagtcagcccaggacatcgcgcttgctgacttgcctaccacccacccgataaggcttggacttgcactcaacttctcagtgttctactatgagatcctgaactctccagaccgtgcttgcaaccttgccaagcaggcatttgatgaagctattgctgagctggactccctcggcgaggaatcctacaagacagcaccttgatcatgcaacttcttcgtgacaacttgactctctggactctgata

SEQ ID NO: 1044 - DNA, 1808 bp, Zea mays
  UNSURE (1)..(1808): unsure at all n locations
  Clone ID: PAT_MRT4577_137832C.1
  unsure (1)..(1808): unsure at all n locations
actgcactgcctaccgaacacaactcgctagctctgcatcatccgtcgttctggtgagcgagcgagcgagtgagagacctagctagactgaccggtcgccggcagcgcaggccgagaacgaagcgcgtgtttgtgcatgagccatggcggagccagcagcagccacagcagcagccgcaggagatggacgttgatcgtaccggtggcctcgaactgcctccagggttccgcttccacccgagcgactttgagattgtcaacgactacctcacgaagaaggtgcacgacagggactacagctgcatcgccatcgcggacgccgacctaaacaagaccgagccatgggacctcccgaaagttgcaaagatgggcgagaaggagtggtacttcttctaccagaaggaccgcaagtacccgacggggctgagggcgaaccgggccactgaggcgggttattggaaggcgaccggcaaggacaaggaggtctacgatccccttgcagcggaagggctgctgctggtcggcatgaagaagacgctcgtgttctacaagggcagggctcccaggggtgacaaaaccaactgggtgatgcacgagtacaggctcgaaggcagtggtaggctccctgctagtcctgcatccgcatccggctcagccaccaacatcgctgcggccatgatgaaagcttcagcttcggcttgcaaggatgagtgggtggtctgtcgtgtgttcaacaagaccaccgggatcaagaagacggctgcgccggcataccaggtggccatggccggtgctgagatggatcagaatcagaacaacattccggccatccccatccccatgccgctgcagctgccactgcccgtgcccatgcagatgcaatttcccatcctgccagattttgccatggacccggtggccccctactaccccaacccaaatgccggcgcggggatgatgccgcctatggcattggcaggtatgggtggcgccggcgggctccagatcaacggcgctctgttcggcaatccggtgcccgcgccgctgccgatgaacttctaccaccaccagatgggcatgggggcagcagctggccaggtggacatgggggcagcggctggccagatggacatgggagcagctggcgctggcgctggcggcttcgacgttgcagcgccggagagtaggccgtcctcgatggtgtcacagaaggacgagcaggctaatgccgccgagatctcgtcgatgatgtctgtgaccggcccagggtccgcgaccaccaccatagagatggatggcatatggaagtacaagtactgaaaaagtggatatggagtttggagacaaatgcatgaatatgcatgttatatctactatatctgcattgcattttgtgaaaatttgcatggttcctatatttctgcaataactagtcggtaagatatgtgtgcatgcatgtgctagtatatacatgcattgtatcattgcatgtgtggtatatgtgtgtgtcgtttggtcttagtaatccggggcatgatggtacccatacctggatttacatctgcttggtcgtgctgatgttgtgttgtaatttgtaaaaagcagattgaagttcggtacagtatattatcgtgaacctatatatattatacttgtgtgaaaaaaaaaaaaaaaaaaaaaaaaaaaaaaaaaaaaaaaaaaaaaaaaaaaaaaaaaaaaaaaaaaaaaaaaaaaaaanaannnnnggaaaaaaaaaaaaaaaannggggccgatttttttttttttttttcctccaaaggttttttta

SEQ ID NO: 1045 - DNA, 3393 bp, Zea mays
  Clone ID: PAT_MRT4577_137888C.1
gtattgtcccaaacaacctcattccgttgtagccagcaaacagctagccaaaacagcagccgaacgtcggcctagttttggaatcaagtactgctgtattatatttatgttttaccagggtagatccacactgtaccttttctgttatcacccgctatgtaatatcaaaattttttattacaatgtaactagaaatttataactttgcaacaacaatgagaaacaaagaaaaactgtagtaacggcctggtgccgttgcaggcatgcagctgctggagcagtgcatttacgtgtggtcacccggcttttgcctcggaaagttggcaggcaacgaaccaagggcgtgagtcaaagcccccaaccgttcgggtgtatccgcccgcccgcccgcctagcctaggcaagcgacagacaggcagacaccactcccgcgtcccgtcctggactggactgccggaatggaatcgagtgaccagtgactgacggagggagagcaaacggcggcgaggtgaaactgaaacgaaacggaacggaacgcgttgccgctgataaaaaaggcgtcggggcaaagcgaggagcaaaagaggggggagaaaaaaaaagagggaaggagagacgtcgttttctcctgcgcgcctcgccgctgccacctcctctgttccccgcggatccttcttgacactccgtcgttgggggagccaagcgccaaaaaaaaaaaaaaaaaaaacccatctctgctgccgtgagctctttcctgcctcacactcttcttttcctactagtatttgtatttcctgccgggcggccgggcgggcgattccagcggctcaatcccagtcaatcatagagcagagcagcccgtgaccccgtgggcgtgtgctgcgactgcgaggagggaggagggaggaggaggaggaaaaagagtgccgccgtttcctgggggcagccagattccattccttgcgcaggagtactacggctactccttgtactatttcctagtagcaggctgccgtggaatcagctgcctcctgcctagagcaatgcgagattatcaacaccagcacagcctccctccctccctcggctgccttttcccactccttccagcgatcgatattcctccttccttccttccttcctcgtgaaggcgtcgagtgagtcctgcgttcttgctctcctctgctaagcacttgtcacaggaagaccccctcgtattcgcgtgctcttgccttcacacccgggacgggagttccttgctaggggagagagcttcccttgctcgtgtcctcactcactcactcattcaccgacggtcccagtggactgaggtgagacttcggtcggagccggccggacggaacatacaggatggccgccgcgccgccgcccaaggccgacgagctccagccgttcccgcccaaggagcagctgcccggcgtcgccttctgcatcaccagccccccgccatggccggaggccatcttgctagggttccagcatttcgtcgtcatgctgggcaccaccgtcatcatacccagcgcgctcgttcctcagatgggaggcggaaatgaagagaaggctcgggtggttcagaccatactgttcgttgctggcataaacaccctgttccagacgttattcgggacgcgccttccggtcgtgatgggcggctcgtacgtcttcgtcgggccgaccatctcgatcgtcttggctggacggtacagcaatgaagcagaccctcacgagaaattcctgcggacgatgagggggacgcaaggcgctctcctcgttgcgtcgacgattcagatcatacttgggttcagtggcctctggcgcaacgttgtcaaattactgagtccgctggcagctgttcctctggtatcactggtcgggttcgggctctacgagcttggctttccaggggtagcgaaatgcgtcgaagttggcctcccagaactgctcctgctggttgtgttttctcagtatctgcctcaggttctggacttcggcaagtccgtcttcagccggttcagcgttctcttcaccgtcgccatcgtgtggctgtacgcctacatcctcaccatcggcggcgcttacaagaactctccgcccaagacgcaggtgcattgccgcgttgatcggtcgggccttatttcaggagcaccttggataagtgttccctatccctttcagtggggtgctccgacgtttgacgccggagaagctttcgctatgatgatgacttcgttcattgctcttgtagagtcaactggcgccttcatcggtgcttcgagatatgcgagtgcaactatgattcctccatcgattatcagtcggggcgtgggatggcagggcattggtctgttgctcgattcatttttcgggacagcgaacgggacatcggtttcagtagagaatattggactgcttgcgttgacacgcattggcagccggagagtggtgcagatatctgcaggcttcatgattttcttctctgtccttggaaaatttggagctttgtttgcgtcgattccgctgcccgtatttgccggcatgtactgtctcttcttcggatatgttggtggcgttggcctgagcctccttcagttctgcaacctaaacagctttaggaccaagttcatcatggggttcgctttcttcatgggcctatcggttcctcagtacttcaacgagtacacagccgttgcaagctatggtccggtgcacactggcgccagatggttcaatgacatgatcaacgtgccattcacgtcgaagccgttcgtcgctgggttggtagcctatatcctggacaacaccctccaggtaaaggagagcgcggtgaggaaggacaggggcaaccactggtgggagaagttcaggagcttcaagaaagacgcgaggagccaagagttctactcgctgccgttcaatctgaacaagttcttcccgtcggtctgatctcaaatggcgccgccgctgaatcaattctggaagcaacccttgttcatatgggccttaatgaggaacataattctgctggtctggccagtggaagcttctgtgtctccattgttggtcaattttgtgtgttttcggacgagatgggagtaattgaactgtagaaattattaggattgaagtatatcgcgttctttttgtaatctacatgaatcagcaacgcagattaaatatttgtaggcgtagatactttgatcagtcaaatgttataggagcaaaccaatcttgggcctgagggactagatgctaaaatagcccattagctgagcaatgtaagccaacaaggaccattaggtgagaaataaaatcaaactttttacgacccgcaaaaaaaaaaaaaaaaaaaaactcgcaaagggggccggtacc

SEQ ID NO: 1046 - DNA, 2298 bp, Zea mays
  Clone ID: PAT_MRT4577_138175C.1
gccggcctgggttgcgattcacccaagtccaagcaccttcccaaaaaaatcccccattttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttcggaggctaggctggatgcctcttctccttgctgtcgtggatgcctgtttgttgttagggttacttcgtttagttccttgtctgtgacgtgttggactattgttagtagtattcttgaagttgtgtttcgaatgtaatccaatcttatcgttcgagaattgaaatgattcctgggcaacattttgcaggcaaaaaaaaaaaaaaaaaacgtctgagagcaaaccagacgaaacaaaccctcctgggctgcttccccttttcgatccccatggcgcaggacgacatcccggagtcctccgcctccggatcccccacctcctccgccccggcggctcgcctcaacgccgccgcgcccgagtttaccccccgatccgccgcccagcaccacggcaacaacgcccatcgccgcggcccgcaccaccaccatcagccgcaccaccacccccactaccaccctcaccagcactaccagccgcggcaccagcaccatcaggcccaggccgaggatgaggggagcgccgccgcgacggcggaggatagggagggccccgctggtgcggtgcaggcgcagcaccggctgcccgaacccgaggcccgcaagctcgtcaagcaggttgaattttacttcagcgatatcaatttggccacaactgaacatctgatgaagttcatcgctaaggatccagatggatttgtgccaatttctgtagttgcatcttttaggaagatccgagagatagtttatgatagatccttgttggttgctgcattacgcacgtcatctgagctggttgtttcagaggatgggaaacatgttaaacgcttacagccctttaatgccgaagaagttcagtctcgtattgttgttgctgaaaatttacctgaggatcaaaagcatcagactctgatgaagattttctcagctgttgggaatgtgaaatctatacgtacctgttatccacaagatatttctccagcagcagccaacagaacatcaaggattgagatgatttttgctaataagcttcattcttttgtggagtattcagctgttgaagatgctgaaaaagcagttgctgaattcggtggtgggggaaactggagagaggggattagagttcgttcactgcttggatgtctgaaacatgggttaggtcaaggaagaaaaggtggggatgaggagtatgctgcagatgaagatggccctgacacaactgatcatccacgagactttggaacagatgttactgcccaaatctcagaagcacatttcgatcaccaggccgaagatggcacccatgacaagggtggaatgaggcagcaggggagagggagaggccgtggaggtagaggcagaggccgtggtcagcattatggccacaacagccgagatggccaccatccaattggcactcccccgtcagagcatccagctgtgccgaagccgcccccgggcccccgcatgccggatggcacaaaagggttcaccatgggccgagggaagccgctcagcattaccattgatgctgcggctaaccctaccaccacggatgctgcttagccgcagcgtctatgctggtaccggcctattgccctgatcatcagtcttttgcaaaccgattgcagtggtcatttactcatgttctaaaccgtttactgtggcgtgttggttcattttgtctgggatttaaaaggaaaggagatggctggtactatgatacatgagtgtatactaacacccgaagtttagacatgtggacatgtactgtgatatgtagctcttaaattagaaaaatgcacacttttgatgaaaaaaaggggtggttttatgttccaaaaaaaaaaaaaaaaaaaaaaaaaaaaaaaaaaaaaaaaaaaaaaaaaacaaaaa

SEQ ID NO: 1047 - DNA, 1488 bp, Zea mays
  UNSURE (1)..(1488): unsure at all n locations
  Clone ID: PAT_MRT4577_138176C.1
  unsure (1)..(1488): unsure at all n locations
cattgggtacctcgaggccggccgggggatgcgatcataccagcactaaagcaccggatcccatcagaactccgaagttaagcgtgcttgggcgagagtagtactaggatgggtgacctcctgggaagtcctcgtgttgcattccccaagtccaagcaccttcccaaaaaaatcccccattttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagaccgtcaccgccatggacgtcgtctacgcgctcaagcgccagggccgaaccctctacggcttcggaggctaggctggatgcctcttctccttgctatcgtggatgcctgtttgttgttagggttacttcgtttagtttcttgtctgtgacgtgttggactattgttagtagtattcttgaagttgtgtttcgaatgtaatccaatcttatcgttcgagaattgaaatgattcctgggcaacatttttttcctataacaggttgacttatataatctanattataatctagattatataatctggattatttgctctggattatataagctaggtgctgctatttgttagctcagattatttggactttacttattattatatgcatacaaatacaacatctttagttaanaaaaaaaaaaaaaagcggccgcttttttttttttttttttcggtccagagcaagccagcaatgacaacatttcttcagacaaacacaccatgtgcagcataccgcactgcagttctacagtatctagcaaatttcccccacacaaacaacttgcgaactgcagcaacaccagaaccgcagcgacggcgaggcgcggggcggcaggcctagccgccgaagccgtagagggtacggccctggcgcttaagcgcgtagacgacgtccatggcggtgacggtcttacggcgagcgtgctcagtgtaggtgacggcgtcgcggatgacgttctccaggaagatcttgagcacgccgcgggtctcctcgtagatgagccccgagatgcgcttcacgccgccccgccgcgccagcctccggatcgccggcttcgtgatcccctggatgttgtcgcgcagcaccttccggtgacgcttcgcgccgcccttgcccaggcccttgccgcccttgccgcgccccgacatcttcgccgcggagacgagaggattggggaatttttgcttgctggttggtgtggtgagcctgtgaatggatcccggccggcctcgaggtaccc

SEQ ID NO: 1048 - DNA, 882 bp, Zea mays
  Clone ID: PAT_MRT4577_138178C.1
cggcccgggttcccgaaaaaagaaaaaaaaaaaaaaaaaaaaaaaaaaaaaaaaaaaaaaaaaaaaaaaaaaaaaaaacccaaagtccaagcaccttcccaaaaaaatcccccattttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttcggaggctaggctggatgcctcttctccttgctgtcgtggatgcctgtttgttgttagggttacttcgtttagttccttgtctgtgacgtgttggactattgttagtagtattcttgaagttgtgtttcgaatgtaatccaatcttatcgttcgagaattgaaatgattcctgggcaacattttgcaggcaatctcgttcgagagttaggtccattatatctgttaagattttttttccatacagcattgactaagtatgaagcccattccatcctgaagatcgtgtatttcagagttgcaattcagttgtcaaagttctagcgtgtatgctaaaattttaagagggatacatagtctcctttctgaatgcatttgtctcatgatttgaagcgaaaaaaaaaaaaaaaaaagcggcc

SEQ ID NO: 1049 - DNA, 315 bp, Zea mays
  UNSURE (1)..(315): unsure at all n locations
  Clone ID: PAT_MRT4577_138415C.1
  unsure (1)..(315): unsure at all n locations
ctcgcctgctttccctcgccgctccagttccacaccctctgctcatccacccgtccctcctgctcgcacatggcttccatcgctgtctgcgactgccctctccgatggttctagctcgggtggttcgacgagaacgaccagctgcagcaggtctctgtccacgcgctcgtctgcggcaagaaggtcatcctcttctgcgtcctcggcgccttcacnccgacctgcagcaatcagcatgtgccaggcttcatcacacaggctgagcagctcatagccaagggtgtagacgagatcctgcttatcagcgttaacgac

SEQ ID NO: 1050 - DNA, 291 bp, Zea mays
  Clone ID: PAT_MRT4577_138453C.1
ggcagccccaaaaaaccccattttttccttaggattaacttaaaacaaatcccggcaggggtaacaacatccattgatccaaaatccatgctggttgaagcatgggtttgctggaccccaggataaacacagccctaacaactgacacaaagcgaccttggaattaaaaacacaaatgggcaacaacaaacgaaacgaacgaaaataaaccctttggactagggtaaacatcacgggggcgaacaggataacttggccgggcgggccccaccggtgaattcctccagttcc

SEQ ID NO: 1051 - DNA, 342 bp, Zea mays
  Clone ID: PAT_MRT4577_13848C.1
gctctggcttgtgtttcgggggccccctgcctggtgccgggtttcttttagcaccttacgactactaccactggttatcttgctcattacgtccttaaccccggcttgactttgctctcctccctttggctggcccccatttcttgtcccccttgcacgtgggcagcccgggcaacacccaataaaggggccagggtttgggccactccttgtctcctccactcgggactttttccaagcagctggcgaagcagagcgcgtttcagctgcagcagtcggctgaagaccttttcgggcccccagcttccagcgtcaccgacgaggccggcacgtgggggcttt

SEQ ID NO: 1052 - DNA, 673 bp, Zea mays
  Clone ID: PAT_MRT4577_138492C.1
tgtgcaggcgctcgatggcggccgtcttccccgactctacattatcttctctctctgctcctccgcctgcgtctgatacatccaagagagggatctaccatgctaggactacgtaggagcaccacttcgaatcgaaggccgacgctggggcgtgcaagacctacccgcagcaggctggaaccgtccgaaacaacggcttcatcgacatcaagaaccgtccctgcaaggctgtggaggtttctacctccaacactgacacaaatggccacatcaaatgccactttgtcgccatacacatattcaatgtgaaaaagcttgaagatattgttccttcgtcacacaactgtgacattccgcatgtgaaccgcactgagtatcaactgattgatatatctgaggatgcatttgcgagccttcttacttcaaatggcaacactagagatgatcttagactcccaactgatgagactcttgtggaccatattaaggaagggttcgaaagcgggaaggatcttgtatgcgactgtccagactgcgatgagtgacgaatagatctgcgcgttagacgatgatggccccaagtgacttccttggctgtggagacagaaccctactgtatctcaacttatatcgcataagaaggtatcacccaaggattgctaccgagacattc

SEQ ID NO: 1053 - DNA, 235 bp, Zea mays
  Clone ID: PAT_MRT4577_13850C.1
agacgtgagccatccactacgatcccctcccgcgaattgaacagctttcataagagaaccccatgcttcgcttgcgccggtgcacgcttggtatatcgcaccctgaatcgacagacatgcaagcccgaaccatttttgaacctgctataacaatgaccaaccaaggtgttcaagtgtatccatagataatggctactcttgttggaacaccacaggaactggggcatcaagtgac

SEQ ID NO: 1054 - DNA, 108 bp, Zea mays
  Clone ID: PAT_MRT4577_138513C.1
gaccccccctgtatcggggcattaagcgctgcgggtggggtggtaacacccagagtgaccgcttcacttgtcagcgccctaacgccccgtcctttcactttcttccct

SEQ ID NO: 1055 - DNA, 376 bp, Zea mays
  Clone ID: PAT_MRT4577_138599C.1
ttaggacactcgggggcgcccctatctctctggcctgctgattcctgataatcgaccagtagcccagtctgtgctccttgcactcctccctccatctacagcattgtcgtctgatacacctgctcgaatggctcgctctttctgctgctgatgcttcctttttctcagctggtgggctcgagggctatgagaagcgcctggagatcacattctctgaggcacctcgctctggggaccctcatgggcgtggggagcgcgccctctacagggcccagattgactctgatctggatcttgcacggtgcacaattgcgtccgagctctcgcacaaggatttcgactgatatggtcctttctgagtcaagctatgtatatc

SEQ ID NO: 1056 - DNA, 123 bp, Zea mays
  Clone ID: PAT_MRT4577_138634C.1
actctgtgggctgaagacagtgctgtcccctgaactcatccagatgctgcaggagtgtggctgccgcataagatgggtcaacaagcctccagtctacaaggactagaccacctgttcctcatc

SEQ ID NO: 1057 - DNA, 2010 bp, Zea mays
  Clone ID: PAT_MRT4577_138695C.1
tccaaaagtgaactgtgaaccggacgatccaggcatccagctaaccgcttccccctcgtcgcgctcgcgccgcgccgcgcctcgcctccaccagctacgccgtcacgcgagctcacggcccgggggcctcggaagcacaaccaccacgcgtccacgccgaagccacgaggagagcctgtctctcctccggggattctatcgccggctggtctcagcggcgccacttggagcaggcggcacccgctccgtactgttgctgatttggtgagcgcgggcagccgcgggatgggagatctggtggcgtgatggtgagcgccgggcagtaaccggggcggccagtcgcgcgtatcgacgcggggcggcgtcgccgggccggggagcccgcgcgcctctcctgccgcgaccgctttcgcggcgctacggcgcaggtggcggtgggcgcccccgggctcgccgacgctggagcgcgcggcccgcgcgttcctcctggcctccgcggcgctcgtgctcgcctgcgcgctctacctctacgtgctccgctacgtcggccggggaggtcgcgccttcgccgccgcgggcttcgtcgggggctccgtcctgggcctcggcggcgagccgtgcgacgtgttcgacggcgcctgggtacccgacgacaccggccgccacccgctatacaacagctccgagtgcccgttcgcggagcgcgggttcgactgcctcgccaacgggcggaacgacactgggtacctcaagtggcggtggaagccgcggcggtgcggagtgccgcggtttgcggcccgcaccgcgctggagcggctgcgcgggaagcgggtggtgttcgtgggggattccatgagccgctcgcagtgggagtccttcatatgcatgctcatggccggcgtggatgaccccaggacggtcttcgaggtgaacgggaacgagatcaccaagacgatacgccacctggcggtcaggttcgcgtctcacggcctcaccgtggaattcttccggtccgtgttcctcgtgcaggagcatcctgccccgcggcatgcccccaagagggtcaaatccactttgaggcttgacaggatggataatttcagccggaaatgggtcaattcggacgtactgattttcaacactgggcattggtggacaccgaccaaattgtttgatacgggttgctattttcaggctggacgttctcttaaattaggtacatccattgatgctggtttcaggatggcactggagacctgggcctcatgggtacaaaaaagagttgatttaaaccgaacacatgtattctttcgcacatatgagccatcgcattggggggatacaagccaaaaggtgtgtgaggtaacagagcagccttcatcagaggccaaaggaaatgataagagtgaatttggggctatactttctgatgttgtaaccaacatgaaagttcctatcacagtactaaatgtaactttaatgggagcgtttagaagtgacgcacatgttggcacttggagttatcctcccactatacttgattgcagtcactggtgtcttcctggagtccctgatgcttggaatgaacttgtgttttcgtatcttttgacaaatggttggcgaaacatgccgggctgaaatttatggcagcattgctcaatctacccccactttttgtattttgatatttgacattaccaggtatactagagaattaacatacttccgggacaagagacagctgcatctgctgtaggtggttcactagacttctgcattcttttcttctttttgatttttgactcgtatacacggtgaagcatgctacatgcaactagagttgtatgtagttggtaagggattagaaggccttggcattcgttctatttgctcaatttactaacggttcattttattatgttgttaaaaatcgagtttgtattgtaacctgtatgtacaaacatttacttgatacattgtgagaaagtgccctctctcaattggattgat

SEQ ID NO: 1058 - DNA, 340 bp, Zea mays
  Clone ID: PAT_MRT4577_138729C.1
cacttcatacaagagcaaatacgctgtcacaaaaaagaaaaacgcgaacacatgaactagcaaaactacgcacacgcgcagagccatctgcctcattcgagtcatcccaatggccacctaactgtgcagagctccacctacttggtcagacgaccatgtccggcgccagaagcgaagctctacttcggctctgagccgaccgatgctccggcgatcccgacgaacacccgcgccctcgagctgctccggcgccatcttcctgaaacgtacggtgaggacgccgctgccaaagatagcggaaaccgagtcccccacgagtccgcccacgcattcccccacg

SEQ ID NO: 1059 - DNA, 2202 bp, Zea mays
  Clone ID: PAT_MRT4577_138761C.1
cccagcgtccggcagataattgttatgggtgctccatctaccacgcgtccgtgatagagactgatcctgctgaatattgtatcgttgcgccagatactgaaatattttgtgatgagaagaagaagaagaagaggatgaggagcgtcttgatgaagttggttatgatgatgttggtggagttagaaagcaaatggcccaaatcagagagcttgttgagcttccactacgccatcctcaacttttcaaatctattggtgtgaagccaccaaagggcatattgctgtacgggccacctggttcgggaaagactcttattgctcgtgctgttgcaaatgagactggagcctttttcttcctgatcaatggtccagagattatgtcaaagctggcaggggagagtgaaagcaatctcagaaaggcatttgaagaagcagagaagaatgctccatctatcattttcattgatgaaattgattccattgcacccaagagagagaagaccaatggagaagtagagcgtcgtattgtttcacagctactgactcttatggatggactgaaatctcgttcccatgttattgttatgggtgctacaaaccggccaaacagcattgatcctgctcttcgaagatttggaaggtttgatcgggaaattgacattggagttcctgatgaagttggccggcttgaggttctccgtattcacactaagaacatgaagctagctgaagatgttaatttggaactcatttcaaaggatacccatggatacgttggtgctgatcttgctgctctttgtactgaggctgctcttcagtgcattcgtgagaagatggacatcatagatcttgaggatgagacaatcgatgcagagatattgaactcgatggctgttacaaatgaccatttcaagactgcgcttggaacaagcaacccatctgctcttcgtgaaactgttgtcgaagtcccaaatgtctcttgggaggatattggtgggctggagaatgtcaagagggagctccaggagactgttcaatatcctgtggagcatccggagaagttcgagaagtttggcatgtctccatccaaaggagttttgttctatggtcctcctggttgtggtaaaaccttgttggcaaaggcaattgccaacgagtgccaggctaacttcatcagtgtcaagggtcctgagttgcttaccatgtggtttggtgagagtgaagccaacgtccgcgaaatttttgataaggctcgtcaatctgctccttgtgtcctcttctttgatgagcttgactcaattgcgactcagagaggaagtagtgtgggtgatgctggaggtgcggctgatagagtgcttaatcagctactgacagaaatggatggcatgaacgccaagaaaactgtgtttattattggtgctacaaacaggcctgacatcattgatcctgctcttctgaggccagggcgtcttgaccagctgatctacattccactgcctgatgagcagtctaggctccagatcttcaaggcctgcctaaggaagtcccctgtggcaaaggatgtggacctgaatgctcttgctaagtacacacaagggttcagtggagcagatatcacagaaatttgccagcgtgcgtgcaaatatgcaatcagagagaacattgagaaggacattgagagggaaaggcggatgaaggacaaccctgaggcgatggaggaagatgaagtggacgagattgccgagatcaaagcagctcacttcgaggagtctatgaagtatgctcggcgcagtgtcagtgatgctgatatccgcaagtaccaggcgttcgcccagacgttgcagcagtcccgtgggttcggcagcgagttccgcttctcagagcagtcggcgacagctggtgctgctgcagccgatccgtttgcttcggctggtgctgcggctgacgatgacgatctatacagctaggtgtcctgttgggttggttctgggttgtgcaatatcagtctcatcagtcatctgtttaaaactctgattatacttagacacgggatgtcatgcaatgatatttgttttccgtacatttggacgttgagataatgcctgtttattttatgccaaaaaaaaaaaattattttattttaaaaaaattaaaaaaaaactcgtgctccccatgcccttttatgaatgattgtttgtcattg

SEQ ID NO: 1060 - DNA, 548 bp, Zea mays
  Clone ID: PAT_MRT4577_138762C.1
cgaggtaatcgccgtcaactcggtcttcgagatgcaccggctgctcgcgcagcccggcgccctggagaaggtcctgggcaccgtgcgcgccgtgcggccgaggatcgtcaccgtggtggagcaggaggccaaccacaactccggcacattcctggaccgcttcaccgagtctctgcactactactccaccatgttcgattccctcgagggcggcagctccggcggcccatccgaagtctcatcgggggctgccgctgctcctgccgccgccggcacggaccaggtcatgtccgaggtgtacctcggccggcagatctgcaacgtggtggcctgcgagggggcggagcgcacagagcgccacgagacgctggggcagtggcggaaccggctgggcaacgccgggttcgagaccgtgcacctgggctccaatgcctacaagcaggcgagcacgctgctggccctattcgccggcggcgacgggtacaaggtggaggagaaggagggctgcctgactctcgggtggcacacgcgcccgctgatcgccacct

SEQ ID NO: 1061 - DNA, 1464 bp, Zea mays
  Clone ID: PAT_MRT4577_138763C.1
cggacgcgtgggtgttggtgctgatcttgctgccctttgcatgaggctgctcttcagtgcattcgtgagaagatggacatcatagatcttgaggatgagacaatcgatgcagagatattgaactcaatggctgttacaaatgaccatttcaagactgcgcttggaacaagcaacccatctgctcttcgtgaaactgttgtcgaagtcccaaatgtctcttgggaggatattggtgggctggagaatgtcaagagggagctccaggagactgttcaatatcctgtggagcatccggagaagttcgagaagtttggcatgtctccatccaaaggagttttgttctatggtcctcctggttgtggtaagaccttgttggcaaaggcaattgccaacgagtgccaggctaacttcatcagtgtcaagggtcctgagttgcttaccatgtggtttggtgagagtgaagccaacgtccgtgaaatttttgacaaggctcgtcaatctgctccttgtgtcctcttctttgatgagcttgactcaattgctactcagagaggaagcagtgtgggtgatgctggaggtgcggctgatagagtgcttaatcagctactgacagaaatggatggcatgaatgccaagaaaactgtgtttattattggagctacaaacaggcctgacatcattgaccctgctctgctgaggccagggcgtcttgaccagctgatctacattccactgcctgatgagcagtctaggctccagatcttcaaggcctgccttaggaagtcccctgtggcgaaggatgtggacttgaatgctcttgctaagtacactcaagggttcagtggagcagatatcacagaaatttgccagcgtgcgtgcaaatatgcaatcagagagaacattgagaaggatattgagagggaaaggcggagaaaggacaaccctgaggcgatggaggaagacgaagtggatgagatcgctgagatcagggcccctcacttcgaggagtcgatgaagtatgctcggcgtagtgtcagtgatgctgatatccgcaagtatcaggcgtttgcccagacattgcagcagtcccgggggttcggcagtgagttccgcttctcggatcagccggcgacagctggtgctgctgctgcagctgatccgtttgcttctgcgggtgctgcggctgatgatgacgatctatacagctagttgggttgttcaatatcagtcccgtcactcatctgtttaaaactgatcatactaaacacgcttgtcatgcaatgatatttatttgccgtacatttggacgtcgctgagataaagcacaataggccttcggttaactttaataactagattttcccatgtgcattgtctggcccagtgacattttattaattattgtgaaatctatcatctctcaaaaaaaaaaattataaataatattattatatataatttatt

SEQ ID NO: 1062 - DNA, 1625 bp, Zea mays
  Clone ID: PAT_MRT4577_138802C.1
gcacggcgactggactatactgctcccaagaggctggccggactatattgctcccatgaacctcgccgtcgcagccgcactgccgtccgtgacgccacgtaccggcgtcgtgctcccacggagcagtcgccgacactgcccccgcggggtcgtcccactcgcggcctcgagctccgtttcctcctttacctccccctcagcagcggcggcgcccatctacgcgcccacgccgcaggaccggtctctccggacgccgcatagcgggtaccactttgatggcacggctcgacctttctttgaaggatggtacttcaaggtgtcgattccagagtgcaggcagagtttctgctttatgtactctgttgagaaccctctcttccgtgatggtatgagtgatttggacaagttgttatatggcccacgctttactggtgtgggagcacaaatccttggtgcggacgataagtacatatgccagttctctgagaaatcaaacaatttttggggaagtaggcatgaactaatgctgggaaacactttcatttccaataaagagtcaaccccaccgcaaggggaggtgccccctcaggatttctctaggcgtattttggaagggttccaagtcaccccaatatggcatcaaggtttcatacgtgatgatggaaggtcaaactacgtgccaaatgtccaaacagctcgctgggagtacagcactcgtccagtttatgggtggggtgatgtcaaatctaagcagttgtccacagctggttggcttgcagcttttcctttctttgaacctcattggcaaatttgcatggctagtggcttgtccacaggatggatagaatgggatggagaacggtttgaatttgaaaatgctccatcttactcagaaaagaactggggcggaggttttccaagaaagtggtattggatccagtgcaatgtcttcccaggagcttctggtgaagtttctttaactgctgctggtggattgaggaaaattggacttggtgatacctatgaaagtccttcactgattggaatacattatgagggacagttttttgaatttgtaccttggactggaacagtaagctgggacattggactgtggggtctttggaaaatgtctggcgagaacaaaactcatctggtagaaatagaagcaaccactgcagaatcaggaactgctctgcgcgctcctactatcgaggctggactggtaccagcgtgcaaagacacctgctatggagatctaaggctacagttgtgggaaaagaaatacgatggtagcaagggagagatgatactcgacgccacaagcaacatggcagcactagaagttggcggaggcccctggttcaatgggtggaaagggacaactgttgtgaacgaggttgtaaataacattgtgggcacgccagtcgatgtagagagcctcctcccaatcccatttcttaagcccccaggcctataggatcaccaacgaatgtcacaatgaagaagtatcacggatatcaatgttgatcatacagtaaaactgtgcccagttcaataataattcatgatttttacttgttttttactacaaaaaaaaaaacaaaaaaaaaaaaaaaaaaaaa

SEQ ID NO: 1063 - DNA, 2267 bp, Zea mays
  UNSURE (1)..(2267): unsure at all n locations
  Clone ID: PAT_MRT4577_138883C.1
  unsure (1)..(2267): unsure at all n locations
gggacctcgagccggccgggccgggnaactataaagancngtnctcgtctcgggggtgcaggaagctcgtcgagctcggtcgggggagaggccaagaacccagccgcgaagccaagccaagcccatctgatccggcccctgctgccctgccccaggccccagctcgtctctcaggtcgccttgccgttgccggtggcccgccgcgctgcgacagacgcaatctcgtccagctcacccgatccagttcgtgtcgcccctagcgtgtcgcagccagtacctgcggtcagctcggctcagttggcactagctggtcgccgagatttatcttcgtttggttgcactctcttctgtcttcttgccgcgtcggcggggtggttttgtgcgcggcgggggggagggtttaggtggggacggggggatcgctcagcctctcggcggtgtcctccgtctccatcgtcatctgcaacaaggctctcatgagctcccttggcttcaacttcgccactactttgacaagctggcatctcctggttaccttctgttctctccatgtggcattatgtatgaagctgtttgagcacaaacctttcgatgcaaggaccgtcatgggattcggagtgctcaatggcatatctattggacttcttaacttgagtctgggtttcaattctgttggtttctatcagatgacaaagctggccataattccctgtactgttatactggagacccttttcttccggaagaaatttagccggaatatcaagctttcccttagtgtgctccttcttggtgttggtgttgcaactgtaactgatctgcaactcaacgttatgggatctgtactgtccctactggcaatcatcacaacctgcatcgctcagatcatgacaaatacaatacagaagaagttcaaggtatcttcaacacagctcctgtaccagtcgtgcccataccaggcattgacgttgttccttgtcggtccattcctcgatggatttttgactaaccaaaatgtctttgctttcgactacacaactcaagttctgtttttcatcgtgctgtcgtgcctgatttcagtctcggtgaacttcagcacttttctcgtgatcgggaagacgtctcctgtaacctaccaagtccttggccatctgaaaacatgcttggtcctcacctttggctatgtcctgcttcacgacccgtttagctggagaaacatacttgggatcctaatcgcggtaatcgggatggttctgtactcgtacttctgcactagagagactcagcaaaaaccagcagaagcctccccgcaagccgttcaggcaaaggagggtgaatcgaacccgctgatctcggactccctgagcgctgccgaaaacggaggcagtgccaccgacgacgaacctctgaaggtaccaatgtggagctcgaagtactcgaaggcgtgaagtggctgttctggtattagtgcacacggtgctatacagaattcagcttggtaggcagatactagggttggaaggcaaccctgttcctgttccatttttggccttctattttttcttcttcctggcacaaatactataaatatgtgctgtcagtaaatggatctcactcttgagaggaatacctcagctcgagaccgagtgttctgttctgcctgaaagctagtatttgtttgtgctccactccacgtgtaaagtggtagatggacatgatctcaacagtagtagtttgcattcttttgtactagtgatatacaatatttatgtattcctcgtgttccctaaacgggtagagatggacatgatatcaacagtagtggtttgcattcttttgcactagtatgtatcccattcttctggtatgtattccccgcgatcccccaccagtatggggtcctctggttcatatgtaggccattggtacgcgttgggcgcatacaaagcgatgttaaaaaacatgccatttggtttcacgtttgaaaaaaaaaaaaaaaaaaaaaaagaagaaaaaaaaaaaaaaaaaaaaaaaaaaaaaaaaaaaaaaaaaggtctgaatggtgcttttagcaaggttgccaattttgtgtagtattttgtcaaaactgaaggcctttggattagtttgtgctggtcagctagaaacctggaaacaacaaacttgttgagtagcgatgtttacaagaaatgtagcctttatgggctcttgtaaccctttctctcttatcatattttgttaaagaagcaaaatatccaccaaaactc

SEQ ID NO: 1064 - DNA, 1806 bp, Zea mays
  Clone ID: PAT_MRT4577_138888C.1
gggtgcctcgaggccggccgggttgtaaaaatataaaagacccgtctccgtctcgggggagcaggagaggggggagaggccaagaacccagccgcgaagccaagccaagcccatctgatccggcccctgctgccctgccccagctcgtctctcaggtcgccttgccgttgccggttccgcgcccggctcagagtcgcgagctcgtctcgcagatccggcttcgcttgcttgaattctgttctttgggagcaaagaggtgctggccggtggcgtggcttggtgctctggggccggcgagttttttttttggctccgctcgctctgcctgtagtcttcttgctgcggcggcggggtggagatgggggtggcgggggagaagttccagctggggacggtgggggcgctcagcctctcggtggtgtcctccgtctccatcgtcatctgcaacaaggctctcatgagctcccttggcttcaacttcgccactactttgacaagctggcatctcctggttacattctgttctctccatgtggcattatgtatgaagctgtttgagcacaaacctttcgatgcaaggactgtcatgggattcggagtgctcaatggcatatctattggacttcttaacttgagtctgggtttcaattctgttggtttctatcagatgacaaagctggccataattccctgtactgttatactggagacccttttcttccggaagaaatttagccggaatatcaagctttcccttagtgtgctccttcttggtgttggtgttgcaactgtaactgatctgcaactcaacgttatgggatctgtactgtccctactggcaatcatcacaacctgcatcgctcagatcatgacaaatacaatacagaagaagttcaaggtatcttcgacacagctcctgtaccaatcatgcccataccaagcattgactttgttcctcgtcggcccattccttgatgggtttttgactaaccaaaacgtctttgctttcgactacacaactcaagtcctgttcttcatcgtgctgtcgtgcctgatctcggtctcggtaaacttcagcactttccttgtgatcgggaagacgtcgcctgtaacctaccaagttctcggccacctgaaaacgtgcttggtcctcgccttcggctacgtcctgctccacgacccgtttagctggagaaacatacttggaatcctgatcgcggtgatcgggatggttctgtactcgtacttctgcactagagagactcagcagaagccggcagaggcctccccgcaagccatccaggcaaaggagggtgaatcgagccctctgatcttggattccctgagcgccgctgaaaacgggggcagtgccaccgacgacgagcctctgaaggtgccaatgtggagctcgaagtactccaaggcgtgaaaggctgttctgttactggtgtactacggcgctatacagaattcagcttggtaggcagataccatactactactagggttggaaggcaatcctgttcctgttcatgttccatttttggccttctatttttttcttttcttgttttcttcctttctggcatatactacaaatatatgtgctgctggtgctgttagtaaatggatctcactcttgggaggatgatacctcagctcgagacgagtgatctgtctgaaagctatttccttgtgttccattccacagtataaactggtagatggacatgatatcaacagtagtggtttgcattcttttgtactagtaaaaaaaaaaaaaaaaatgtatccgagtcttctgct

SEQ ID NO: 1065 - DNA, 1154 bp, Zea mays
  Clone ID: PAT_MRT4577_13898C.1
actccatagggcgattgggttcctcaaggccggccggacacgccgtccctcctgctcctgctctccacacgccgccggagaaacgcggcggaacgcccagcacgggctgcacggcaggtcggcactcggtagcacatccctcccggtggtccggccctccgccgtcccagcacgacagcacttccggcgaccaggtcctaggctcccagcgtccggcggtcccagcagtccagcacgacagtgacagcacttcgggaccacggctccgcgcgttctgctgtgcagggagggaaaatcctttttggaggatctgccattgaatcagaaggaaactttgtgcaaccaacaattgtggaaattacacgttctgcaccagttgtgaaagaagaactctttggtcctgtcctttatgttatgaaatttcagaccttgaaggaagcaattgaaatcaataactctgttcctcaaggattgagcagttttatatttacaaagtggccagatattatttttaagtggctcgggccccatggtagtgattgtggtatagtgaatgtgaacatacctactaatggtgctgaaattggtggagcatttggtggagaaaaagcagctggtggtggacgagaagcagggagtgattcctggaagcagtacatgaggagggcgacttgtacaatcaactatgggagcgagctacctctagcccagggaatcaattttggttaatcctgcagaaatgttgcgcgtggatctcagtgttttctgcagacgtggatgccgtatggaaagaactgatgcaaccgcatttgagatctcagcagacttgagcagcatttattggcgtcagttgtgaaacttaaactgcaggagcatcttgtacataaataaaataagatgtttgttgctcgtgggccgtggcacgttttggtaccggtgtccagtctactaataaaatctaatgcaaaacggtcataactacattctcatgcagtatgattttccggccttttgatctggaattgaaatgagcgttgttcgttttgaacaaaaaaaaaaaaaaataataaaaaagttgtaatatcttatcttgcttgtgaaatcgaataggcctatatatgttatgctgttaaaaaaaaaaaaaaaaagcggcc

SEQ ID NO: 1066 - DNA, 1236 bp, Zea mays
  UNSURE (1)..(1236): unsure at all n locations
  Clone ID: PAT_MRT4577_13900C.1
  unsure (1)..(1236): unsure at all n locations
gcgctgggnagcctctaccctctcncgctgtccctcctgctcctgctctcccacgccgccggagaacacggcggaacgcccagcacgggctgcacggcaggtcggcactcggcagcacatccctcccggtggtccggccctccgccgtcctagcacgacagcacttccggcgaccaggtcccaggctcccagcgtccggcggtcccagcagtccagcacgacagtcgacagcacttcgggaccacggctccgcgcgttctgctgtgcaggttctagcgttctgctgtccacggctccgcgcgtccaggaggtgaccaccagaccaagcctccgctgtccagaccagggggcaggggctggatttacatggctcaagacttaggttctagcttgttgaggtatacaaacaagtccaaattggggatccgttggagaaaggcaccttactgggaccactgcacactcctgcttcaaaagagaactttttgaaaggcattcagactatcaaatctcagggagggaaaatcctttttggaggatctgccattgaatcagaaggaaactttgtgcaaccaacaattgtggaaattacacgttctgcaccagttgtgaaagaagaacactttggtcctctcctttggccgggccgggttcagaccttgaaggaagaattgaaatcaataactctgttcctcaaggattgagcagttctatatttacaaagaggccagatattatttttaagtggctcgggccccatggtagtgattgtggcatagtgaatgtgaacatacctactaatggtgctgaaattggtggagcatttggtggagaaaaagcaactggtggtggacgagaagcagggagtgattcctggaagcagtacatgaggagggcgacttgtacaatcaactatgggagcgagctacctctagcccagggaatcaattttggttaatcctgcagaaatgttgcgcgtggatctcggtgttttctgcagacgtggatgccgtacggaaagaactgatgcaaccgcatttgagatctcagcagacttgagcagcatttattggcgtcagttgtgaaacttaaactgcaggggcatcttgtacataaataaaataagatgtttgttgctcgtgggccgtggcacattttggtaccggtgtccagtctactaataaaatctaatgcaaaacggtcgcaaaaaaaaaaaaaaaaaaggcccctagggcc

SEQ ID NO: 1067 - DNA, 222 bp, Zea mays
  UNSURE (1)..(222): unsure at all n locations
  Clone ID: PAT_MRT4577_13901C.1
  unsure (1)..(222): unsure at all n locations
gcgggcccnacccttaccccaagcgcgcctcctccgacgctgaccccggccgctcctccccgctcggcgggtcctccgacgctgcaccggcacccaaggctcgtgtggtgggctggccgggggggagggcggaccggaagaacacgctcggcgacgccgcggggtccaggaagggcggcaagtccggcaagggggccgcccacggcgcgccctacccccgga

SEQ ID NO: 1068 - DNA, 966 bp, Zea mays
  UNSURE (1)..(966): unsure at all n locations
  Clone ID: PAT_MRT4577_139031C.1
  unsure (1)..(966): unsure at all n locations
cattggctcgctcgaggccgggacgtcacccccttccgtcctcccccgagacaatccccacgcaaccgcgcaccggagcggcggagcctgacgagtctacacaagcggtggggggagcaaaatctgcgccagttcgcctcgcctacttatacactccgatcgcccccgtaagcaaagatggcaccaccatccatgtgtcttgcggcaaagggggtgcttcccttctcggcacttatttcaagtggtgttacacaaaggccagtgtcagtgaccgcttccttggagcacaaaaccagcgatgctagaaggaagttcctaaaacttgcgcttgggaatatcggagttggactgcccaccttgttgggtgttaagaaagctctcgctgatgagcaaggaatctcgtcctcgaggatgtcttattcaaggttccttgagtatcttgacaagggtagagtgaagaaggttgatttatttgagaatgggacaattgctatcgtggaggccatttctcctgagcttggcaaccgcgtgcagagagtccgtgtgcagcttcctggtctaagccaggagcttcttcagaagttgagggaaaagaacatcgattttgctgctcacagcaaccaggaggactctggttctcttctgttcaaccttattggaaatttggcattcccacttattcttatcggtggtctatttttactgtcaagaagggcacaaggtggccttggtggacccaatggccctggttttccccttggttttggtcaatctagggccaagtttcagatggaacccaacactggtgttacatttgatgatgttgctggtgtggatgaagcgaagcaagacttcatggaagtggttgagttcttgaagaaacctgaaagttcactgctgttggtgctcgcattccctaagtgttctgctttgtcgtcctcctgggactgntaaactttgcttgca

SEQ ID NO: 1069 - DNA, 882 bp, Zea mays
  UNSURE (1)..(882): unsure at all n locations
  Clone ID: PAT_MRT4577_139032C.1
  unsure (1)..(882): unsure at all n locations
tcgaggccggccggcagttcgcctcgcctacttatacattggatcgctcgcggtaggtaggggacttcgctccctttccctcctcccagctccggccccggctccggttctcacgcagtaagcaaagatggcaccaccatccatgtgtcttgcggcaaagggggtgcttcccttctcggcacttatttcaagtggtgttacacaaaggccagtgtcagtgaccgcttccttggagcacaaaaccagcgatgctagaaggaagttcctaaaacttgcgcttgggaatatcggagttggactgcccaccttgttgggtgttaagaaagctctcgctgatgagcaaggaatctcgtcctcgaggatgtcttattcaaggttccttgagtatcttgacaagggtagagtgaagaaggttgatttatttgagaatgggacaattgctatcgtggaggccatttctcctgagcttggcaaccgcgtgcagagagtccgtgtgcagcttcctggtctaagccaggagcttcttcagaagttgagggaaaagaacatcgattttgctgctcacagcaaccaggaggactctggttctcttctgttcaaccttattggaaatttggcattcccacttattcttatcggtggtctatttttactgtcaagaagggcacaaggtggccttggtggacccaatggccctggttttccccttggttttggtcaatctagggccaagtttcagatggaacccaacactggtgttacatttgatgatgttgctggtgtggatgaagcgaagcaagacttcatgggagtggttgagttcttgaagaaacctgaaaggtcactgctgntggtgctcgctttcctaaaggttttctgctt

SEQ ID NO: 1070 - DNA, 2744 bp, Zea mays
  UNSURE (1)..(2744): unsure at all n locations
  Clone ID: PAT_MRT4577_139033C.1
  unsure (1)..(2744): unsure at all n locations
cattgggtacctcgaggccggccgggaaatcccaccacaccccaaaaccccgagatgtgggctcatctcttcctttcgggccggcacagacccccccgcgccgcacccgtccctccgcaccggagacatccccacccgaccgcgcacccgagcgctggtgcctgccgggccgggatcgacgctgtggtcaccgaaccgcccacgtcacccccttccgtcctcccccgggacaatccccacgcaaccgcgcaccggagcggcggagcctgacgagtctacactagcggtggggcgagcaaaatctgcgccagttcgcctcgcctacttctacgctccgctcgttccccccggtagttcctcggcttcgctcccttcccctccctgctccggctccggttcgcacacagtaagaaaagatggcgctgccatccatgtgtcttgcggcaaagggggtgcttcccttctcggcacgtatctcgagtggtgttacacaaaggccggtgtcagtgaccgcttccttggagcacaaaaccagcgatgctagaaggaagttcctaaaacttgcgcttgggaaccttggagttggactgcccaccttgttgggtgctaagaaagctctcgctgatgagcaaggcgtctcgtcctcgaggatgtcttattcgaggttccttgagtatcttgacaagggtagagtgaagaaggttgatttatttgagaatgggacaattgctattgtggaggccatttctcctgagcttggcaaccgcgtgcaaagagtccgtgtgcagcttcctggtctaagccaggagcttcttcagaagttgagggaaaagaacatcgattttgctgctcacagcaaccaggaggactctggttctcttctgttcaaccttattggaaatttggcattcccacttattcttatcggtggtctatttttactgtcaagaagggcacagggtggccttggtggacccaatggtcctggctttccccttggttttggtcaatctagggccaagtttcagatggaacccaacactggtgttacatttgatgatgttgctggtgtggatgaagcgaagcagagacttcatggaggtggttgagttcttgaagaaacctgaaaggttcactgctgttggtgctcgcattcctaaaggtgttctgcttgtcggtcctcctgggactggtaaaactttgcttgccaaggcaattgcaggagaggctggcgtaccatttttctcaatttcaggttctgagtttgtggagatgtttgttggtgttggtgcttccagagtacgtgaccttttcaagaaggccaaggagaatgctccttgcatagtgtttgtcgatgaaattgatgctgttggaaggcaaagaggtacaggtattggtggtggaaatgatgaaagggagcagactctaaatcaactactaactgagatggatggttttgagggcaacactggaattattgttattgctgccactaaccgagctgacatcttggattccgctttacttagacctgggcgctttgacagacaggtgtctgttgatgttcctgatgtacgtggaaggacagagattctaaaagtgcatggtagcaacaagaaatttgattctgatgtttctcttgatgtcatagcaatgagaacacctgggttcagcggagcagacttggcaaaccttctgaatgaagcagccattctggctggaagacggggaaggacagcaatttcttcaaaagagattgatgattctattgacagaattgtagctggtatggaagggaccgtgatgacagacgggaagagcaaaagtcttgttgcttaccatgaagttgggcatgcaatttgcggaactttgacgcctggccatgatcctgtccaaaaggttaccttagttccaaggggtcaagctcgtggtcttacatggtttatcccgatggatgacccaacactcatctccaggcagcaactttttgccagaattgttggcggccttggtggtagagctgctgaggaggtcatatttggagagcctgaggtgaccactggagctgctggtgacttgcagcaaattactggcttagccaagcagatggttgtgacattcggtatgtctgaaattggtccatggtctctgatggagggtggagcgcagagtggggacgtcatcatgagaatgatggcaaggaactccatgtcagagaagctcgcggaggacattgattcggccgtgaagcagttgtcggatgaggcctacgagatcgctttgaggcacattagaaacaacagggaggccattgacaaaatcgttgaggtgctcattgagaaggagacagtgaccggagacgagttccgggcgatcctttctgagtttgccgagatccctgttgagaaccgggttcccccagccacaccggcggccgcgctcccagcctaaacccaagccttgtaggggaggattttcttgttgtatggtgttcatattttggattcttggtgtacactaactctactaaatctgccggattttcggtacacgacatgtaagatgtaacttactcatggtgaattatagtaaaatgtaattagctttaaaaaaaaaaaaaaaaaacaacattttcagtttgtagcttcgcttctggcgagcgaaactcttgctatatgttccacggttcctactttcataaactatatgttctaattagaacttgnncattttgtttttgcaaa

SEQ ID NO: 1071 - DNA, 321 bp, Zea mays
  Clone ID: PAT_MRT4577_139155C.1
gtagggtgtctttttttggttgtttttttttttttttccaaccccaaaaaaacaaattttattcataaacaaaatgggttcacagatttttttccataccttcatgctcattgggggagaccccactgaccccctaaagctggttacttacttattcaaactgatcccgcttgtggcacccttggaagttcacattcttacaaaccacaaatttttataacaatagcccggcttggctgtttcacaaaataaccaaaccacacccccgaaattgcggcgttttaaaataaacaactcaaaagcaaattgcccccaaaagcc

SEQ ID NO: 1072 - DNA, 624 bp, Zea mays
  Clone ID: PAT_MRT4577_139235C.1
cccccgccagctgcctactgtatttttgccctgacccactattcccgttgctactgcactggggtcatgttggactcccgcgtgctcatatacccgtgggttaaataaggaacatgagggccctgcagaggccactggtgaggactgctctgatgacccacctgatgagagaaggcctttccgagctctctgggatgatggccttattaggactacaactgggaaccgagcctttggtgccctcacgggagctatggatggtggactggatattgctcacagcgagaagaggatcgctgggctcaataaggatgacaagcagctggatgctgatatccatcgcaagtacatctatggtggccatgttgctgactacatgacgaacctcgctgatcatgagccagataagaaccagtctcacttcagtgagtacattaataagggaattgaggctgatgacatggaagctatgaacaagaaggtccatgctggcatccgtgctgatccttctgtggtcaaggcaaccaaacacccaccaaaggagcacaagaggtaccaccccaagaaactgagctaccagcagaggaaggcccaccctaattgaaaggcttaagccaacttaac

SEQ ID NO: 1073 - DNA, 743 bp, Zea mays
  Clone ID: PAT_MRT4577_139270C.1
caactttggtcaagatgcagagaaaatggactaaaaaatattcaccaattttcctggcctgaacattgcaagaatcacctgtcaaggatattgactcttggcatgagatctcctgctgtcggtagtgaagaggaaaggagtaaggcacctatatcaggaaggaagcatatcattgttatttctgtagactctgttaacaaggagaatctagtgcggatcatcagaaatgcgattgaggccgcacatacagaaaacacaccggcttcaactggtttcgtgctgtcaacttcgctaacaatatcagagatatgttcactgctagtatctgtaggcatgcatcctgctggttttgatgctttcatctgcaacagtgggagtagcatttactatccttcatattctggtaatacgccaagcaattccagggttacacatgtaatagatcgaaatcatcaatcacatattgagtatcgttggggaggagaaggtctaagaaagtatcttgtgaaatgggctacttcagtggttgaaagaaagggaagaattgaaaggcaaatgatttttgaagattcagaacactcttctacatattgtcttgcatttaaagtggtcaatccaaatcatctgcctcccctaaaggagttgaggaagttgatgagaatccagtctctccgttgtaatgcgctgtataatcacagcgctaccagactgtctgtaactcctattcatgcgtcacgttctca

SEQ ID NO: 1074 - DNA, 384 bp, Zea mays
  Clone ID: PAT_MRT4577_139347C.1
ctgcactcatctcttctcgtttagaacctctataatgtcccccactcgccagtctcaggatcggctgtagccatggacgccagcggagccggtagcatggggaagaagggtgcggccgggcgcatggcaggcattcccaggaagatgtcggtgacgctgtccgtcaaggccgagctgatgttccacgtcggccggatcgagcgctacctgaagaaggtccggttcgctcaacgcgtgatcactgtcacccgcgtttaccttgaccgcgtcctggagtacctagccgtcgaggttatagagttggcctgtatcgcggcgaatgacttcaagatgacgcgcatcatactgagcgacgtgctactggcgatccgcaacgacgaggag

SEQ ID NO: 1075 - DNA, 299 bp, Zea mays
  Clone ID: PAT_MRT4577_139459C.1
cggacgcgtgggctcacgggcgctgcccgggttgcagctgtggaaggaggagtctgagagtaatctggggttcccaccattgtcggtattctcttcggctgatttccagaatgcagggtctgatagactctgctcttcgctagatggaaacatcgtcaggttgacctgggacagcaggacatcggctggcgagggcaggagcaggcgaaactcatctgagtcaataaggagcagaacatcggctggcgagcgcaggagcaggagaaattcatcggaatcactaaggagcagctggaaca

SEQ ID NO: 1076 - DNA, 307 bp, Zea mays
  UNSURE (1)..(307): unsure at all n locations
  Clone ID: PAT_MRT4577_139545C.1
  unsure (1)..(307): unsure at all n locations
ngatgagtgntgcagcgtagtagctcgcaatcggctcgacgcgctcctggcagcaggaacaagatgtccaatagggcacacaatcgtgttatgcctgtccgcaggcaattcgactccgtgngcaggatatcgtatcgcacaactgcaatgatggtagtatccaggagattagtgagatgagtcgcatattgaacacttatgagctacttgaactagactatgacggacgtcgagctacgatgattcgagaatgatggatgccatgtcttcacttatgcggcaacggatggaagacatgngaagagat

SEQ ID NO: 1077 - DNA, 1316 bp, Zea mays
  Clone ID: PAT_MRT4577_139718C.1
ccgggtttattatggccatcctgatgtcttcgatcgtcttttcacgttacgaggggcggtgtcagtaaagcatccaaaattatcaatcttagtgaggacatctttgcaggattcaattccacattgcgtgaaggcaatgttactcaccacgagtacatgcaagttggcaagggaagggatgtgggtctcaatcaaatatctctgtttgaggcaaagatagcaaatggcaatggcgaacagacgctgagccgtgacatctaccggctgggtcatcgctttgatttcttcagaatgctatcttgctactatacaacaattggtttctacttcagtacaatgattacagtgtggactgtatatgttttcctctatgggcggttatatcttgtacttagtggacttgatgaagcgctggctactggaaggaggtttgtgcacaatgcacctctccaggttgcgcttgcatcggagtcttttgtgcagcttgggtttttgatggcgctacccatgatgatggaaatcggtttggagagaggattcagaacagcattgagtgacttcatactgatgcagcttcagttggcctcagttttcttcacgttctcattgggaacaaaaactcattactacggaaggacattactccatggaggagctgaatacagagccactggacgtgggtttgtggtgttccatgcgaaatttgctgacaactatcgactctattcccgtagccattttgtcaagggcattgagctgatgattctactagttgtgtatgaaatatttagccagccatatagaggggctgtaacttacatcttcatcaccgtgtccatgtggttcatggtgggcacttggctctttgcaccattcctgttcaatccttctggatttgagtggcagaagattgtggacgactggaccgattggcacaagtggatcagcaatcgtggaggtatcggtgtagcaccagagaaaagctgggagtcatggtgggaaaaggagcaagagccccttcgatactccgggaagcgcggtactgttgttgaaatactgcttgcgctgcgtttctttatctaccagtacggacttgtgtatcatctgaatataacgaagaagataactaaggacaaccagagtgtgctggtttattgcttctcatgggttgtaatttttgtgattttgctccttatgaagaccgtatcagtgggcaggagaaggttcagtgcagagttccagctagtgttccggttgatcacggccctgatttttataacatttacagccatcctggtaatcctaatagcgatccc

SEQ ID NO: 1078 - DNA, 1998 bp, Zea mays
  Clone ID: PAT_MRT4577_139769C.1
gtataacatcacatttttccactttgatggtccatgctcaaatttatttatagggatttaaagccacaaaacctgctggtggacaaggagaaaggtatactgaagattgctgatctgggactcggtagggctttcactgtgcccatgaaaagctacacccatgagattgtgaccctttggtcgacgcacgcgaccgcccacgcgtcctccctcattaccgacgttgcccgggaggggtggggaggggagcggcccatttggatttggaagcatcctcggcggcgagcggcggcgtcgcattcactctcatctctctctcacacagattccggctccttttccctctcccccaattcaaaatcaacccccctcgtcgcaaggccacaacaactccactcctccccatccctagctagccactagggtttgccagcctttgcagcgtcgcgctcgcgtctcatgcccttgcccatcgacggtagacgagagcgagcggtctgtgttcgtggagcaggggccggcgccatggagatcaacatcgtggacaagtacgagaagctggagaaggtcggggagggcacctacggcaaggtgtacaaggcgcaggacaaggcgacggggcagctggtggcgctgaagaagacccgcctcgagatggacgaggagggcatcccgcccacggcgctccgcgagatctccctcctcaacctcctctcccactccatctacatcgtccgcctcctcgccgtcgagcaggccgctaagaatggcaagcccgtcctctacctcgtcttcgagttcctcgacaccgatctcaagaagtacctcgacgtctaccgcagggggcccagcgccaggccgctccccgcgacactcatcaagaatttcctgtatcagttatgcaaaggagttgcacactgccatagccatggtgtccttcaccgggatttaaagccacaaaacctgctggtggacaaggagaagggtatactgaagattgctgatctgggactcggtagggctttcactgtgcccatgaaaagctacacccatgagattgtgaccctttggtacagagctcctgaagttttgcttggagcaacacattactcaactggcgttgatatgtggtctgttggatgcatctttgctgaaatggcccgacggcaggctctctttcctggtgactcggagttgcaacagttgcttcacatcttcaggttgctgggaacacctactgaggaacagtggcctggagtgagtgatttaagggactggcatgagtttccacagtggaagccccagggtttggcacgtgtcgtcccaacactggaacctgaaggagttgaccttctatcgaaaatgcttcagcttgatccttcaaacaggatatcagctttagctgcgatggagcatccctactttaacagccttgacaagtcccagttctagccgttgtactatgtggttcagaaggcgctaccctcgtacagagagatttccaatggtgttatgaatctcaattgccatctaggcaactggttcatgattttaccaatctgttagtgagtgaaaatcgtgcgagggtcatatgtgttccccttgtcttaaaaatctggtgtggtgtagaacaagagttacctgtgggaggcctgtgataatgccctttatgtctcaacatccattttcgtgcattccatgttcttcaatacggacttgaaacaggaattctgattttcttattactaccttcaaaaaaaaaaaaaaagacgacaaaacaaactaacatacatatactaaaaaataaactaatcttccttcgatctagacaaccctaccttacgaccacgtccttatgcacaacaatatatctttttcatacccactattatatttgcattcaccacttgcacaaactttgttgcttactaatacctttttttgcctacttactaaatttttactctaaattgttatctttcaaattttcaatttgtt

SEQ ID NO: 1079 - DNA, 279 bp, Zea mays
  Clone ID: PAT_MRT4577_139867C.1
ccggccggcgagtctcgtgctctcatctccacctctcctccggctaggttgcacacgcctgccgcggcgaagcttctgtcccccctccccccggcgtcgcgctctgcgcgtcgtccgccgggaagatggctggcgctttcagggtactgcatctggtcagggcctttctgcgtttcttgccataggcgcccaatgcgaataggaacatactattccaaaaaacggctatctacactgttatttctctcatcatttacctgccgtgaagacagcttccac

SEQ ID NO: 1080 - DNA, 329 bp, Zea mays
  Clone ID: PAT_MRT4577_140013C.1
cgtgggttctcctccttcttccgtgtagctctcggtttcagcgatgtcggagactgatgcaattgtcaacaaggcggctgcgcaagcggcggcgccaagcgccaccgcaaggtgctgcgcgacaacatccagggcatcacgaagccggcgatccgtaggctggccaggatgggcggcgtcaagcgcatttctgggctcatctacgaagagacccgcggcgtgctcaagatcttcctccagaacgtcatccgcgacgccgtcacctacacccaacacgcccgccccaagaaccgtacccgcatggatgtcgtctacccccttaaacccca

SEQ ID NO: 1081 - DNA, 332 bp, Zea mays
  Clone ID: PAT_MRT4577_140093C.1
gggcagcaccaaaaaccaccattttttccttagggttaacttaaaacaaatcctgacagggggaacagcatccatcgatccacattccatgctggttgaagcatggggctgcccgagccgagggtgaacacaggtctaacaactgacacagagcggccttggaatcaaaaacacatatgggccacaacaaacgggacgaacgaggataaaccctctggactggggggaacatcacgggaggaaacaggatatcttgggcgcgcgggccccaccagtaagttcttccagtctcccggcggagttgccggatcccccttcacggggggcacctt

SEQ ID NO: 1082 - DNA, 2605 bp, Zea mays
  Clone ID: PAT_MRT4577_1400C.1
cgccgtcccccgcaccaacccacccccaccacacgtccgcaggagacccccggccggaattcggcacgcttgttgcttggcgtccgtctgccgaaacaaaagtcgccgtcctcccccctcgtcgcttcatcacctcacctccgccgtcgcctcccctcatccctccaccggcccgtttgaccctctccctggctcgctcgttctcctcctcctccgtacccgtcctagtaggtttagcgctcaacagaaccccaatcaccaccccggcgccccccgagagcagttgccttgccgcttgctgcggttccatatggtgccccccgcgtcggcgtgagggctgcgcgcgctcgtgctgtttatcgggaggagatagatggggcccgccgtccgcagtagcgtcgtgatcagggccactgtggtagggctcgtgctggttggcatcgccctggccctgccgctggccgcggcgctgcggccgctccgggagcacgtcgcgtccatcggagccgcagcctccgctggttcgtggggcgatgagcatgccttctacaaaagggatgagaacgatataggcccatattcatggaatattactggaacatataaagggagctggacttttgctggtgccacaaatggttcgtctagatttcttgagtttgtggaatctaaaggtgattcagttttggaattgttgagcactccaacaaagataagcggggtgcattatgttcagggttcagttacattccatgatgtcattgacaatgcccacaatggtggagtggctcaaataaggttagaaggagtttacatatggccttttagacaacttcgcatggtagcaaacagtggtgcagatggtgaaccactccaggaagaggattatttcttgtcaaatccataccatttattgcggattttctcctctcaagtgtttcaagaatcttctgaagagaagaaccgaaggaagaattctctcacatatgacatggagaaacattgcaacacagaaatagctgctaaggtggttcgtgtgtcatctaacccaaatgatggagaacacgagaagtaccgtttggagggtttgatggagagtccagccgtcgatgatgatggggaatgcttctctcctatcttattgaatgcaacttctttgaatgttgaagtttattacaacaaagcagtcaactacacactgatggtcacttttatctctttccttcaagttttgctgctgattagacaaatggagcatagcaacacacaatctggagctgctaaggtttctattttaatgattggccaacaagctatcatggatgcatatctctgtctacttcacctgactgctgggatattggttgagtcactcttcaatgccttcgcaacggctgcattcttcaaatttgttgtattttctatttttgaaatgaggtaccttctcgccatatggaaagcaagtaggcctttaaacagtggagaaggttgggagataatgaggcgagagctgtctgttctttacagccgcttttatggcattctgttgggaggaatccttctaatgtatgagctgcacaatttcttacgcccacttctcctcctgatgtactccttttgggtacctcaaattgtcacaaatgtcatcagggatacaagaaaacctctgcacccacaatatattttaggcatgacagttacacggcttgctattccattgtatatatttggttgccctagtaatttcatgcgtatcgagcccgacaagaaatggtccatagctgttacagtattcatgggtatccaagcagcagtgcttctgcttcagcactatcttggttctcgctgctttattcctcgccagatactgcctgagaaatactgctaccataggaaggtagaggacagcacaaatcagcccatcgattgtgttatttgcatgactacaatcgaccttacccaaagaacaagtgaatacatggtggcaccttgcgagcatatatttcactcaggctgtttacagcgttggatggacattaagatggagtgccctacttgccggcgctccctaccaccagcttagatgaggctttgtatcatatataatagtgaacaagaagtaggtagctcagcttatacaaggtgggggaactgatgtacaataaggtgaggctgcaatcgtgtgaaagctatgaacagaactgtagaaaagttttatactattgatttcaagaggtcttgtgttgtgcaaactagcgtatcaagcatcccacgaagaaatcgtccttccccgctcatgcggttatcactgttgcatgcctttgcctgctaccagtatttcggcccagcgttttggtctgagctttgtgcaaagtttgttaacgccgtgaaagagttcgagatgtgcattcttgatttggtggacacattagtagcgtgtttggtttgaggaatgagatctctctcactcacttttttgtttggtttgtggaatgaaatgaattaatctatcaccatttcatttctcgtagactcataattagtaataatatgaggaatgggtttattccaaaaaaaaaaaaaaaaaaaaactcgagaaaagggc

SEQ ID NO: 1083 - DNA, 395 bp, Zea mays
  Clone ID: PAT_MRT4577_140129C.1
gtgccgcgccacattcagcttggtgtgcgcaacgactaggagctgaccaaactgacggggggtgcgactatcgaaagcgacagcgactatgcctaacatccatcagcatgtgctcgccaataaggctgccttctctaaggccagtgcagacgacgacaactactgagactgcttgctgtagaaatgatgcgaccaccgtctcgctttgttggaataggatgatgttgtcttcgatctgggaggagtcgcttatacagggcaagagaattagattacaatctgattttttgaatggaatgcgaacgtggctatgaatctcagaattgtatgctcgttcagaaagaaatggaaagacttcgtgatacacgacgctgatgccgcatcatattcatcgt

SEQ ID NO: 1084 - DNA, 1722 bp, Zea mays
  Clone ID: PAT_MRT4577_140198C.1
atttcggcacgaggatggacgccggcgacgcctccaccgcgcttgccctcacggcggcggaaccatcaccgccgagccccaacaggaggggcaagaggccgaccaacccgcccaagcgcttcgtgcacaccccgatcccgccttcaatcctctcggacccgaccctggccgccgccgccacctccctcctcccggccaactacaactttgagctccacaagacggcgcaccgcatacggtccgcggccgctcgccgcgtggcgctgcagctccccgagggcctgctcctcttcgcgctcccactgtcgcacctcctcgcgccctacctcgagcccggcgccgacaacgacgtcctcgtcctcgccgacgccacctacggggcctgctgcctcgctgaccgccccgccagggcgctcgccgccgacctcctcgtccactacggccactcctgcctcgtccccgtcacggcctcactcctcccggtgctctacgtcttcgtcgagatccgcgtggacgccgcccgcctcgccgccgccgtcagagccgccttcccggacccagcggccgcgccccgcctcgccatcgccgggaccgtgcagttcatcgccgcggtccacgccgcgcgcgagatgctcacggtagagggctaccacgacatcgtcgtgccgcaggcgaagccgctgtccgccggcgagatcctgggttgcaccgccccgacgctcaagaagtcggaggaggtgggcgccgtggtgttcgtcgccgacgggaggttccacctcgaggcgtttatgatcgccaatcccggggtgaaggcctaccgtttcgacccattcctcggggttctcgtgctggaggagtatgaccatgttggcatgaagcaggcgaggaaagcggcggtgctggcggccaggaaggccaagagctggggagtcgtacttggcaccctggggaggcaggggagcaccaaggttcttgacagggtggtggagcatttggaggagaaagagttggaacacacagtggtgctcatgtcggagctttccccggcgaggatggagctatttggagattccattgatgcctgggtgcaaattgcttgtccacgcttgtcgatcgactggggggagggtttcaagaagccagtgctgacaacgttcgagtttgatgtcgcactgggctatgtccctgggtggtgggagaaggggagcaggggttgcggtagtgaatgtggtgttgggtgttgttcaggatcaggaactcgtggaaactgcaactgcagtgatggggattatggtggtgactacccgatggattattattcgcaagatggaggtgattggaatagctgctacatgaagaagaagccatctactggcgagaggaaactgcgggttcggattgggcaacgaaattcaagccgaggagaagcgtgggaatcaggattctcgtgagctagtcaggtgaatagggataccgagaacagcttcatggctcaaaaaggatttttgacaccaggttttagtgtgattgtaacgatgtttagttaccagagggaaaatcttgtgactgtacctgtatcgatgtatccaccaccccatatactgtaaatttgttacgtacaatgtctcattgtaaacatcttgagaaggtatgaggtgttgtcatacccattggtgcaaccatccaaaaaaaaaaaaaaaaaaaagggcggcggacgcgtgg

SEQ ID NO: 1085 - DNA, 2163 bp, Zea mays
  Clone ID: PAT_MRT4577_140212C.1
cgggccgacccacgcgtgcgctacggtccctcatcacttgttccactacgaccggccacctagctcgccgcgcgcgcaagcctgcgccaccacccactctactagcttagtctcccctcgtgcagcgcgacgacagccagcaatggccgccgcccagtgaggcagggtcgcagtgacggcacgagacgcacacccacgggcgctggcggcatgccgggcgacgcctacgacctcctgtgcgccgaggacgacgccgccggcagcgccctgctgtgcaccaccgacgacgacgacgggtgctgctccgctgtcgaggaggactcggcggcggcggcggcctccatcgccgagctcatcggcggcgaggcccagtactcgcccaggccggactaccccgacaggctccgctccaggtccatcgacccggccgcccgcgccgagtcggtcgcatggattctcaaggtgcaagaatactatgggtttcttccattgacagcctacctcgccgtcaactacatggaccggttcctctctctccaccgtttgccgcaggaggacgggtgggcgatgcagctgctggccgtgacctgcctctccctcgctgccaagatggatcgattggttgttgttgattgcactgcattgcaggttgagggcaccagcagatacgactgcttcgagcctgggacggtcggccggatggagctcctcgtcctgatggcgctcaactggcggctccgctcggttactcccttcaccttcgtcgacttcttcgcgtgcaaggtcgacccaggagggaggcacaccaggtgcctcattgcccgggccacgcaagtcattctggctgcgatgcatgacgtcgagttcttggaccactgcccgtcatcaatggcggcagcggccgtgctctgcgccatcggtgagacgccgtcactggagtcggtcagccctggggctgccgtcagctggtgcatcggccttgcagaggaagggatcagcagctgctacagactgatgcagcggctggtgataggcaacgtccggacaagggtcgccagcacgacgaccattaccatggcagcagtgaacctgtgctgctcggatgaggcgctgtcctcgcattcctctgccacctcctcgccacccccggccaagaggaggaagaggtcgccaacggccacgtgaaaactgaagaacgcaagtagataggattatttatacgctttttgggggggcagattaacagggtttgatcgatttctttgcagtttgtttgtcgttttttcttctttgtgattctttctcctttttttcccccctttgccatttatttgttctgttcttttgggttggatctctactcctcggtggggggattctgcctgcctgctcgaccggcccagtcatcatggtggcctctggcctctgcaacgcgcgccagccagtatgtgaaggcgacgagactcgagagagagagaaagaaagacagctactacgtataacagacacatctgtgtttctctgtgcaacactctgtggggcttcttcaaccccgacgcagagctgcagagagggaccattgattggtgagcgagggcagccatggcggcagatggagatggagagggtgggggaaagaggcaatgagttgcggtggatggatgatgattggtagggttaaatgaggtggtcaaagggccgggcggtcagtgctcctgccaagatgcagccctgcctgcaaagtttctgttcatattcatgagggcaaaaattgtttgtttccgagtggtttgtttgtattttgttgatgccgctgaggcgagggcgtcagagagagagaaagagagagagagaaagaggggcatgctttgctttgctgtgatgggagtcacatggatatgccctactgtggtggtgctctggagggaaatatttgtccatctccagagctaacagtgtccaagcatggggcttttgggggcccttgctgattgtttgtatctcttttttcttgcttgtgtatcaatgaagattttgccatttgaattggcctgagaagagagtacaagctgaagagagagtttctgtgttttgcctgctgctggattatatgtttgtatcacttccttcttgtttaagtatcaataaagattttgccatttg

SEQ ID NO: 1086 - DNA, 222 bp, Zea mays
  Clone ID: PAT_MRT4577_14036C.1
ctaggaggcgctgcacctgagggggggcatgtcaggcctggggagggagcacgtcaaggtgtgttcttatcataacatcctggtgatcaagggcgagggctagaaggatgatagcgaggactaggccgtcctgtctcctagatacagcgttctcatctagctcgcgccagaggtttacaggatggacaagatcaaggcgtatattaagaacggtgttcttca

SEQ ID NO: 1087 - DNA, 921 bp, Zea mays
  Clone ID: PAT_MRT4577_140424C.1
tctcttagcctagtctccctctccccggctctccgccttcctcttccagtccccgcgcgcgagatcgccgccccgtgtgggtcctagatcccgatggcctcgcgccgacgcaccctgatcaaggtcatcatcctcggcgatagtgtaatacgatgggcgagcgagcatccgattgggtgcctcgaggccggccgggacttacctggacggggtcgactggctatcaagaaggcccgtggcctagatcaatggcccacattgcacttggtggatgcgttggcttaccatctccccaagtgggagagtggacgtcataatttgtggtagatggggtacgcgacgcagttcaggtctcggtttgctgcttcttgatcagttcagatctcggtttgctgcttcttgatccagatcagggtttctgatccatatagtctgtactttgttacaaaaatcatgtaattttaaaactttttcccatatctgggttcctgatttatgaagtctacagttccggcgcctggcccctgccaattctgatttgggttcttttgggccagatctgggttctgaaccatgtagactttgtttcatgagccgttcatgagccgtttatgcgctgcagtctcatccacgtcaaaaagaaatgatgaacagaccgtcggaaaaaaataaaaaaaaagaaaggagacctggaatttcatctattagatacaataagcgactcgactttgggcaccggatatttgggttctcgcatcgatgaagaacgtaacaaaatgcgatacctggggtgaattgcaaaatcccgcgaaccatcaagtttttgaacgcaggttgcgcccgaagccttctggcggagggcacgtttgcctgggcgtcacgccacttacctgaacggggagaactgcttatcaagaaggc

SEQ ID NO: 1088 - DNA, 697 bp, Zea mays
  UNSURE (1)..(697): unsure at all n locations
  Clone ID: PAT_MRT4577_140503C.1
  unsure (1)..(697): unsure at all n locations
ctcgaggccggccgggagcatctctagcaccatcgaccttcaagtctcgctacgtatgcagtgcaataaaaatggtagccgcaatggagagcatggtcatggacctctcctcccgtgcttcgccggcaaggccgtgaacgtgccgtcgtcgtccgccttcggtgaggcccgtgtgacgatgcgcaatacgtgggcgtgtgccaagccagcggtggcgtcctggagcccgtggtacggccccgaccgcgtgttgtacctgggcccactgtccggcgagccacctagctacctgacgtgcgatttcccgggctactacggatgggacgccgcgggtttgtcggctgacccggagacgttcgccaataaacgggagctggaggtgatccactcccgctgggccatgttggtagctctcggctgcgttttcccctagctgctcgcccgcaacggtgtcaagttctgtgatgccgtgtggctcacggccggctcccatatcttcagcgagggcgggttggactacctcgtgaactcgaggctcatgcacgcgtagagtatccttgctatctgggtctgccaggtcgtgctcaggggcgccgttgagggctaccgtatctccgtcggtcctgtcggagaggtcctcgacccgctctaccccggagcaagcttcgacccgctcggnctctccgactacccctag

SEQ ID NO: 1089 - DNA, 229 bp, Zea mays
  Clone ID: PAT_MRT4577_140557C.1
caatgagtggagcgcgcgtcgcgctctgggcatgggatatcgtcgtcggcggctgcgctgtctgccgcagccacatcgtggatctatgcgtctagtgccatgctagccgagccagcgcgaccagcgatgagtgcactgttgcttggggagtctgtaatcatgctttgcacttccgctgcatcggcatgtggcttgagactcgtcgagtgtgcccattagatagcagtga

SEQ ID NO: 1090 - DNA, 1809 bp, Zea mays
  Clone ID: PAT_MRT4577_140694C.1
cggccgcgaccccaatctcgcagacacgcaccgtcgcggtatccgtatcgccagagtcctcacggatggcctcgccagcgatggtcccgctgcggcagctcttcgtcgacggcgagtggcgcccgcccgcgcagggccgccgcctccccgtcgtcaaccccaccaccgaggctcacatcggcgagatccctgcgggcacagcggaggacgtggacgccgcggtggcggcggcgcgggcggcgctcaagaggaaccgtggccgcgactgggcgcgcgccccgggggccgtccgggccaagtacctccgcgctatcgccgccaaggtgattgagaggaaacctgagctggctaagctagaggcacttgattgtgggaagccttatgatgaagcagcatgggacatggatgatgttgctgggtgctttgagtactttgcggatcaggcagaagcctaagattgtgacaaaatttcccccttttctcttccaatggaaacttttaaatgccatctccgaagaggcctattggggtagttgggctgataactccttggaactatcctctcctgatggctacatggaaggtagctcctgcattggctgctggttgtacagctgtgctaaagccatctgaattggcttctgtgacttgcttagagcttgctgatatctgtaaagaagtcggtctcccttctggtgtcttgaacattgtgacaggattaggtcctgatgctggcgctcctttgtcagcacacccagatgttgacaaggtcgcttttactgggagttttgaaactggcaagaagattatggcagcggcagctcctatggtcaagcctgttacactggaacttggtggaaaaagtcctatagtagtatttgatgatgttgacattgacaaagctgtcgagtggactctgtttgggtgcttttggaccaatggtcagatttgcagcgcaacatctcgtcttcttatccatacaaaaattgctaaaaaatttaatgagaggatggttgcatgggccaaaaatattaaggtttcggatccacttgaagagggttgcaggcttgggccagttgttagtgaaggacagtatgagaagattaagaagttcatatcgaatgccaaaagccaaggtgctactattctgactggaggtgttagacctgcgcatcttgagaaggggttctttattgaaccaactattattactgatatcaccacatcaatggaaatctggagggaggaagtctttggtccagtcctgtgcgttaaagaatttagcactgaagatgaagccatcgaacttgccaacgatacacagtatggtttggctggtgctgtaatttctggtgatcgggagcgctgccagaggttatctgaggagattgacgctggatgcatctgggtaaactgctcgcaaccctgcttctgccaagctccctggggcgggaacaagcgcagtggatttggacgtgagcttggagaagggggcattgataactacctgagcgtcaagcaagtcacggagtacatctctgatgagccgtggggatggtaccaatccccctccaagctgtaaactggcaagacgaaaatttgtctgtttcggtagaataaatatatctcgatgctatacagaacgaacccgtgtatcacattgaatgacatggtgaaaaaggcacatctgcaggataaaggcgagagttgagttgaaaccaaaaattttggaactgtgccattataagaggtggattttgtcaaaaaaaaaaaaaaaaaaaaaaaaaaaaaaaaaaaaaaaaaaaaaaa

SEQ ID NO: 1091 - DNA, 1620 bp, Zea mays
  Clone ID: PAT_MRT4577_140696C.1
ggccgcgattgggcgcgcgcgccgggggccgttcgggccaagtacctccgcgccatcgccgccaaggtaattgagaggaaacaagagctagctaagctagaggcacttgattgcgggaagccttatgatgaagctgcatgggacatggatgatgttgctgggtgctttgagtacttcgcagatcaggcagaagctttggacaaaagacaaaattccccagtttctcttccgatggaaacttttaaatgccatctccgaagagagcctattggggtagttgggctgataactccttggaactatcctctcctgatggctacatggaaggtagctcctgctctggctgctggttgtgcagctgtgctaaagccatctgaattggcttctgtgacttgcttagagcttgctgatatctgtaaagaagtcggtcttcctcccggtgtcttaaacattgtgacaggattaggtcctgatgctggtgctcctttgtcagcacacccagatgttgacaaggtcgcttttactgggagttttgaaactggtaagaagattatggcggctgcagctcctatggttaagcctgttacactggaacttggtggaaaaagtcctatagtagtatttgatgatgttgacattgacaaagctgttgagtggactctgtttgggtgcttttggaccaatggtcagatttgcagcgcaacatctcgtcttcttgtccatacaaaaattgctaaagaatttaatgagaggatggttgcatgggccaaaaatattaaggtttcggatccacttgaagagggttgcaggcttgggccagttgttagtgaaggacagtatgagaagattaagaagttcatatcgaatgccaaaagccaaggtgctactattctgactggaggtgttagacctgcgcatcttgagaaggggttctttattgaaccaactattattactgatatcaccacatcaatggaaatctggagggaggaagtctttggtccagtcctgtgcgttaaagaatttagcactgaagatgaagccatcgaacttgccaacgatacacagtgagctgattctttttagcgcagtttcgatgtcttttttgcaggcttcacaggtcatgtgtagtccatagcttatgaatttatgccagtatccttcttttgaatttttgataggtatggtttggctggtgctgtaatttctggtgatcgggagcgctgccagaggttatctgaggagattgacgctggatgcatctgggtaaactgctcgcaaccctgcttctgccaagctccctggggcgggaacaagcgcagtggatttggacgtgagcttggagaagggggcattgataactacctgagcgtcaagcaagtcacggagtacatctctgatgagccgtggggatggtaccaatccccctccaagctgtaaactggcaagacgaaaatttgtctgtttcggtagaataaatatatctcgatgctatacagaacgaacccgtgtatcacattgaatgacatggtgaaaaaggcacatctgcaggataaaggcgagagttgagttgaaaccaaaaattttggaactgtgccattataagaggtggattttgtc

SEQ ID NO: 1092 - DNA, 359 bp, Zea mays
  Clone ID: PAT_MRT4577_140714C.1
ccaaacttgaaaaatggcacggatcctcttttgatgccatttaattcctacatggcagattggagcagcgataagataacttacaccactctgaacactccaaaaataagcacagaacttccagtcaagttacaccatgacaaaagtagtagctttgaagcaccaaacctgaaggagcatgaatcagtctttgcaacacatgaaatgacggtagaagcaacaagaaaagaagacgaacacacatcaaaatctagttttactttctacaatggagtaccagatacagctgcacaagcatcaaagccaaagaaaacaagaaccacaactgctaaaaacacagagaaatttgactgggaaaa

SEQ ID NO: 1093 - DNA, 259 bp, Zea mays
  Clone ID: PAT_MRT4577_140869C.1
gttccgatcctccacaccagacccccgccgccgccgcctcttcccttgcgcacctgctgctgtgcggatcggtgaagcggaggaataggatcgcgaacgcggccggagggaaacgagcgaagaaagggaattggtttaaggtatccaagctcaggccattgatggaagcgctggaccccacggccaaggaagtgaacaacttaaagctgcgtcgattcctgcgcacgcgcgaccacgacgtggtcaaggcctccgccat

SEQ ID NO: 1094 - DNA, 672 bp, Zea mays
  Clone ID: PAT_MRT4577_140882C.1
tcgcctgctgcccagcgacccggagagagacgccgaaacctagcgacgccgccgacgacccccggatccgcccgccatggcgacccccaacccgccgccgccccagcaggacgagccctcctcctccgccgatcccaaggcgaagaaggactactcgacggcgatcctcgagaggaagaagtcccccaaccgcctcgtggtcgacgaggccaccaatgacgacaactccgtcgtcgccctccaccccgacaccatggagaggctccagctcttccgcggcgacaccgtcctcctcaagggtaaaaagaggaaggacaccatctgcattgttcttgctgatgacacatgtgaggagccgaaggtcagaatgaacaaaactgtcaggaagaacttgagagtgagacttggtgatgtggtgtctgttcatcaatgccccgatgtgaaatacgggaagcgggtgcacatacttcctattgatgacacagttgaagggattacaggaaacttgtttgacgccttcttgaaaccatacttccttgaagcctaccgccctttgagaaagggagaccttttccttgttaggggtggaatgagaagcgtggagctcaaagttatagagactgacccggcagagtattgcattgttgcaccagacactgagatcttctgtga

SEQ ID NO: 1095 - DNA, 153 bp, Zea mays
  UNSURE (1)..(153): unsure at all n locations
  Clone ID: PAT_MRT4577_140895C.1
  unsure (1)..(153): unsure at all n locations
cacaaggtaaaaccaaacaagcaaatttaataaacttcatnntaacaaannnctaagcttannatagtgtgggcgaccatttaaagtaccaagcanaccgatgtaacttcacattaaaaaaaaactatgtttccgcaattgcaattgttttcg

SEQ ID NO: 1096 - DNA, 2256 bp, Zea mays
  UNSURE (1)..(2256): unsure at all n locations
  Clone ID: PAT_MRT4577_141052C.1
  unsure (1)..(2256): unsure at all n locations
attgggatccctcgaggccggccgggagcaccagccgtccagccccggtttttctcctcccgcccccgttccccgtcccgactcccgacccaacccatatcagagattccttccgttggtggcgctggcgtccgcgctggcgttcccgtgagtcggcccgcgcgcgaaggcggccgtgaccgaccgtccggagcttcatgcgccaggggcggcggctccaccccgtcgtttgatgggcaacgcatgcggcggcgcccttagatccaagcaccagcacagcttcaagcacgccgcgtcgtcgcagcgccaccacgcctcctccgagtacagcgccagcgccgcggccgacgactcgcccaggaagccgccaccgccgcccgccaccacggacgcccacgcgccgccgccgccgcccgccaccgccatgaggcgcggcggggccggcgcgccgccggacctggggtccgtgctcggccaccccacccccaacctccgcgacctctacgcgctcggcaggaagctcgggcaggggcagttcggcaccaccttcctctgcaccgagctcgccacggggatcgactacgcctgcaagtccatctccaagcgcaagctcatcaccagggaggacgtcgacgacgtgcgccgcgagatccagatcatgcaccacctctccggccacaccaacgtcgtcgccatcaagggcgcctacgaggaccagctctacgtccacatcgnnnnnnnnnnnnnnnnnnnnnnnnnnnnnnnnnnnnnnnnnnnacagcgcggccactacagcgagcgcaaggccgccgcgctcaccaggatcatcgtcggcgtcgtcgaggcctgccactccctcggggtcatgcaccgggacctcaagcccgagaacttcctgctcgccaacagggacgatgacctctcgctcaaggccatcgatttcggactctctgtcttcttcaagcctggtcaagttttcaccgatgttgttggtagcccatattatgtagctccagaagttttgttgaaaagttatggaccagcagctgatgtatggacagctggtgtcattctttacattctactgagtggtgtgcctccattttgggcagaaacacaacaaggaatatttgatgctgtattgaagggtgccattgattttgattctgatccgtggcctgtcatatctgatagtgcaaaagatcttatcagacgaatgctgaatcctcgctctgccgagcgcttaacagcacatgaagttctatgccatccatggattcgtgatcatggagtagctcctgaccgtccactggatccagctgtcttatctcgcattaagcaattctctgcaatgaataagttgaagaaaatggctttacgagtaatagctgagagcctatcagaagaggaaattgcggggttgaaggaaatgttccagaccatggacactgacaacagtggcgcaattacttatgatgagcnnnnnnnnnnnnnnnnnnnnnnnggctccacactaaaggacactgagattcgtgatcttatggatgcagctgatattgacaacagtggaacaattgactacatagaattcattgctgcaactttgcatctcaataagctggagcgtgaggaacatctcgtggcagccttttcatatttcgacaaagatggtagtggctatatcacagtggacgaactacagcaagcttgcaaagagcataacatgccggannnnnnnnnnnnnnnnnnnnnnnnnnnnnnngatcaggataacgatggccgcattgactatggagagtttgttgccatgatgaccaagggcaatatgggagtcggtcgaagaacaatgagaaacagcttgaatatcagcatgagggacgacctggtgcgttctgagacttaacacgatgtacagcttgttgcttggctacttcctgccttgctgccctacgaaaccttctgcannnnnncaagatgttgtcaagtgtctgtgtggatgtgnnnnnctggggattctgattcaactctggtgattgattccatgaaatgcataacaagatgcccatgtcacgcaagaagccagattgtaaatgctgctgcccctttgactctcagaaacactaatgctcagtgaaaagaaatcgctccctatgcatgtctccagtctcccttgattgatggcatccattcttggatgcacgctgtatctcaatgcaatgtgttgctccgtttggatgaacatgtactcaatatact

SEQ ID NO: 1097 - DNA, 2754 bp, Zea mays
  UNSURE (1)..(2754): unsure at all n locations
  Clone ID: PAT_MRT4577_141053C.1
  unsure (1)..(2754): unsure at all n locations
aattcggcacgaggcaccgccggcctgagcctaatcctaatcctaatcctaatcccataccgggacaatccagacgaacgagcgaaccaacgcacggacggccaccagccgctgcgtgcgttcgctttcccccgaaacgtgacccgagccgagctgcagagagagaaaggagaagccgccatgaagcagcagcagctgcagctgcctcctagtcgtcaacgttaaatccctgctcgccaagccactactacgactacgagcaccagccccagtttttctcctctcgcccccgttccccgtcccgactcccgacccaacccatatcagaggttccgtccgttggtggcgctggcgttcccgtgagtcggcccgcgcgcgaaggcggccgtgaccgaccgtccggagcttcatgcgccaggggcggcggctccaccccgtcgtttgatgggcaacgcatgcggcggcgcccttagatccaagtaccagcacagcttcaagcacgccgcgtcgtcgcagcgccgcgcctcctccgagtacagcgccagcgccgtggccgacgactcgcccaggaagcccacgcagccgcccgccaccacggacgcccacgcgccgccaccgccgcccgccaccgccgcagccgccatgaggcgcggcggggccggcgcgccgccggacctggggtccgtgctcggccaccccacccccaacctccgcgacctctacgcgctcggcaggaagctcgggcaggggcagttcggcaccaccttcctctgcaccgagctcgccacgggggtcgactacgcctgcaagtccatctccaagcgcaagctcatcaccagggaggacgtcgacgacgtgcgccgcgagatccagatcatgcaccacctctccggccacaccaacgtcgtcgccatcaagggcgcctacgaggaccagctctacgtccacatcgtcatggagctctgcgccgggggcgagctcttcgaccggatcatacagcgcggccactacagcgagcgcaaggccgccgagctcaccaggatcatcgtcggcgtcgtcgaggcctgccactccctcggtgtcatgcaccgggacctcaagcccgagaacttcctgctcgtcaacaaggacgatgacctctcgctcaaggccatcgatttcggactctctgtcttcttcaagcctggtcaagttttcaccgatgttgttggtagcccatattatgtagctccagaagttttgttgaaaaattatggaccagcagctgatgtatggacagctggcgtcattctttacattctactaagtggcgtgcctccgttttgggcagaaacacaacaaggaatatttgatgctgtattgaaaggtgtcattgattttgattctgatccgtggcctgtcatatctgatagtgcaaaagatcttataagacggatgctgaatcctcgctctgccaagcgcttaacagcacatgaagttctatgccatccatggattcgtgatcatggagtagctcctgaccgtccactggatccagctgtcttatctcgcattaagcaattctctgcaatgaataagttgaagaaaatggctttgcgagtaatagctgagagcctatcagaagaggaaattgcggggttgaaggaaatgttccagaccatggacactgacaacagtggcgcaattacctacgatgaactaaaagaaggattgagaaaatatggttccacactgaaggacactgagattcgtgatcttatggatgcagctgatatcgacaacaatggaacaattgactacattgaattcatcgctgcaactttgcatctcaataagctggagcgcgaagaacatctcgtggcggccttttcatatttcgacaaagatggtagtggctatatcacagtggatgaactacagcaagcttgcaaagagcataacatgccggatgcttttcttgatgatgtcatcaacgaagctgatcaggataacgatggccgcattgactatggagagtttgttgccatgatgaccaagggcaatatgggagtcggtcgacggacaatgagaaacagcttgaatatcagcatgagggacgcacctggtgcattctgaaacttaacacgatgtacagcttgtggcctagtcacttcggccctgtttgtttcggcttctggcagcttctggccaccaaaagctgctgcggactgccaaacgctcagcttttcagccagcttctataaaattcgttgcggcaaaaaccatccaaaatcaacataaacacataatcggttgagtcgttgtaatagtaggaatccgtcactttctagatcctgagccctataaacaactttatcttcctccacacgtaatcgtaatgatactcagattcttcccacagccagattttcagaaaagctggtcagaaaaaagccgaaacaaacagggccaactgtcttgtcttgctgccctaccaaaccttctgcaaaattttttttcaagatgtttgtcaggtgtatgtgtggatgtgttttttctgattcaactcttgtgattgattccatgaaatgcataacaagatgtccatgccatgcgtgaaagtgaagccgattgtaaatgacggcgctgcccctgcttgactctcagaaacacaaacacccatgttctgaactagctcgccatgtatgcctncagtctcccttgattcatggcatccattcttcatgatgtggatcaagatactctattatgctc

SEQ ID NO: 1098 - DNA, 2243 bp, Zea mays
  Clone ID: PAT_MRT4577_141054C.1
cggacggccaccagccgctgcgtgcgttcgctttcccccgaaacgtgacccgagacgagctgcagagagaaaggagaagccgccatgaagtagcagcagctgcctcctagtcgtccccgttaaatccctgctcgccaagccacgactacgagcaccagccgtccagccccggtttttctcctcccgcccccgttccccgtcccgactcccgaccgacccaacccatatcagagattccttccttggtggcgctggcgtccgcgctggcgttcccgtgaggcggcccgcgcgcgaaggcggccgtgaccgaccgtccggagcttcatgcgccaggggcggcggctccaccccgtcgtttgatgggcaacgcatgcggcggcgcccttagatccaagtaccagcacagcttcaagcacgccgcgtcgtcgcagcgccacgcctcctccgagtacagcgccagcgccgtggccgacgactcgcccaggaagccgccaccgccgcccgccaccacggacgcccacgcgccgccgccgccgcccgccaccgccatgaggcgcggcggggccggcgcgccgccggacctggggtccgtgctcggccaccccacccccaacctccgcgacctctacgcgctcggcaggaagctcgggcaggggcagttcggcaccaccttcctctgcaccgagctcgccacgggggtcgactacgcctgcaagtccatctccaagcgcaagctcatcaccagggaggacgtggacgacgtgcgccgcgagatccagatcatgcaccacctctccggccacaccaacgtcgtcgccatcaagggcgcctacgaggaccagctctacgtccacatcgtcatggagctctgcgccgggggcgagctcttcgaccggatcatacagcgcggccactacagcgagcgcaaggccgccgagctcaccaggatcatcgtcggcgtcgtcgaggcctgccactccctcggtgtcatgcaccgggacctcaagcccgagaacttcctgctcgtcaacaaggacgatgacctctcgctcaaggccatcgatttcggactctctgtcttcttcaagcctggtcaagttttcaccgatgttgttggtagcccatattatgtagctccagaagttttgttgaaaaattatggaccagcagctgatgtatggacagctggcgtcattctttacattctactaagtggcgtgcctccgttttgggcagaaacacaacaaggaatatttgatgctgtattgaaaggtgtcattgattttgattctgatccgtggcctgtcatatctgatagtgcaaaagatcttataagacggatgctgaatcctcgctctgccgagcgcttaacagcacatgaagttctatgccatccatggattcgtgaccatggagtagcttctgaccgtccactggatccagctgtcttatctcgcattaagcaattctctgcaatgaataagttgaagaaaatggctttgagagtaatagctgagagcctatcagaagaggaaattgcggggttgaaggaaatgttccagaccatggacactgacaacagtggcgcaattacctacgatgaactaaaagaaggattgagaaaatatggttccacactgaaggacactgagattcgtgatcttatggatgcagctgatatcgacaacaatggaacaattgactacattgaattcattgctgcaactttgcatctcaataagctggagcgcgaagaacatctcgtggcagccttttcatatttcgacaaagatggtagtgggtatatcacagtggacgaactacagcaagcttgcaaagagcataacatgccggatgcttttcttgatgatgtcatcaacgaagctgatcaggataacgatggccgcattgactatggagagtttgttgccatgatgaccaagggcaatatgggagttggtcgacggacaatgagaaacagcttgaatatcagcatgagggacgcacctggtgcattctgagacttaacacgatgtacagcttgtggcctagtcacttcctcttctgtcttgtcttgctgccctacgaaaccttctgcatttttttttcaagatgttatcaggtgtatgtgtggatgtgttttttctggggattctgattcaactcttgtgattgattccatgaaatgcataacaagatgtccaaaaaaaaaaaaaaaaaaaaaaaaaaaaaaaaaaaaaaaa

SEQ ID NO: 1099 - DNA, 2334 bp, Zea mays
  Clone ID: PAT_MRT4577_141056C.1
ccggccgggaaagttaccaagctacagagagagaaaggacaagggaggagaagccgccatgaagcagcggcagcagcagcagcctcctagtcgtccccgttaaatccctgctcgcccccggtccgcgaccccgacccaacccgtttgtgtcgtaggcggtttgcactagcgtttccgtgaggtgggcgaaggcgtccgtgaccgaccgaccgaccgaccggagcttcatgcgccaggggcggcggcttcaccccgtcgtttgatgggcaacgcatgcagcggcgcccttagatccaagtacctgcacagcttcaagcacgccgcgtcgcagcgccacgactccgagtacagcgccagcgccagcgccgacgactcgcccaggaagcccacaccgcccgccaccacggacgcccacgcgccggcgccgcccgccgccgccatgaggcgcggcgcggctggcgcgacgccggacctcgggtccgtgctcggccacccaacccccaacctccgcgacctctacgcgctcggcaggaagctcgggcaggggcagttcggcaccacctacctctgcaccgagctcgccacggggatcgactacgcctgcaagtccatctccaagcgcaagctcatcaccaaggaggacgtcgacgacgtgcgccgcgagatccagatcatgcaccacctctccggccacaagaacgtcgtcgctatcaagggcgcgtacgaggaccaggtctacgtccacatcgtcatggagctctgtgccgggggcgagctcttcgaccggatcatacagcgcggacactacagcgagcgcaaggccgccgcgctcacaaggatcatcgtcggggtcgtcgaggcctgccactcgctcggggtcatgcaccgggacctcaagcccgagaacttcctgctcgccaacagggacgatgacctctcgctcaaggccatcgatttcggactctctgtctttttcaagcctggtcaagttttcaccgatgtagttggtagcccatattatgtagctccagaagttctgttgaaaagttatggaccagcagctgatgtatggacagccggtgtcattctttacattctactgagtggtgtgcctccattttgggcagaaacacaacaaggaatatttgatgctgtattgaagggtgccattgattttgattctgatccgtggcctgtcatatctgatagtgcaaaagatcttatcagacgaatgctgaatcctcgccctgccgagcgcttaacagcacatgaagttctatgccatccatggattcgtgatcatggagtagctcctgaccgtccactggatccagctgtcttatctcgcattaagcaattctctgcaatgaataagttgaagaaaatggctttacgagtaatagctgagagcctatcagaagaggaaattgcggggttgaaggaaatgttccagaccatggacactgacaacagtggcgcaattacttatgatgagctaaaagaaggattgagaaaatatggctccacactaaaggacactgagattcgtgatcttatggatgcagctgatattgacaacagtggaacaattgactacatagaattcattgctgcaactttgcatctcaataagctggagcgtgaggaacatctcgtggcagccttttcatatttcgacaaagatggtagtggctatatcacagtggacgaactacagctagcttgcaaagagcataacatgccggatgcttttcttgatgatgtcatcaacgaagctgatcaggacaatgatggccgcattgactatggagaatttgttgccatgatgaccaagggcaatatgggagtcggtcgaagaacaatgagaaacagcttgaatatcagcatgagggacgcacctggtgtgttctgagacttaacacgatgtacagcttgttgcttggctacttcctgccttgctgccctacgaaaccttctgcattttttcaagatgttgtcaagtgtctgtgtggatgtgtttttctggggattctgattcaactctggtgattgattccatgaaatgcataacaagatgcccatgtcacgcaagaagccagattgtaaatgctgctgcccctttgactctcagaaacactaatgctcagtgaaaagaaatcgctccctatgcatgtctccagtctcccttgattgatggcatccattcttggatgcacgctgtatctcaatgcaatgtgttgctccgtttggatgaacatgtactcaatatactgtttcctgataccaaaaaaaaaaaaaaaaaaaaaaaaagtcgacgcggccgcgaattcggat

SEQ ID NO: 1100 - DNA, 1682 bp, Zea mays
  Clone ID: PAT_MRT4577_141133C.1
aggaaatcaggtgggggaaaacttaaaattagaagtccagcgcaataattgggcaggcagggcccctcctaatcactgcccctaaacatgtgtgccgggccgaggccatgatcgatgcagggaggaggatgctgccgctgctctggagtgaatcactagtataaagcaggcggagacagccggcccctctggcctcgctgctcccccttcctccccgtccccacccacatgccctgcctccgccccgccccgccctgcccaagctgagttcccccacccccaacaaacaattactagagtagctgcattggcggggaaattaaagcgctagaagctcagcagcaatggcggagcaggcgggcgccggaaggtactggtgccacatgtgcgccgcggccgttagccccgcggagggcgaggtggagatgaagtgcccgttctgccacagcggcttcctcgaggagatggagaccgcccgcggggccgcgaccgacgacggtgacggcgacggcgacggcgcggtggctcaggtgcaccccggcgccgaccgcccgagctccatctgggcgcacgctatcctcagcacggtcgacagctccgcccgtcgccgccgcaaccggcggcagcaggaggccgccagcgacgtctacgactggaacgaccccgagttctcgctgcgccggcggcgcgtcaccgcgttcctgcggctcctgcacgagctccgggaccgccagctgcagcggctggagtccgctgccggcgtcgccctcgaaggcgaccagctgaccccgttcggccggagcctcttcatcggcgcagctggcggcgagcatggcgtggcgctgggcgactacttcctcggccccagcctcgacgccttgccacgcctccgcgccgagaacgatgcggcgcggcacggaacgccgccggccaagaaggaggccgtggaggcaatgccgaccgtggaaatcgccggcggcaacgatggcgacgacgcggccagctgcccggtctgcctggaggactacgcggccggcgagcgcgcccgcgagatgccctgcaggcacaggttccacggcaattgcatcgtgccgtggctcgagatgcacagctcctgccctgtctgccggttccagctgccggccaccgacgacaagagctcatgcagcggcggcgacggtggtttcgtcagtgtcgatgcggatcgtgaaggcagtgacaacggcgggggtgatggtagggcaagctctccgggcaacgccgagctagctgaagctgaagagagtggcaggcggttgccgccatccttgcagtggctcaacagcctgttctcgccgtcggcgcagtcctccggtagcggcggcagcagttcgcatcattgggagaactaagcaatattgccatggttgctgccgcttgaaagcttggcccgttggttggtcccaatgtacataggaaggagcaggagcgcatgccgggttggtgccatggaaaaatctggagccttttttcagtttggctcatgttaatggtctctgatatgtatcatggctgtaaaaaagaacagaaatgggcaaatgtatgaacttgccgcgctcttgcgtgaactgggtgctaatcatcgtcttactactcaattttggtttttattaacaaaactatagtatttatgaaaaatacca

SEQ ID NO: 1101 - DNA, 712 bp, Zea mays
  Clone ID: PAT_MRT4577_141167C.1
ccggccgggccttttgtgcaaaagagactctctccctcctaccacacacagcctccggactgctccggacgcgcgcctcagatctactccaacacctgtaaggattcctctggccgtgtggcctttccggcaactatagctagcggcggcgcccgcgggtggaggagcaggagcaggagcggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaaatccttgacgagatcagcggtctggaaagaagagaacgcagctgatcgaggagaactcaaggctgaaggagc

SEQ ID NO: 1102 - DNA, 853 bp, Zea mays
  Clone ID: PAT_MRT4577_141169C.1
cctcgaggccggccgggcctttgcgcaaaagagtactctctccctcctaccacacacagcctccggactgctccggacgcgcgcctcagatctactccaacacctccgcagcggcggcgcccgcgggtggaggagcaggagcaggagcggcggcgccatggtcgggaccgggaagagggagcggatagcgatacggaggatcgacaacctggcggcaaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaagtccgaaccgcagtcgtctcaactgcagtcacatatggatgacggcacttgtgcaaggctaaaggaggaacttgctgaaacaagccttaagctcaggcagatgagaggagaggagctccagaggctgagcgtccaacagctacaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgacccagagttcgtgtacgaggaagggcagtcgtctgaatccgtgacgaacacgtcctatccgcgcccgtcaccgacaccgacgactgctccgacacatcgctcaggctcgggctaccattcttcagctcaa

SEQ ID NO: 1103 - DNA, 1523 bp, Zea mays
  UNSURE (1)..(1523): unsure at all n locations
  Clone ID: PAT_MRT4577_141171C.1
  unsure (1)..(1523): unsure at all n locations
acctcctaccacacacagccttcggactgcttcggacgcgcgcctcagatctactcgaacacctggaaaatatagctagggttctccttctcccctccctccgcccgcttgctcttggacggtgcttcctcttctttaccagctagtcaaagtaaccacgcgtgctgcttcatctctcccttccttcctgccgtgtggttgttggcagccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaatacgtgacggggtatccgctgcctgcagtccgtgacctgtctgtcgtctctgtttctagtacccgtataatcaccctgcaattacctgcagctggtcatcgttaggagaaactccagtccatgcaaatgaactcccagcacttgtgctcttcgcggtatcagatatgctacgtngttctttgcagtnggaacttcgatgnnaatttngcaatagcatacggagcaggtgcagagccttcagcaatngagggtaaaantgaagaagcccaaagaaaaaaaaggggttctttggcgtcacaggggntanactttaatgatgaagtaggtcaagcaaaaggtgg

SEQ ID NO: 1104 - DNA, 211 bp, Zea mays
  UNSURE (1)..(211): unsure at all n locations
  Clone ID: PAT_MRT4577_141465C.1
  unsure (1)..(211): unsure at all n locations
ccccacncgccaggcgcagcagcaccggggagccangggacgccagcggagccggnagcaggggaagagggggcggccgggcgcaaggcaggcggccccaggaaggaancggngacgcggnccggcaaggccgggccgcagggccccggcggccggaccgggcgccaccngaagagggccggaacgcgcagcgcgngggcacgggcgcccc

SEQ ID NO: 1105 - DNA, 1134 bp, Zea mays
  Clone ID: PAT_MRT4577_141627C.1
cccgggcaggcgatagccatcttcttctctgcttatcagctatagccatcttcttctcttctctgaattccagtccaagggccggaataccgtcagagcagagggagtgggaggaagaagaaaaaaagatggtgaagctcgcatttggaagctttcgcgactctttgagcgccgcgtcgctcaaggcctatgtggccgagttcatcgccacgctgctcttcgtgttcgccggcgtcgggtccgccattgcctactcgcaattgacgaagggcggcgctctggaccccgccggcctggtggccatcgccatcgcccatgcgttcgcgctcttcgtcggcgtctccatggccgccaacatctccggcggccacctgaaccccgccgtcaccttcggcctcgccgtcggcggccacatcaccatcctcaccggcatcctctactgggttgcccagcttctcggcgcttccgtggcgtgctttctcctgcagtacgtcacacacggacaggctatcccgacgcacggcgtctccgggatcagcgagatcgagggcgtggtgatggagatcgtgatcaccttcgcgctggtgtacaccgtgtacgccaccgcggccgacccgaagaaggggtccctgggcaccatcgcgcccatggccatcggcttcatcgtcggcgccaacatcctggccgccggccccttcagcggcggctccatgaacccggcccgctccttcggccccgccgtggcggccggcaacttcgccggcaactgggtgtactgggtcggccccctcgtcggcggtggcctggcggggctcgtctacggcgacgtcttcatcgcctcctaccagccggtcggccagcaggagtacccatgaaagtccggagctagcccgatcgatccgtctgtgttgatttcaccatcgtcgtcgtcgtgtcatctggcgcttcgtgctgtaatcatgtttggtcctgtttgcatttcccaacgtctggttttcatttccattcaccaacggtgccaagatgccgtactgtaagcgagagaagtgttcggtctgtatctgtataaatgcaatgcacagttcggcgtttccatgaaaaaaaaaaaaaaaaaaaacccctagggcctagaac

SEQ ID NO: 1106 - DNA, 471 bp, Zea mays
  UNSURE (1)..(471): unsure at all n locations
  Clone ID: PAT_MRT4577_141669C.1
  unsure (1)..(471): unsure at all n locations
ggggggggggggggggaacaaaaccttgctcattcttctctcgtgtcgtgtcatagcgggggcgaccaaagcgagacaacagggggccaacacctaatccaagggggaacgggcactaacacggggacagagagcgaacggggacacgaggggtgtggagggagaanataactcgggccaagccagggatggggccacacatnagtccctccagcgcgggccgccaccgccgccgtagccggcaccggcaccctcgcgccgaccgccgtagccgccaccggctccgtaggcggcgccggcaccttcgcgccgaccggcgtggggggcaccgccgccataaccgccgtcacggcgcccggcaccataaccgccgtcgccgccgcgaccgccgccgtagccaccggcggcaccggcaccgccacgggactgggcctgggtaacggggatgttacggggcgggagctccttgcc

SEQ ID NO: 1107 - DNA, 1561 bp, Zea mays
  Clone ID: PAT_MRT4577_141711C.1
cctcgaggccggccgggggaggagtcccctctctctctctctatatacctttcttgcccaagcagtcaatcaagctgggaaacttaaacagaaagcgaagcaattaaaggccaccaccgccttcacttgttccttttggttattttcctcttgctgtggcttaacttgacaagaagaagaggaagaagatgctacgtcggcaaggccgaggtggaaaatttctggaggaggtgctcatcgtcggcgggctcctgctggtgcagtgcgtgctctccggctacgtggtcttcaccgaccacctgctcgccctcggcgccgacccgctggccgtcgtcgtcgtcgccggagccgcctacgccgccttctgctttcccttcgccgtcgccctcgagaggaagcgatggccttccacggtttcggggactctggtggcgcaatacctgctcattgctcttggagggacaaccgcgttccaagcgctgatgctgctggggatcaagaagaccacgccggccatcgcatccgccatgcccaacctcagccccggcctcatcttcatcgtcgcagcctgtttcaggctggagaggttcgacagggcgtgcaagtacacgcaggcgaagatggcggggacggtggtgtgcctggcgggagcgctggccatgggcttcctgcacagcccaacttctacgtcctcctctctgcaggcagcagtagctgcggaagcagcagcaggaggtggcgactactactacgactggatcctcggctgctgctgcctcgtcgccgccgtcaccgtcttcgcgctcgtcaccgtcctgcaggccgccacgctcgccgccttccccgcgccgctcaccatgtgctgcgccacctccgcgacgggcgccgctctcaccgccgtcctgcggctcgtcctggaagggaggttcctcggcatggggtcgcccaggatcgacgccacgctcgtcgcgggggatcgtcgtcctcggcggggccgcggtgggcgcgtgcatggcgttccaggcgtggtgcctgggcaggaagggcccgcttttcgtctccgtcttcgggcccgtccagaccgtctgcaccgccatcctctccgcggctctcctccgccaagtcctcagcctgggaagcctcgcagggatcgtgctcatgttcactgggctctacattgtcctatgggccaagagcaacgagatctcggctgacgacgaggaacagtcgttgcagggtggcgacgacgccgagaaggcactcctagcctagcctagcaaaatccagagcgaatatcactgcacgctctgtatttgtaaaaatggaatggtgtctacgtacctgtatacatactcgagaggatttagagaaaaaggacatggctacgtttgttcataatatgtatatactggaaatactccctcccctctgtatttgtaaaaatggaatggtgttggtgtctacgtacatactcgagaggaggatttagagaaaaaaaaggacatggctacgtttgttcataaaaaaaggaaacaagaaaagaaaaaaaaaaaaagcggcc

SEQ ID NO: 1108 - DNA, 1121 bp, Zea mays
  Clone ID: PAT_MRT4577_141718C.1
aacatatcaagctcagagcctcagagcgccagccaagtcttgcggtcgcgaagagcaacgcaacaagatggtgaagctcgcattcggaagcgtcggcgactccttcagcgtcacctccatcaaggcctacgtggcggagttcatcgccaccctcctcttcgtcttcgccggcgtgggttccgccatcgccttcgggcaactgacgaatggcggcgcgctggaccctgcgggactggtggcgatcgcggtggcgcacgcgctggccctcttcgtgggcgtctccgtggccgcgaacacctccggcggccacctgaaccccgccgtgacgttcggcctggccgtgggcggccacatcaccgtcctcaccggcctcttctactgggtggcccagctgctgggcgcgtccgtggcgtgcctgctcctcaggttcgtgacccacggcaaggccatcccgacccacggcgtctccggcggcaccaccgagctggagggcgtcgtgttcgagatcgtcatcaccttcgcgctcgtctacaccgtgtacgccaccgccgccgaccccaagaagggctccctcggcaccatcgcgcccatcgccatcggcttcatcgtcggcgccaacatcctcgccgcggggcccttcagcggcggctccatgaaccccgcccgctccttcggccccgccgtcgccgcggccgacttcgccggcaactgggtctactgggtcggcccgctcatcggcggcggactcgctggcctcgtctacggcgacgtcttcatcggcggctcctaccagcaggtcgccgaccaggactacgcctaagtagtgtgctccgttcgtctggattcagctcatccaacgcaggcgcgcgtttcgatcggcgtcgtcatttgctttgctcttcatttcatcacgttatgtaacgtgccaatgatgtgtgtcgtcctggtctgttccattccgtccttgtattcatttcccttcttttttcggggtaaaatcgatgtaaagatctcatccgatctgccgttttcgatcgccttggagtggaaaaaaaacaggtgattttcgtttcgacttcgtttatgcatggaattcttggctccttttacggtttgtatcc

SEQ ID NO: 1109 - DNA, 209 bp, Zea mays
  Clone ID: PAT_MRT4577_141731C.1
acaaaaaaaaaactttttttcccagtttattccacagaagacgagagattttattttgcaagggggtgaacatacttgacaccctcacatgcgtgggcccccaacaacagaagcggcagcaattaattattattggttccctttcacgcccgaaaaggcgacaaacccaaataattaattggatcatcaactcatcgtacccagcaaag

SEQ ID NO: 1110 - DNA, 1232 bp, Zea mays
  Clone ID: PAT_MRT4577_141787C.1
ctcgcgttacgttgctgtcgttattgctggctgggtcgacctgacccggggatggttctgcttctgctttaccactcaatctggttgagagtcgccggcgccggcgattcctcctccaccgattcgcccggcgggagtctccgcagggctcaccgggaccgcgggtccacgatggccgccaacttctggacgtcgtcgcactgcaagcagctgctggaccccgaggacgtggacctggtgccggcggcggaccgggagcgaggcatcacgccggaagagttccgcctcatcaagatccatatgtcgttccatatctggaggctagcacagcaggttaaagttaggcaaagagttgtagctacagcaatagcttacttcaggcgtgtgtatacaaggaagagcatgtcagactatgatcctcgtttggttgcacctacttgtttgtatttggcatctaaggtggaggagagtacagtgcaagcccgacttcttgtattttatataaaaaagatgtgtggttccgatgataagtatcggtttgaaattaaggatattcttgaaatggaaatgaagctcctggaagctctcgactattatttggttgttttccatccatatcgtcctctcttacagttgttgcaggatgctggcataacagacctgacacaatttgcctggggccttgttaatgatacatacaagatggaccttatcctcatataccctccctacatgattgcactggcctgcatatacatagcgagtgttttgaaagataaggacaccacagcatggtttgaagagctccgtgttgacatgaacatagttaagaatatctctatggaaatattagacttctatgacacctacaagattgatcctcaaaggggcatccctgaggataagataagccccgtgatgaacaagttgccggcaaaggcttaactcagatttggcgagcttaggagttgtaaactagtagtaaactacatcatacttccaccatgtgtgtactcagcctgcactgtcgcttgtgacgtgttgatgaactacttgatagattcaatgcaagaaccccatggaattgtttgtgtaaaaaaaaaaaaaaaaaaaaaaatgctgctggagtttattcaagttagtagcatctgcatctattaactatttattacgattgttattccagggttcttgatatatattaatatgaaaggtgctatttgttttacccg

SEQ ID NO: 1111 - DNA, 2191 bp, Zea mays
  Clone ID: PAT_MRT4577_141944C.1
ccgggcatgtagtttttacggtgcggccccgcgaccattcgaaagatccctccaggaaagatttttcttccctcctccgacgccccagcccaccaacacactctataaagcagcccccagtcacacacagaacgcacaagcgcaagccgggcaagaaaactccgcaggccagtctgcgagttggatggccttcttcttggccctcgtgtgcatcctcgtcttcctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacgctgtcgtttgatgtgggcatcgtgacgatcttcggcggccggctggacgagcggcgcaaggcggagctgaggaagaattactccgtcgtggagaaggggtacaactccttccccaacagcctgccggggacgctccattacaaggcgatgcaggcgcggcggcggctgcacggcgtgctgtgcgacatcatgcgggagcgtcgtggccaggcccaggcgggcaccaccggcctgctgggctgcctgatgcggtcccggggcgacgacggcgcgccgctgctgagcgacgagcagatcgccgacaacgtcatcggcgtgctgttcgcggcgcaggacacgacggccagcgcgctcacctggatcgtcaagtacctccacgaccaccccaagctcctcgaggccgtccgggcggagcaggcggcggtccgcgaggccaccggcggcgggaggcagccgctggcgtgggcgcacacgaagagcatggcgctaacgcatagggtgattttggagagcttaaggatggcgagcatcatctcgttcacgttcagggaggccgtggccgacgtggagtacaaagggttccttatccccaaggggtggaaggtgatgcctctcttcaggaacatccaccacagccctgactacttccaggatccacacaagttcgacccttctagattccaggtggcgccgcgtccgagcacgttcctgccgtttgggcacggcgtgcacgcgtgccccgggaacgagctggccaagctcgagatgctcgtcctcatccaccacctggtcaccggctacaggtgcgtccatctcctctcagatcctctccatatattccccgcttgttgtatagcttctggaccaagaatgacacatggctggctcgtcttcactagccccgctgtgctctccctcctatataaactgtgagcatggcatcgactgctataacgacagtttactgatcttacactgaggcactgattggcgtctctgcatgctttatttttaaatttgcaggtggcaaatcgttggatccagtgacgaggtcgagtacagcccgttccctgtgcccaagcacggcttgcctgtcagattatggagacaaaacaatccggtcgacagaaaggggcgtgagaccgacgacgatcatgtggagaggatattttagtttgactcttgagttaggcatgaatttaaccccaagctagctagagaagtttttttttcccctttgaaattcttctttgctcgcctcttcctcctggatcaaattacgttggaggagaagaaacggcagctttctctctttcgttttctttgcctgcttcaccgcgacgataatggtgaaaatatgtaagctacgtggacatcaatgatccacagcatcgttgatatatataatatatagagaaaattctctgcacaaaaaaaaaaaaaatatccggtatcttatttccc

SEQ ID NO: 1112 - DNA, 1960 bp, Zea mays
  Clone ID: PAT_MRT4577_141949C.1
ccgggcatgtagtttttagggtgcgaagtctccaccattcgaaagatccctccaggaaagatttttcttccctcctccgacgccccagcccaccaacacactctataaagcagccctcagtcacacacagaacgcacaagcgcaagccgggcaagaaaactccgcaggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaccttctgggttgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacgctgtcgtttgatgtgggcatcgtgacgatcttcggcggccggctggacgagcggcgcaaggcggagctgaggaagaattactccgtcgtggagaaggggtacaactccttccccaacagcctgccggggacgctccattacaaggcgatgcaggcgcggcggcggctgcacggcgtgctgtgcgacatcatgcgggagcgtcgtggccaggcccaggcggcgggcaccggcctgctgggctgcctgatgcggtcccggggcgacgacggcgcgccgctcctgagcgacgagcagatcgccgacaacgtcatcggcgtgctgttcgcggcgcaggacacgacggccagcgcgctcacctggatcgtcaagtacctccacgaccaccccaagctgctcgaggccgtccgggcggagcaggcggcggtccgcgaggccaccggcggcgggaggcagccgctggcgtgggcgcacacgaagagcatggcgctaacgcatagggtgattttggagagcttaaggatggcgagcatcatctcgttcacgttcagggaggccgtggccgacgtggagtacaaagggttccttatccccaagggtggaaggtgatgccgctcttcaggaacatccaccacagcccggactacttccaggatccacacaagttcgacccttctagattccaggtggcgccgcgtccgagcacgttcctgccgtttgggcacggcgtgcacgcgtgccccgggaacgagctggccaagctcgagatgctcgtcctcatccaccacctggtcaccggctacaggtggcaaatcgttggatccagtgacgaggtcgagtacagcccgttccctgtgcccaagcacggcttgcctgtcagattatggagacaaaacaatccggtcgacagaaaggggcgtgagaccgacgacgatcatgtggagaggatatttttagtttgactcttgagttaggcatgaatttaaccccaagctagctagagaagttttttttcccctttgaaattcttctttgctcgcctcttcctcctggatcaaattgcgttggaggagaagaaacggcagctttctctctttcgttttctttgcctgcttcaccgctacgataatggtgaaaatatgtaagctacgtggacatcaatgatccacagcatcgttgatatatataatatatagagaaaattctctgcaaaaaaaaaaaaaaaataggccccta

SEQ ID NO: 1113 - DNA, 945 bp, Zea mays
  Clone ID: PAT_MRT4577_142197C.1
cctcgagggcctggccggaaaaaaaaaaaaaaaaaaaaaaaaaaaaaaaaaaaaaaaaaaaaaaaaaaaaaaaaaaaaagggatctcccacctcgatccctgcactgcaagcaacaaagttctactctttccacccgtccatctagctcccaagaaccaatccgtaccagcgctatatccggcggtccggcctgccatggcggcggcgggccggctctccctgcccctcgtcctgctggtcgtcctggccgtcgccggccgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgatggcacgtacccgcagaactgcagccccgacaacgccttcaacccgtcgaaggtgagcgacctaatgagcagcctccgcgccaagtggccgacgctggcgtgcccgtctaacgacgggctgcgcttctggggccacgagtgggagaagcacggcacctgcgcagccgacgtcttcgacgagcacggctacttccaggccgcgctgcgcctccgcgaccagctgggagtcctcggcgcgctcacctccgccggcgtcaagcccgacggcggctactacacgctgagccagatcaagggcgccatccgccagggcaccggcttcgagccctacgtggagtgcaaccgcgacgaggccggcaacagccagctctaccagctctacttctgcgtcgacgccgccggcgacagcttcgtcgactgccccgtcctccccagcggcaggcccttgcattctatgcaagaggataatggaatgttcattccccattcttcatttttttttgcaaataaaaggagggcgatcggtgttccatattt

SEQ ID NO: 1114 - DNA, 1178 bp, Zea mays
  Clone ID: PAT_MRT4577_142201C.1
gcacgaggtggatccacatccaccctagctgcctcccgatcccacgcccaaagcttcctataaatgcgcacccccagcccggccgggccgggatctcccacctcgatccctgcactgcaagcaacaaagttctactctgtccacccgtccatctagctcccaagaaccaacccgtaccagcgctatatccggcggtccggcctgccatggcggcggcgggccggctctccctgcccctcgtcctgctggtcgtcctggccgtcgccggccgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgatggcacgtacccgcagaactgcagccccgacaacgccttcaacccgtcgaaggtgagcgacctgctgagcagcctccgcgccaagtggccgacgctggcgtgcccgtccaacgacgggctgcgcttctggggccacgagtgggagaagcacggcacctgcgcagccgacgtcttcgacgagcacggctacttccaggccgcgctgcgcctccgcgaccagctgggagtcctcggcgcgctcacctccgccggcgtcaagcccgacggcggctactacacgctgagccagatcaagggcgccatccgccagggcaccggcttcgagccctacgtggagtgcaaccgcgacgaggccggcaacagccagctctaccagctctacttctgcgtcgacgccgccggcgacagcttcgtcgactgccccgtcctccccagcggcaggccctgtggcaaccggatcgagttcccggctttctaagctaactcactcttcacgtcagttgctgcaatatactgctagtccttttgcttgcattctatgcaagaggataatggaatgttcattccccattcttcatttttttttgcaaataaaaggagggcgatcggtgttccatatttattatgttgatcataacatgacattcagagaacaattcataagttcaaaaaaaaaataaaaaaaaaggcccctagggccaaaaaaaaaaaaaaaaaaaaaaaaaaaaaacccaataaaaaaaaaaaaaaaaaagcggcc

SEQ ID NO: 1115 - DNA, 217 bp, Zea mays
  UNSURE (1)..(217): unsure at all n locations
  Clone ID: PAT_MRT4577_142367C.1
  unsure (1)..(217): unsure at all n locations
cccacgcgtncgccgacgcccagaattcacgtgaacgcacacgcacccacacgacacatacaggagaggcttanggtttccccgtgcccggccgccacagtgccaacccagctctccggtgcgcccgcgacccctgctcccgtcgacagggtggcagcgccgtgcggagtcgactcgccgtccgctggcgccgtgtgcagggccgcgggcaagggga

SEQ ID NO: 1116 - DNA, 962 bp, Zea mays
  Clone ID: PAT_MRT4577_142410C.1
ataacccaaaatagtaaatgccatgtttttcttacatgaaagtcaagcgattttgtttaaaaaaaaaaaaaaaaaaaaaagccaagcaagaccagctgtcgatccaattgtcacttgctctccctccaacaagctaattaaggccggtccatccctcttctagctcgtttcattatccatggctgaggagaagcaccacccaccaccacctgttccaccacaagaaggacgaggagcaggccgcggccggcgggtacggcgagtccgccgagtacacggaggccacggtgacggaggtggtgtccacgggcgagaacgagttcgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctagctgattgatcctcccatatcgatcgtcgtccctccccgtttgctacgcgtgcgtgtgagagtgatatcgagcgccggccggcctgcacgcccgccgtgttgtgcgtacgtacgtacgtatacatgtatgtatgtatatgcgcgcgtgtgatgcacgaataagcgtggctacgtaatctatcgtatgtatacgtgtgtgtatatatgcatgtgcccgtgtatgatcttgctacgacgaccgaaaaaaatgtatgcaactctgatttgcttatatgtttacgtctgtccaaaagtattagtcccaattatattatattgattattaaaccaaaaaaaaaaaaaaaaaaaaaaaaagtcgacgcggccg

SEQ ID NO: 1117 - DNA, 805 bp, Zea mays
  Clone ID: PAT_MRT4577_142413C.1
gacaagcaagaacagctgtcgatccaattgtcacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaagaaggaggagaagcagcataagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatccctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgtttagttgtttacgtttctccagaaaaaaaaaaaaaaaaaaggccccta

SEQ ID NO: 1118 - DNA, 2113 bp, Zea mays
  Clone ID: PAT_MRT4577_142415C.1
gaattactaaataaaaaaagttggcccctctgctgtatcccttcccctatctgcagcagagcagttcctttcttgctctcctccgctagtccggtaccctcgacctcggcgtcccaccgaagacgacctcacgcggagctgggaatattccttcgcctccgtgctccctttagcaccaactgtcacggccgcttccagcacgcatcattctcgtctcccgtctcgagagattgcagggggcggcgctcgaagctggaggaagcggacgggttcgcgatggggtccgagggatcctcgggtccggtcgtcgttcccagaaactttaggctgctagaagaactagaacgtggtgagaagggcattggtgatggaactgtgagctatgggatggatgatgctgatgacatatatatgcggtcctggacaggaactataattggtcctcccaatactgttcacgagggacgaatctaccaattaaagctgttttgtgatacggattatccagataaaccaccgacagtccgattccagactcggatcaatatgacatgcgtgaaccaagaaactggattggttgaaccaagtctatttcctatgcttggcaagtgggaaagggaacatacaatggaggacatcctggccagcttaaaaagggagatgtcaactcctcagaaccgcaggctgtaccaacctcatgaaggtaacgaagatcaaagagtagagcagaaagggctgtcccttagatgtgtcgtcatgtaataatgtacatttgaattgagcagcgagatgccgagcttgagcgaaccctcttagggcatgtttaggaacaatcccctccaattcccttgctttcaaagaagccctgtaggaaccctcctgtagctcaccttaatcatgccgccatcgcaataaagtgtcgatgactgttaaattgcctgcacggctgcacaccatgtaacagcaaccgattcgattttctgtgaaggacaacgtgttcagtgtcggctgttccacaaaaaaaaaaaaaaaagctgtcgatccaattgtcacttgctctccctccaacaagctaattaaggccggtcatccctcttctagctcgtttcattatccatggcggaggagaagcaccaccaccaccacctgttccaccacaagaaggacgaggagcaggaggagcagctcgccggcggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatccctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgtttagttgtttacgtttctccaaaagtattagtacccattatgttatattttactatattatattttattgattattaaaaaaaaaaaaaaaagggcggcagctcgcgatctagaactaggacgcccgtcacctccagcccgctcatcgcgtggtacctctccaacctgccggcctaccgcaccgccgtgagcccgctgctgcggggcgtcgaggtcggcctcgcccacggctacctcctcgtcgggcccttcgcgctcaccggcccgctccgcaacacgcccgtgcacggccaggcgggcgcgctcggcgccgccggcctcgtcgccatcctcagcgtct

SEQ ID NO: 1119 - DNA, 1709 bp, Zea mays
  Clone ID: PAT_MRT4577_142418C.1
gaaaaaaaaagaccagctgtcgatccaattgtcacttgctctgcctccaacatgctaattaaggccggtcatccctcttctagctcgtttcattattcatggcgtgatgagaagcaccaccaccaccacctgttccaccacaagaaggacgaggagcagctcgccgccggcgggtacggcgagtccgccgagtacacggaggccaccgcgacggaggtggtgtccacgggcgagaacgagtacgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctgattgatcctcccgtatcgtcgtccctccccgtgtgctacgcgtgcgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgtttagttgttaaaaaaaaaaaaaaaaagcaagaacagctgtcgatccaattgtcacttgctctccctccaacaagctaattaaggccggtcatccctcttctagctcgtttcattatccatggcggaggagaagcaccaccaccaccacctgttccaccacaagaaggacgaggagcagctcgccgccggcgggtacggcgagtccgccgagtacacggaggccacggtgacggaggtggtgtccacgggcgagaacgagtacgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctgattgatcctcccgtatcgtcgtccctccccgtgtgctacgcgtgcgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgtttagttgtttacgtttctccaaaagtattagtacccattatgttatattttactatattatattttattgattattaactatgtatggatgaaatactatttcaagctggtagctagaccgagataaaactcgtccgtgttttttaacgggtgtattattttttccaagttaaatattgtttgcgaaaaaaaaaaaaaaaaa

SEQ ID NO: 1120 - DNA, 2589 bp, Zea mays
  Clone ID: PAT_MRT4577_142494C.1
cctcacgtccgcccactcgtacgagcacagggggtgtaacttagagagtgtgggatttacatgtagttgatcctatgtaaatacgcctaaggatggaggaggtgaacaagttaccaattggatcttttgtccacgcaccttaatttgcatgcacaagtctaaatggacttatataagtctatggaagagtatctactgtcaaattccgttataggcgaaaccgcaaaacaaactacagtactgcacaattgtggttatcttatcaacatggacctcgagccggcgatcgacctcacttcccgttaacttaccctattacctttctgctcgtggtgagtgctgacaccacctcacgcacgcaagccgccggcggcgaccagaccgaccacctcgcgcactagccttgctcgcttctcgtcgccggctcgttgccggctcgtcggcacgatgtcgtcggagcctccacccgccccttctgccgccgccgcagagggactggctgctgacctttccgccgccaccctcagcaagaagcagcagaagaaggacgccaggaaggcggagaaggctgagaaggcggcgcagcgccagcaacagcagcagccggccgacgccgaggacccatttgcggccaactacggtgatgtccccgtcgaggagatccagtcaaaagccatttccggccgcttgtggtcccagatcggcgacctcgacgactcctctgcggggcgctctgtgcttatccgtggatccctgcaggctatccgcccggtcagcaagaagatggctttcgtcgtgctgcgccagagcatgagcaccgtgcagtgcgtgctcgttgccagcgccgacgccggcgtcagcacgcaaatggtgcgcttcgccaccgccttaagcaaggagtccatcgtcgacgttgagggcgtcgtgtccctccccaaggagcccctcaaggccaccacgcagcaagttgagattcaagtcaggaagatctattgcatcaatagggctatcccaacccttccaattaaccttgaagatgcagctcggagtgaggcagattttgagaaggctgaactggctggagaaaagcttgttcgtgttggtcaagatacccgcttgaactacagagctattgatctacgaacaccctcgaatcaagccatattccggatccagtgtcaagttgaaaacaaattcagagattttttgttgtcaaaggactttgttgggatccacacgccaaaattgatttctggatctagtgaagggggtgcagctgtattcaagcttctgtacaatggtcaacctgcttgtttggcacaatcccctcagttgtacaagcaaatggctatctctggtggttttgagcgagtatttgaggtcggccctgtgtttagagcagaaaattcaaacacacacaggcatctatgtgagttcgttggtcttgatgctgaaatggagattaaggagcattattttgaggtctgtgacattatagatggcttattcgtatcaatatttaaacacttgtctgaaaactgcaagaaagaactcgaatcaataaacaggcagtatccatttgaacctctgaagtatctagacaaaaccttgaagctcacttatgaagaaggaattcaaatgttgaaggaagccggaacagaaatcgagcctatgggtgacctcaataccgaagctgagaaaaaacttggtcggcttgtcagggaaaagtatgacacagattttttcatcctgtatcggtatcctttggctgtacgtccgttctacaccatgccttgttatgacaacccagcgtacaccaattcttttgatgtcttcattcgaggcgaggagataatatctggagcacaaaggatacacactcctgagctgctggccaagcgtgcaacagagtgtggaatcgatgtcagcactatctcggcctacattgaagtcttcagctatggcgcgcctccgcatggtggtttcggggtgggtttggagagggtggtgatgctgttctgcgccctaaacaacatcaggaagacctccatgttccctcgcgacccgcagaggcttgtgccgtaatttactgagtccaatgccctgagtttgcagcagagcgtactggttgttttgatgttctttgagcatcgaacatcgctaacttgcaatctcagctactgaagccccggttaccgtggttcagagttcctgttaaattcacaaagctacttgtatctattagattgctgaaaccagcaagtacgatcctttttgggatttgatctggtctaattgttgttaagtggaggtattgctctcagtttttttgtgctctgtttgtcggcatatgccaagagctagggcttcttaagttctaagtttttagacgagtggattccttttttttaagagccggcaaaagttctgccctgcacctgttaaaaatagatattaccctgttccaattctaaataatatgacgtgtcgccttctagatatttaaaatataaaaaaaaagtacaatatgtctagatacagatagtaaagtaatgtatgtctttataaagagagaagaattgtgctgcg

SEQ ID NO: 1121 - DNA, 2237 bp, Zea mays
  Clone ID: PAT_MRT4577_142527C.1
ggacctcagcggcgggtggatatgttctacttgtaaaaaaaaaaaaaaagccaaaaaaaaatttcgggactgttcctcattcacgtgtctcctcccctcccctcccctcccctccccttcccccatgacctgtccgtctcaatctccctcttccccgcaccaaatcgaagctacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcaggtcgaggaccgcggtgtcggtaagacttgctttgaagatcttgatcaccacaagagatttgctgaatttccggtcactgtactttttccactggacatgtcctttcgcagcatagtccgtgatgttagggaaagctttggtagcttatcaagacggagccttgaggtcaggatttctggtttgcctggtctgtctggtggtcatcatagagggaaatctgttggatctgtgagtgacctgcgcgacagacctgtagtagttgatcaaagcaggtgggttgggtcttcctcctgaattgcttcgagatgtaatgagaaggcttgaggaaggtgagagcaatttggccatcccggaaaaatggtgttgcctgtgcagccgtctgtggaacatggagagagatatgcaaggatatagtgctgagcccggagttctgcgggaagctcacttttccagtatcacttaaacagccgggaccaagaaatggaataatccagtgtttcataaaaagggacaaatcgacatcaacttattatctttacctatgtcttagccctgttgtcctcagcgaggatgggaagtttctgctagcagctaagaggaatcgccgtacaacatatactgagtacatcatttctgtggatcctaaaagtatatcacgatcaagtgatggctgtgttggaaaaatgaggtcaaattttcttggcactaaattcatcgtgcatgacactcgagcaccacacaatgctgggagccttgtctcctgtgagcgcggcagccgcagaatctcctctaggagggtttcccccaaggtacccactgccagctaccccattgcccgggtgaactatgagctaaacctgcttggcacaagggggcccaggcgtatgaattgcacgatgcattccatcccagcctcaacgctggaccctcaaggcatggtgcctgagcctggccaacccaagcagatcttcgtccctggctcgtcgtccttcgaagattcctttcgcagtgcaaacaacaccccttccagctcaaggttctcggtcgcagaccgctccttggattggagctcctctcgattctcagagacgagcggattggctcagcaggacgacgatgacagtgaccaggctaaggagaggcctttggttctctgcaacaaggagccaaggtggcacgagcagctgcagtgttggtgcctcaacttccatggtcgggtgaccgtggcttctgtgaagaacttccagttgatagctgcaccacaactagattctgaaccgtcacagcaagctcagcagcaaacccagccttcgaattcgtcttcagcatcggatcatgacaaagtgatcctgcagtttggtaaggtcgccaatgacatgttcactatggactaccgatacccactctcggcattccaggccttcgccatctgtttgaccagcttcgacagcaagctggcttgtgaataaattgtacataaagaacaggaatacatgtagattgtatctctgcagtaagtatttacagtgtgtgtgctggtgtagtttattgccgcgttgattcagtcctttgttggctttagtctaaggtcactagaccggttataccactgttttgcaatgtagactaccaaaatggagtttaaaatgaaagttaaagatagaaaagctgatgaccctagcccgcttagtgtgacttgtcaaaagctcaaagctaagaatcggcactaattatgacttatgagctgcagttgtgtatcacttttatgtctgtaacttggtaacacgaattaacggcactaaaaatcacttttcagccaaaaaaaaaaaaaaaaaa

SEQ ID NO: 1122 - DNA, 1814 bp, Zea mays
  UNSURE (1)..(1814): unsure at all n locations
  Clone ID: PAT_MRT4577_142569C.1
  unsure (1)..(1814): unsure at all n locations
ttggggaccctcgggctcgccgggcgaatctcggggatccggcactcgcctcccttttccctttccgcgcccatcaccattgccacaaatagcaaccaaggcagtaagcctagccaagccaaccgacggcggcgagagtatatatacacacacacctgacgcctctgctgctgctgggatcaacgcggcagcttagtgacgacgacgactcttctgtctctgcgttgattaatggacagtaacagatccatggcgacgagcggcgtggctccgttcgtggccaagacgtaccgcatggtggatgacccggcgaccgacggcgtggtcgcgtggggcagggacaacaacagcttcgtcgtggccgaccccttcgccttctcgcagacgctcctgcccgcgcacttcaagcactccaacttctccagcttcgtgcgccagctcaacacctacggcttccggaaggtcgatccggaccggtgggagttcgcgcacgtgtccttccttcgcggccagacgcatctcctgggccagatcgtccgccggagcagcggcggcaagcgcaaggacgacggcaacggcgccggcgccggctccgccgacgacgaggacgcggtggccatggaggtggtccggctgaggcgggagcagcgggccatcgaggagcaggtggccgcgatgtggcgccgcgtgcaggagacggagcgccggcccaagcagatgctcgcgttcctcgtcaaggtcgcgggcgacccgcaggtgctgcgccgcctcgtctccggcgccgggggcgacgccgtgttcgccgccgcggagccggaggacggcgcgagcatcaagagggcgcggctgcttctcgatgccggaagcggcggcgacggcgccgtcgacttcagcgggctctatagcacaaccgccggaagcgaagacgacggcgtcgggttcggcagcgattacctgcagccgccaccgccgtacgtgttccccgtcaacagcggcggctactgactgatggcggtctggtagtccagcatctatccgagcgatgtggcgtgcttcgtcgtcgttagttgcccctcccgagtgacgtgttggactgaagtggcaacggcgccgacggacggtgagcaaccaacccaagataattagctaggaggtggtacaaagtgtaaagcctttggtttaggcaggtctgcggtgatctttaatttgcttgttgcaatgttttccttccctaccttgtcaagtgaatgctacggatcagcggcggcaaaagccgttagctgcagctagtttgccgctgctcttcatacagctgcacgccgttaaaacacatctcctttgcactggctgtcttattttttagttgttgagctggtgtaagcaaccagaaaagcttgacagatagctgacaacgtgtgtgatacctggggggggggcccggatcccttttcggctttttgagagtcttatatctgctctgggggggggggttgttccccgtttctctgttttgattctttataaaaaaaaataaaaancccacaaattatcactcacccgcctnatnatataggtcttgtaaccaccccacaccctttttttttcttttcgctgccctttttttctcctggtcgcaattttttgtaggctccttcgattcgtgngccataccctttgcgtttggccttttttctgcccgatgttttttgttatattcccccccccgcgtccctatccgcgaatttnctctcttctcgcgatgagaaccctgtatcccccgtaatttcttaaaattccataactaaaatgattaa

SEQ ID NO: 1123 - DNA, 317 bp, Zea mays
  Clone ID: PAT_MRT4577_142585C.1
tcgcgactatttttttttttttttttttttttttttttttttttttttttttttttttttttttttttttttttttgggcggcccaaaccatttttggttggttttcccctttctccattcgtttttccatcatcaacatgtttggttgtgctgggctcacttcaaaattttgggattttacaaacaaaggggggggcgttttttacagcacaagaattggcgcccaccgggcgcgggggcacacacacgaacacaaccggttcagccttcaatgcaaaattgggattcccattgagcatggaaacgggcgcacttt

SEQ ID NO: 1124 - DNA, 353 bp, Zea mays
  Clone ID: PAT_MRT4577_142684C.1
gtcacacacacacacactgacatgtggtttccaaagccaagtgtgtgtactagctaccagctagctcgttcggcatctaggagccatcatgtcggaagagaagcaccaccacttcttcaacctccacaagatagtcgtggagcagcccgccgacgagtacggatacttcgagaccgatgtggtcaccgtcaccgactatggcgagtgcgagaggcacatgaaggaggtgtaggagcacattctcaagcagcacctcattgtggccggcgccatctgcagtcgtcgcctttggactctacaagtagcacgaggcgaaaaaagacccggagcacgcgcacaggctcatgatcacg

SEQ ID NO: 1125 - DNA, 1458 bp, Zea mays
  Clone ID: PAT_MRT4577_142686C.1
cccacgcgtccgacaccctgccaccaacgacaggttaccttcttcgggcccttctcaccatttcctcatttagaagccccctgtgccttgctcctcggtgtttcctccagatagtagtgtttcctcagtggactagtgtgaagctgtgcttagcgtagcggaagggaggaaggacaaggcaaggcaactgatggcggcgggcggcggaggcggctcggcggcgccgttcgtgtggaagacgtacacgatggtggaggaccccgggacggcaggggtgatcggctggggcagcggcaacaacagcttcgtcgtcgccgaccccttcgtcttctcgcagacgctgctccccgcgcacttcaagcacaacaacttctccagcttcgtccgccagctcaacacctatggcttccgcaaggttgatccggaccggtgggagttcgcccacgcgtcgttcctgcgcggccagacgcacctcctgcgcaacatcgtccgccgcggcagcagcgccgccggtgccggaggcggaaagaggaaggacgccagccccacggagctggcctccggggacgacatgaccatggtggccacggaggtggtgcgcctcaagcaagagcagcgcgccatcgacgaccgcgtcgcctccatgtggcgccgcgtgcaggagacggagcgcaggcccaagcagatgctcgcgttcctcctcaaggtcgtcggcgaccgcgacaggctgcaccgcctcgtcggcgacgcccccgtgccagataacgggttcgcctccggcggtgccgccgagccgcccgccgcggaggtcggcgagaagcgggccaggctgctgctcgacggtgacagcatggtggcgctcggtcccgaggccgtcgacttcgccgggttctacagcggcggcggtgcgttcggcgatgttgccgtggatgctgccgctgggtcccgcggaggcgggttctcgtttgcgttcggcgtggacgcggggtactgaatgacgagcaggcgccgccattgtcagcagcttggcccgcttatgctgctgtcgagcttcctgccaatgccattgcgctgagcggcggcagccgtcacatggaagcatggcaggggatggatgataatgatgttaagttctatccctggctccctgctacatggataggatgtgtgtctgatgctgcttttcgtggatctatatgggcggggagcgactactgcgtcgagatctaaaaataaggggatatactgtcatggagtgtgaccttcgaagttcccaatatgagtaggtttgatgttgtacatgaccagtgcagcagcactaatatttcaatctcctgcggatacgcagctggaaaattggcatcgctattatttagcccttttctacacacttagctttagaaaaaaaaaaaaaaaaaaaaaaaaaaaaaaaaaaactcgaggggggggcccgggtac

SEQ ID NO: 1126 - DNA, 566 bp, Zea mays
  Clone ID: PAT_MRT4577_142744C.1
aggcaaaagttttccgaccacagacagcgcgcgcttcaaggacttttttttgtgagatagcgaggattagaggaggagatggcggtcacgatcgcgtgggtgagaggcgaggcaaaccttcgacagccgggggaaccccaccgccgagggggacgtgggccttagggacagcggctacgcgaggggggccggacccaggggggcatcgactgcaatatatgaggccttgaagctgaggaatgcaggatctgattatctggccaagggggctcttaagggtgccagcatgggaaataacattatgggaccaatatttgttgccaacccccccactgagcaggtggagattgacgacttcatgggccaccaggttgatggaacctccaatgagcggcggctggtgggaacaaaactttggaccaaatgacatccttgcggtttcgcttgctgggtggagagctgggagctatggtgaagaaaattcctcttgaccagaacatcgaaggtcttggtggcgaacgaaactctgggggtccctgtacctgcctttaaagtgatcaaggaag

SEQ ID NO: 1127 - DNA, 493 bp, Zea mays
  Clone ID: PAT_MRT4577_143055C.1
ttgggaccctcgaggccggccgggtttggaatgaccctgcaaagtacaagatctcagacaacagacggcatgttgctattgtcaccacagcaagccttccatggatgacaggaacagcaatcaatccattgtttcgtgctgcatatctggcaagaagtgcaaagcaaaaggtgacattggtggtcccatggctctctaagtcagatcaagaattggtttacccaaataacatcaccttcagttcgccagaagagcaagaaacttatataaggaactggctgcaggaaagaataggctttgaagcaaactttaagatatccttttatcctggcaagttctcaaaagagcgccgcagcattattcctgctggggatacttcacagttcatctcctcaaaagaagctgatatagcgattttagaagaaccggagcatctcaactggtatcatcatgggaagcgttggactgataagttcaatcatgtcatcggtgt

SEQ ID NO: 1128 - DNA, 1540 bp, Zea mays
  Clone ID: PAT_MRT4577_143184C.1
gcacgagatctgcttctccagtctccacacaacacaacagagcagaaggcagcacgggcgctgatggcgatgggggaggcgctgcgggcggctgccgctgacgcggtggtgacattcctgtgggtgctgtgcgtctccacgctgggggcctcgacgacggcggtgacgtcctacctgaggctgcagggcgtccacttcgcgctcctggtcaccgtctccctcctctccgtcctcctcttcgtcttcaatatcctttgcgacgcactcggcggcgctagcttcaaccccggccgggtcgtcccgtactccactgctccgtctcccggcctctcgcctctcggcctctccatcgttcgacctcgcgacgcgtcaagtaggggggcggcggccttcgcggagatgaccaccttcctgatcaccggaggcgatttcccgcgacactcctcccccctccccgtgctctgctagacagatagatccgggctcttccttgatttgttcggtgaggacatcatgtggagttttgcatcaaatgccatagctggaagcttaaagaaaaaagcacaaccctcaaaatgcagcatatccaatgcagattattctgatgatgaagtttcttcatgtacaagcagagaggaaggccttgattgtccaatatgctgggaatccttcaacctcgtggagaatgttccctatgtcttgtggtgtggccacacaatgtgcaaaaactgcatccttggtcttcactgggcagttgtcaagttcccgtcccttcctatccagctgcctttgttcatctcatgcccctggtgcaacctgctgtctttccgcctggtttacaagggcaacctcaggttcccacgcaagaactactttctgctctggatggtcgagagcatgaacggtgggagagcaaaattccattccactaaccatgacgagcatcattccacgtggcattcaagtgccggcacaagctccagccatcaacagcgaagaaatgctgctgtaggatcagagagctcttctggcagagagacaggcgtaggccgcaacattttccacaccgacaacattagtgcttctctgcaaaagcttatggtgtgcttcatgcagctgacggccaagttcccactcgtgataatctttctgctgatagtcctttatgctgtccctgcaagtgctgctgttctggttctctacgcccttgtcacgtttttgtttgcactgccctcatttttgatcctctactttgcctaccccagcttggattggcttgtcagagagatcttcgcttaattcgtgctgtctgaaatgtccgcgcagtttgtatccctgcgacaaatgatatatattggtatatgtattccatgggccacctgccctcgtaggccctgtatagtttcttcttattctctgtccttgtagcactctatttctgttgtaactaacagcttattaaaaatgctctgcaatgcttttatttgtggttcaaaaaaaaaaaaaaaaaaactcgagggggggcccggtacccaattcg

SEQ ID NO: 1129 - DNA, 662 bp, Zea mays
  Clone ID: PAT_MRT4577_143214C.1
gttcgttcttctccctcactcacgttccatttcccactctcccagatccaattcgtgagttctccctcctctgccgacatgctgctctctgtggacaatacctcggctggacgacagcacgaggtcaaggatctctcgcaagagcacttcggccgcctcgagattgagatgcgcgaggtcgaaatggccgtgctcatggcgtgccgcgccgagtgcggcccgtacaagcccttcgccgacgctaggatctcgggatctctccacatgaccatccattaccggcgacctcatctagaccctcaccgcgcctcggcgtcgaggtcctgatggtgctcctgctgcatctctctccacgcgaggaaccagcgccgtcagccgccatctctgcgagactcagccgccgagctcggctgaaaaggatagaccctcgaggagtactggtggtgcacagagcgctgcctcgactagtgcgagctgtgcctcccgacctcatcgaagacgacggacaactacgccacgctgctcatccacgatcgtgtccagggcgaggaggactacaacaagatcggcaagatccccgatccggagtccaccgacgacgctgagatcaagatcgagatcaccatcatccgcgactgtgtcaaggttgaccccaagaacta

SEQ ID NO: 1130 - DNA, 2816 bp, Zea mays
  Clone ID: PAT_MRT4577_143224C.1
cattgggtacctcgaggccggccgggatccctcgaaggaacaaccccaggacgccttggcatcccccctgcttcgacacttcgacaaacattgtgttagccgatgtcactctgcttttagccttttgccaagtgccaacaaccaggtcgaaaggacatctgaccggcagcaggcagacatccgtcgtccgccatggagtcctcatggctcctcctgctctcgtgccttccggccgtatgggtgcttgccgcggcggcggggcggagtcccggctgcgcgacgaggtgcggcgagatcgacgtcccgtacccgttcggcctggacccgcagtgcgcgatccacgccggcttttggctcaactgcaccaccgtggatggcgccaccaagctgctcgacaagaactcggaggtgaccaagatctccgtggaggatggcaaggcctggttcaagaacttcatctcccggcagtgctacaaccaatcctcgggtgacatgttcgaaaacaacgcgtgggtcgactataccggcgagccctacgttctgtcggcagaggataataagatcatcgtcctcgggtgcaatagtatggcctacatgcagagcgactcttacataatcggctgcatgtcgacatgcgacgacccactgaagaacggctcatgctccggcaccgctggctgctgccaggcggagctcccgccgggcgtccagttttaccaaggcttcttcaactcgctgcacaacaccaccaagatatggaagcaaacaccctgcaactacatcaccgtgatggagagtgcggccttcagcttcagctccacctacctcaactcgacggtgttgtacgactccgacgacgggaggacgccggtcgtgatggagtggggaatcacacggcagacgtgcgaagaagccaaagccaacaagactgcgtacgcgtgtgtcagcaaccatagcgactgcgtctacagcgatgccgccggctaccgctgcaggtgctccggcggattcaaaggcaacccgtacgtcgtagatggatgcgcaggttcgttcctcttgcgcgcccagacatccaaatccatgcatgcacaagttacaaaccgatgcgattttttcgtgcggttttcagatattgacgagtgcttggacagtgctacctacccctgcgctgggatatgcaaaaacacactcgggaatttcacatgttcgtgcccacgaggaagaagcatgatcaatggcgtttgcgtgaaaagtcagaggtcaacttggatggtgccggttgttggtaggtcgctgcacaagttgcgtacttgcgttaggaaaattccctgccgggagcatctgttttttttccctacactttttcaatgctttccgggtgtttacagaaggagtaataagtaaccttcgttaggaaaatcgtgatgcattgcaggcgcaagtgttgggctggtgactctcgtgatcggcgttacctgcgcatacctggtccgagaacggcgaaagctgcaccgcgtcaagcagagctacttccggcggcacggcggcctgctcctgttcgaggaactgaagtcgcagcaccaccagcagggcgccgccgcgttcacgatcttctccgaggaagagctgcagcaggccacggacaggttcgacgcgcagcgggtccttggccacgggggccacgggaccgtgtacaagggagtgctgaagagcggcaccgccaccgagatagccgtgaagagatgcatgaccatcgacgagcagcagaagaaagagttcggcaaggagatgctcatcctgtcccaggtcaaccacaggaacatcgtgaagctcctcggctgctgcctcgaggtggaagtccccattctcgtctacgagttcgtcccgaacggcacgctgttcgacctcatccacggcgaccacggccagcgcgtctcgctggacacccgcctcaggatcgcctacgagtccgccgaggcgctggcctacctccactcctgcgcgtccccgccgatcctccacggcgacgtcaagtccaccaacatcctcctagacggcgactacgcggccaaggtctccgacttcggcgcgtccattctggcgccgaacgacaagtcgcagttcgtcaccgttgtgcaaggcacgtgcgggtaccttgacccggagtacatgcagacgtacgagttgacggacaagagcgatgtgtacagctttggggtcgttctcctggagctgctcacgggcaagaaggcgttcgacctccaagggtctgagcaggacaggagtctctccatgaggttcttgtacgcgatgaaggagaacaggcttgaggacatcctagacgatcagatcaagaacagtgagagcatcgagtaccttgaggagatcgcagagctggcgagacagtgcttagagatgagtggtgtgaataggccgacgatgaaggaggttgcagataagcttggtaggttgaggaagatcatgaagcatccatgggcacatgaggatcctgaagaattggacaggttgcttggagagccgtctactacaactaactcgaccgctactactgggaatttcatcattgcaattggagagccgtctacagccaactccaccgctaacactgggaatttcagcattacaaagagagctgccatgggcttggaatcaggacgttagctactgtaaatgaaattatatttacctcattccatatgtatataacagatagagactgtacattttcttggcggtacaattccagttttacattaccaacatgaataaaacaaagacgcaaagctttctctgag

SEQ ID NO: 1131 - DNA, 311 bp, Zea mays
  Clone ID: PAT_MRT4577_143334C.1
tgtggtgctataagccacacgacaagttactaggatggtgcgaggagcagaaagcctacagtgtcatggctttaggcgattagaatcatttttacatgaggaacatttgttgatctttttgccccaccacaagccagtcaaagtatacgttttgcgctggtcttggggaggtcagggtcatatgcattttcccccaatgttagaacagaatgtccttaccatcttttggtactctgactatctggcctcactctatcaagttcccaagaaccaggcatcttaaagaaagaaatgctgcgttttaatgacaa

SEQ ID NO: 1132 - DNA, 2230 bp, Zea mays
  UNSURE (1)..(2230): unsure at all n locations
  Clone ID: PAT_MRT4577_143406C.1
  unsure (1)..(2230): unsure at all n locations
cgggntcagaaggtcggcacgatggagcactcttctagtttagaaattagaatagaggcgctgaggcctcacccacccttttccctggcgttgcaagttgcaacacacagcgtccggcgagatcggcgatcagaaaccacgagcccacccaccatccggaacgcgcgcgcgatgtgtcccgtcagaggcggtggttgttcttggccagcgtccgtcgtcggctctgtcacggcggcgctgctcctcgccgccgtcatcgtgcggctcttcgtccccagtgcctgttcttcaggaattatcaaggggcggcggcaggtaggtgctggtgctgccggaggagcacggctccctgccggctcgctcgggtggccgctcctcggcgagacgctggcgttcatccgggccgcgtactcgcctcgcccggagtccttcgtcgagaaacgccgcgtcttgtacgggaaggtgttcaagtcgcacctgtgggggtcgccggcggtggtgagctcggacccggaggtgagccgcgcggtgctgcaggccgacgcgtcggcgttcgttccatggtacccgcgatcgctcatggagctgatggggcaatcgtccatcctagtgctcggcggcggcctccagcgccgggtgcacggcctcgcgggcgccttcttcaagtcgccgcagctcaaggcgcaggtcaccctggacatgcagcgccgcgtcggccgcgccatggacatgtggggcaggcggcgccatcggagcatgggcgacgacgacagcggtggtatgcccgtgcgtgtgcagaacgaggccaagtcgattgtgttcgaaatcctagtgagggcgctgatagggttagaggaaggggacaagatgcagtacctcaggcaacagtttcaagaattcattgccggtttgatatcacttccggttaagcttccggggactcaactctatagatccctcaaggctaagaagaggatgacaaagttgataaaaacgatcatccaagaggagaggaagaagatgatgtcggaaggcgacgatctgcgtggtgggactcatccacgtgatatgatcgacgtcctgctaggcaacggcaacgacgagctcaccgacgagctgatatctgacaacatgatcgacttcatgatccctgcagaggactccgtgcccgtgctcatcacgctggccgtcaagtacctcagcgaatgcccacaggctctgcagcaactcgaggaggagaacatggagctcaagaggcagaaatcaggcgcgggagaaaccctagaatggacagactacatgtcgctcgccttcacacagcacgtgatcacggagacgctgcggatgggcaacatcatcaacgggatcatgcggaaggcggtgcgagacgtggaggtgagaggccacctggtcccgaagggctggcgcgtcctcgtctacttccgcgccgtccacctcgacgccgccgtccacgacgacccgcacgccttcaacccctggaggtggaaggagaggcccgacgtcgtggccatgagcggcttcaccccgttcggcggcggccagaggctgtgccctgggctcgacctggcaaggctcgaggcctccatctttctgcaccatctcgtcaccaatttcaggtgggtggcggaggaggacaccgtcgtcaacttccccacggtgcggctcaagcgagggatgccaatcgcagtgacgcccagaacctgctgaacgcaacgcaacttgccaggcaaaaccatactatacatttatactccgtaatcaactaaagaggtgtgagaaataatacagtacatgcatgcatgtaatggagggcgaaattaaaagttggcacggcaaaggcgccgatggtatgccaaaagttcagtttgcaaattatatagtttaattgctattacactaggggcacccatgtctgatgcctcgtttttgaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttttttttaaatcggaagggcccttttaaaagaaccaaattttactaccccttgtttgaaaggaaaaattttttttttggggccccaaaattaaattccctggcccgttttttaaaaacttgggaatggaaaaacccttgggttacccaaattaaatgcttttgaaaaaaatccctttttc

SEQ ID NO: 1133 - DNA, 626 bp, Zea mays
  Clone ID: PAT_MRT4577_14340C.1
aattttcaaaagagccgcccttgtcctcctcctcctcttcttctctcatctttcccttcaccttcctctccacggaccggaacgcgccatgacgagctcctccacgccgtcccgcaaggcgctgagcaagatcgcctgcaaccggctgcagaaggagctcgccgagtggcaggtcggcccgcccgccggcttcaagtacaaggtctccgacaacctccagagatgggtgatcgaggtgggcggggcggagggcacgctctacgccggcgagacgtaccagctgcaggtcgacttccccgagcattaccccatggaggcacctcaggtcattttcctcaacccggcgccgatgcacccgcacatttacagcaacgggcacatctgcttagatatactgtatgactcgtggtcgcctgcgatgactgtaagttcagtctgtatcagcatcttgtcgatgctgtctagctcgccagcaaagcaacgcccggcggacaatgaccgctacgttaggaactgccgcaacgggaggtcgccgaaggagacccgatggtggtttcacgacgacaaagtatgagggggcatcgaatcgattggctcttctggccaccccatactcgccagccagc

SEQ ID NO: 1134 - DNA, 532 bp, Zea mays
  Clone ID: PAT_MRT4577_143488C.1
gatcctttaaagggcccccccttttttttttttttttttttttaacaaaaacaactttggttcgcttggacaaacttaaccaaaaaggcttgtggcacgactaccggtggcgataaaggccttagcacaaatcctgttcgccgcttaagatagcactacttggaagggactaaactttactcgtcatcctcatcagcagcttctgtgccgcccgaggagttgagtcggttgagcctttcaatgaaactggccttcctctgctcgaatgtaactttcttggggtagcacctctagtgctcctttggtggctgcttggtccacttgaccacagaaggatcagcacggatggcactttggaccttcttgtacaaagctcccatgccgaaagcctcaatcccctacttaatgcactcactgaagcgaaactggcccttctctggctcctattcatcgaggttcctcatgtattcacccacttggccaccatagatgtccttccgatggatttgagcttccagctgattttaatcct

SEQ ID NO: 1135 - DNA, 530 bp, Zea mays
  Clone ID: PAT_MRT4577_143683C.1
atattatggggaaccaactagccaccatgagaaggcacattagggtcccaacaagggcagccaaaatatttggcctccttatgctccttggtctttctgcaggggctgttacggcgaccattttcccgcaaggctcgcaggctcctatagcttccttttttcccccgtacctctaaccagcggggtcttcggtatgtgaaaacccaatttttcaaccttacaggatccaacaggcaatcgaagttggcatcttaccttaataacccttgttcctccaacaataataagccttattacaacagttacctttggggcattaatgggaacaaaacataagggcacaacaactacaacaactggtgctagcaaaccttgttgcctactttaagaaacagcagttttttccattcaaccaactaggttcattgaactttgtttttaatttgaaacaacaacaactacaattcagccagttacctgttgcctaccccaagcattttcttccattcaaccaactagcagcattgaac

SEQ ID NO: 1136 - DNA, 2191 bp, Zea mays
  Clone ID: PAT_MRT4577_143832C.1
caagcccacattgtttccgcagctgcccggaggggcaaatgaggagtagctagcggagaggttggtgcgtttcggaggaggcgccatggacgtcgacatgcaagcccgtgccggccgggattccctctaagtctcgagacccaccaccgcaccccgcgctcggcggactcttttgctgctgcacctgccatcgtcacgcaccggtgtgtggagcgaagccagcgagcgagaagtagccacagagcggcctgtgcgtgcgtgcagatcgagagagagacgtgcagatcgagagagagagacgaacagagagagcgattcatggtaggtgcgatgcgcggcggagccatggagttggaggaccgcctggccacccttcctcgcttccgcggcgatcacgatgacgacggcaaggaaaggaggacagggacggtatggacggcaacggcgcacatcatcacggcggtgatcggctccggcgtgctgtcgctggcgtgggcgatggcgcagctggggtgggtggccgggccggtgatcctggtgctcttcgcggcgatcaccttctacacctgcggcctcctcgcagactgctaccgcgtgggcgaccccgtgacgggcaagcgcaactacacctacaccgaggccgtcaagagctacctgggcggccggtatgtctggttctgcggcttctgccagtacgtcaacatgttcggcacaggcatcggctacaccatcacagcctctatcagtgcagcggccatcaacaagtccaactgcttccactggcacggccacgatgccgactgcagccagaacaccagcgcctacatcatcggcttcggcgtggtgcaggtcatcttcagccagctccacaacttccacaagctgtggtggctctccatcatcgcggccatcatgtcgttctcctactccgccatcgccgtgggcctctccctggcgcagatcgtcatgggccccacggggaagaccaccatgaccggcaccctggtcggggtggacgtggacgctgcgcagaaggtgtggatgacgttccaggcgctgggcaacgtggccttcgcgtactcgtacgccatcatcctcatcgagatccaggacacgctgcgctccccgcccgccgagaacaagaccatgcgccgcgccaccatgatgggcatctccaccaccaccggcttctacatgctgtgcggctgcctcggctacgccgcgttcggcaacgccgcgtcggggaacatcctcaccggcttcggcttctacgagcccttctggctcgtcgacttcgccaacgcctgcatcgtcgtgcacctcgtcggcggcttccaggtcttctgccagccgctgttcgcggccgtcgagggcgccgtggcggcgcggtaccccgggtcgacgcgcgagtacggcgccgcgggcctcaacgtcttccgcctcgtgtggcgcacggcgttcgtggctgtcatcacgctgctggccatcctcatgcccttcttcaacagcatcctgggcatcctcggcagcatcgccttctggccgctcaccgtcttcttccccgtcgagatgtacatccggcagcggcaggtgcggaggttcagcaccaagtggatagcgctgcagagcctcagcttcgtctgtttcctcgtcaccgccgcctcctgcgcggcctccgtgcagggcgtggtcgactcgctcaagacctacgtgccgttcaagacgaggtcgtgagctcctgctgcttagttattatacatgtagcatacatactactcgtgcctcctttgtagtggcaccgaaacaaactgagcaaactcagccaaattagttatgcgggagtttaattttgaactactagtatgttgctgtcgaatgcaacaaaactaataacgtttacagtttttctatttggcatcaaccttgagcactgcacgtacggtcccatatgtagctcaaaaacttaattacgtgctcatcaagcagccaggctccttcattcaattccaaagcaggattaatttgggatacgtggcttaattatattggtgtgtttgcgatggcatggtacgatgggttggagcagatcctcttaggcgtgtttcgcaatcctcctccaacattattgaaaatatgtgaatgattgattgtattccaataccgggaatatgagtacatatatacagcgcat

SEQ ID NO: 1137 - DNA, 717 bp, Zea mays
  Clone ID: PAT_MRT4577_143833C.1
gtaccctcgggtttggccgggattccctctcaagtctcgagacccaccaccgcaccccgcgctcggcggactcttttgctgctgcacctgccatcgtcacgcaccggtgtgtggagcgaagccagcgagcgagaagtagccacagagcggcctcagagagacgtgcagatcgagagagagacgaacagagagagcgattcatggtaggtgcgatgcgcggcggagccatggagttggaggaccgcctggccacccttcctcgcttccgcggcgatcacgatgacgacggcaaggaaaggaggacagggacggtatggacggcaacggcgcacatcatcacggcggtgatcggctccggcgtgctgtcgctggcgtgggcgatggcgcagctggggtgggtggccgggccgttgaccctggtgctcttcgcggcgatcaccttctacacctgcggcctcctcgcagactgctaccgcgttggcgaccccgtgacgggcaagcgcaactacacctacaccgaggccgtcaagagcaacctgggcggctggtacgtctggttctgcggcttctgccagtacgtcaacatgtttcgcacaagcatcggctacaccatcacagccttcatcagtgcagcgggcatcaacaagtccaactgcttccactggcacggccacgatgccgactgcagccagaacaccagcgcctacatcatcggct

SEQ ID NO: 1138 - DNA, 370 bp, Zea mays
  Clone ID: PAT_MRT4577_143840C.1
gcggccacgcccccacaccaagccgtatcggcttctccctctagaccggtacgggtggtccgcggtcagggtgagcgagtgagcagctttgcttctccatctccccgatagcttccctccccatccccccggcccggcggtttgtacgtgagggtgacaccgcagcgctagctagctcgccagaacagcaagcggccgcccgcgacctgagagcacagcagcgccggaccggctcatggtggcgaccggcagaaaagatggcgggagcatcatctgtggacacggaggcagcggctggaaccgccaacgtaaaagctggccttcacactccccaaggggcccgggtaccccacgacgctggaggccatgg

SEQ ID NO: 1139 - DNA, 184 bp, Zea mays
  Clone ID: PAT_MRT4577_143884C.1
cgtcaatgctattttcaccattcctccagagctggcttatggcgcatctggatccactaccaataatcccacccaatgcaaacctgcgattgatgttgagatgctttcatggaccagtgtgcacagccatttgctaagatggcggcttattcacgcagctaccttaaagagggagagccctggg

SEQ ID NO: 1140 - DNA, 302 bp, Zea mays
  Clone ID: PAT_MRT4577_144014C.1
ggcatgtgctcgctcacttaccaagtcctcttctggttatggttacttatggttctgtggaggggctatggcggcggctgatgtggagtaccgttgcttcctcggcaggcttgcctgggccaccagcaacgagtcgctggagaatgcctacgacttctacggcgagatcctcgactccaaggtcatcaccgaccgggagacggagaggtctcgcggattcggctacgttaccttctccttcgagaacttcatgctctacgctatcgagaacatgaactgcaaggagctcgacggtcgtaaca

SEQ ID NO: 1141 - DNA, 1111 bp, Zea mays
  Clone ID: PAT_MRT4577_14402C.1
ttctttttacttaaaaaaaaatttttccaaaaaaaaaaaaaaaaaaaaaaaaaaaaaaaaagcctcgaggggccggggcgaggccggccgggatgtccgaggtcccacccagtaggccgttcctctcccgtgtgggtgcattctccccacctccgccgccgtttccccgcgtgctttctctctctctcgatctcgagcgacgactcggttacagccgccgtcctacgccaggttccaggtcttcgtcgggcccttctccggcaacgagcaccaacaagatttttgtgtgtaaagatttgcgagcaccattcacttttacatcagtgtgaaattaaaacacttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaacatgaggagttcatatgaaggttctgattcctctgttatttattgtatcattgtatgcaatacagttgttactcttgttttgttttgagatgctggtgtgccaaaatggatttgatgaccgataattgtattggtgttggctacctggtcgaatggtcgtcgctccattttgttggtgacttaacaatttcaattgagaaaatatgtttcaaaccgagcaatctgcttgatgctgaaatcagttattcgccaagagtgaatcttcctatcc

SEQ ID NO: 1142 - DNA, 158 bp, Zea mays
  Clone ID: PAT_MRT4577_144152C.1
acaactacctacagtgagtcgtattaaggcatggcagcgtttgtgatcgaattcctgcttgctatctgtgctgaaacgggcgccaccgcatcgcgcgccacggggtcgtaaggcacgaagtttaagccggcgctccggaggcggctgtggtcgagcag

SEQ ID NO: 1143 - DNA, 1713 bp, Zea mays
  Clone ID: PAT_MRT4577_144161C.1
attcggttcgagtccacacctcacccaccaagagaccaatccagcagcacacgcctctccgtcgtcgtctccgataactcatcgtcgaaatcctgcccttctagcttcgcttccttcagctaactggtttcgatggcgctgctagtgcggagggcacggagggcggcgaccaaggccgcggtgtccctcgccggcagaaccggcagcgtggagcttgccatcccggcgcacttccggtgcccgatctcgctggacctcatgcgggaccccgtcacggcgccggcgggaatcacgtacgaccgcgagagcatcgaggcgtggctggacacgggccgcgccacctgccccgtcacccacgcgccgctccgccacgaggacctcgtccccaaccacgccatccgtcgcgtcatccaggactggtgcgtcgccaaccgctcccgcggcgtcgagcgcatccccacgcccaagatccccgtcacgcccgtccaggcctccgagctcctcttcgacctcgccgggtccgcgcgccgccgcgatgccgctgcgcggtgcgccgaggtggtcaccaagataaaggtcctcgccagggacagcgagcgaaacaggcgctgcttcgcgtccatcggcacgggccgcgtgctcgccgccgcgttcgagtcgctcgctgctgctgctgctgctgacgccgccgcaccggcggggcgcgtccttgaggacatcctggcggcattggtctgcatgatgccgttggacgaggaggccgccaggacgttggccttgccgacctcgctggggtctctggtcgccattgctgagaacggcagcttggcaggaaggctgaacgccgtgctggcaatcaaggaggtcgtctcatgcgacggggcggtcactgatctgagcgggaaggccgacgagatcgtagacgcgctggcaaagatcatcaagtctccaatctgtcctcaggcaaccaaggccggcatggtcgccacctatcacctggcgctatacgacgagcgtgtcgcggcgcgccttgccgctgccgggctcgtccccgtgctcgttgaggtccttgtagacgccgacaagagcatgtccgagaaggcactggccgtgctcgacgcggtgctcgcctcggaggaaggccgcgcgagcgcgcgggcgcacgcgctcgccgtgcccatgctcatcaagaagatgttccgcgtgtccgacctggctacccagcttgccgtgtcggcgatgtggcggctcggaaaggcgcacagcgacggcgaggatgacggtgcggtgacgcggtgtcttgtcgaggcgctgggggttggggcgttccagaagcttctcctgctcttgcaggtcggctgcagggacgcaaccaaggagaaggccaccgagctgctcaagttgctcaacaagtacaagagcgtaggcgaatgcgtcgacgctgtggatttcagagggctgaataagctgtcatcttaaatcaatgggggctgcgatgtaaaaaatgtgtattttgtaaaacagagagacgatttaacttgtaagtagatgcagataggctagttgcaattttgttgggcgtgcttgcatgctatttcagcagcttagtttcaaacggaaacttagatccgaattccgttttatgaagaacttcagtgtaaatttcttgttttaaaagatgtttttttttcttttaaaaaaaaaaaggaggag

SEQ ID NO: 1144 - DNA, 2133 bp, Zea mays
  Clone ID: PAT_MRT4577_144241C.1
cgttgctgtcgctctctgtccctctcgtctcgcttcttccccaacctgctcggtttcaccagatcgcgccggacacggtcgttgggccaccaccatgatctcgacgcggcttggttttcggccactcgggttggtggtggtgagagggccacaaccacgtcctaactccaccacttctctcctctacgacgcgagcaagggcgccaccgactgcggcgtcggtgggaactgggcctcggcctccccatctctctgataccagggcagatcagagctggaactgaaggtggcgggagccgagtgatccggcggtgagctgagcggggcgggatggcggcggagcaggggcggtcgctggcggagacgcccacctggtccgtggcaaccgtcaccacgctcatggtcgctgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagccagacggcgcgcttcatatcggagatctgcgtgccgtcctcgctcttcaccagccgcttctacatctgctccgagagcgactaccaggacctgctgcgcaacacggacgccaaccagacggcgctcgacaagaacatgttcggtggccaacggctgcacgtctgtggcgagggccatgaaccttttgtttcgtacgagggccttgagcagctgcaccggtttctcttcatccttggtatcactcatgtgttgtacagttttgtaacagtggttctgtccatgatcaagatctatagctggaggaagtgggaaaccttagcaggtccaattgctgctgaggaattgaaagctaggagaaccaaggtgatgagaaggcagtcaacctttgtttttaacaatgcttctcatccatggagcaaaaataaaatacttatttggatgctttgctttttgcgtcaattcaagggctccataataaggtcagactatttggcactgaggttgggctttgtcacatatcacaagctaccacattcatatgacttccataaatacatggtacggagcatggaagatgattacaatgggactattggtatcagttggccactttgggcatatgcgattgtctgcatattaatcaatgttcatggtatcaatatatatttctggttgtcctttgttcctgttattaagctggtgcttctagtgggtactgaacttcagcacgtcattgctcagttggctttggaagtcgctgaggcaacagcgccttatgttggctcacaacttaaactgcgtgatgatctattttggtttggaaagcctcgggtactctggtggcttatacagttcatttcatttcagaatgcttttgagctggcgacattcttatggtctctgtgggaactcagtgcacatacatgtttcatgaagcactactacatggttgccattcggttgatttctgggctcctagttcagttttggtgcagctacagcacactgccgctgaatgtgattatttctcagatgggttccaagttcaagaaatcactggtctcggagaacgtgagggagtcgctgcacagctggtgcaagagggttaaggacaggagccgacacaacccgctcttctcgcggaacgggaccctcacgaccagatccgtgtgctccctagacaccacctacgagacggatcacgagacgaacacggtgtgcacgctgtcgaggacggcgtcggcaacgtcgctggacgaccagttgaccgtggtcaccgtcgatgacgagccgtcctgcattgagaaggatgtctgacgcagttgctgattcgccaaaactacatactgcatcgacctgtgtgttaggaggtactctaggactgaaatgaatgtatatgtgcagtggttgcccctatcgtggcagtgaccatgtgtatatatagaactaaaaaaactataatgtctcttagctgagagtgagaggctgtacatggaaatacttgaggcagcttggaccaaatacaaaactgcatcttttcgagataagccgtccgttgcaactgcacgtaccatgtactcctttccc

SEQ ID NO: 1145 - DNA, 415 bp, Zea mays
  Clone ID: PAT_MRT4577_144375C.1
ggaccgtagtgcccggcttgacccaccacacacgtacttcgtgcacccgtggcgcaacatcctggagggcaggttcagtccgcaggtggcggtggccgcgctgatcccctaattccagcagctgacgggcataaacgtgaacatgttctacgcgccggtgctgagcctgaccatctgctttagcgacgacacgtcgataatggcggccgtgatcacggggctggtcaacatgttcgccacacgggagtacatcgcgagcgtggacacgcctgggcctgagcgcgctgctactgcaaggcgggacgcagatattcgactcccagatcgtggagggcacgctgatcgcgctccagtaaggcaccgcctgcgagggcgagatgttccgctccaacgtcagactgatggagctcttgat

SEQ ID NO: 1146 - DNA, 323 bp, Zea mays
  Clone ID: PAT_MRT4577_144426C.1
attcccggctggacccacgcgtgcgcgcttctcctccccctccggttccggttcgggtccgagaggttctccggagggcgggggcgtgcgtgagcgtatcgagatggcggcgtctgatgttgagataccgcttgattgtccgccgtctcacctgtgccacggacgaccactctctccacaacgcctttagcacctacagtgaggtcctcgactccaagatcatcctcgatcgggagacgcagatgtaccgcggcttccgcttcgtcaccttcttcacgggagacgcgatgcggaacgccattcgagggcatgaacggcaagga

SEQ ID NO: 1147 - DNA, 2083 bp, Zea mays
  Clone ID: PAT_MRT4577_14449C.1
gccggccgttatgcggatccgctctccggtcacactccctcgcgcccgctccactccacttcccttccccagtcggacccccgatctcaatcatcctcagcggaggaaagcagagcacggcacagcgagtcgcagagggatagatccgagcacaagcaggccccgatggcgacgacggcgacgaaccggcgggtgatcctcaaggagtacgtggagggataccctcgcgaggagcacattgagctgcctactggcgccggggatcgcccgggatccaaacagcagtactacactgaactcaatcatcctcagcggaggaaagcagagcacggcacagcgagtcgcagagggatagatccgagcacaagcaggccccgatggcgacgacggcgacgaaccggcgggtgatcctcaaggagtacgtggagggataccctcgcgaggagcacatggagctgctccagggcgccgaggttcccctccgcctgacgggcgccgagccggccgggtccgtcctcgtcaggaacctctacctctcctgcgacccctacatgcggcccaagatgtcgcgcccgctgcgggagtcctacacggccgccttcgtcccgggcgacaccatcacgggctacgcccggccgcgcgcgtggtcgactcctccgacccgcgcctcgcgcccggggacctcgtctggggcatcaccggctgggaggactacagcgtcgtgaccccgcccgccaccaggctcctctccaagatctcccaccacggggccggggagggggcgggcgtgccgctgtcctactacaccggcatcctcggcatgccggggctcaccgcgtacgtgggcttccacgagatctgcgcgccgaagaagggcgagaccgtgttcgtgtccgccgcgtccggcgccgtcggccagctggtgggccagttcgccaggctcgccggctgccacgtcgtcggcagcgccgggtcccgggagaaggtggagctgctcaagaccaggttcggcttccacgacgccttcaactacaaggaggagcccgacctcggcgccgcgctcaagcgctgcttccccgacggcatcgacatctacttcgagaacgtcggcggcgccatgctcgacgccgtcctgctcaacatgcgcgtgcacggacggatcgccgtctgcgggctcatctcgcagtacaacctggcggacggggagaaggacgccgtgcgcaacctcgccgccgtcatctccaagcgcctccgcctgcaggggttcatcgagcccgaccacaagcacctctacccgcagtacgaggcgtgggtgctgccgtacatcagggacggcacgctcgcctacgtcgaggacgtcgccgaggggctcgagagcgcgcccaaggcgctcataggactcttccacggtcgcaacgtcggaaagcagctcgtccgcgtcgccgacgacgagtgagacgcgcctcacttcgattggaccagacgatccatgtgtcactgttgctatgtttcgattccccattttcatgaataattaattgtgccaatggatgcttttgttcggaatatatgccggttgctatgtttcgattccccattttcattccaagatgccgcattttactaaaaaaaaaaaaaaaaaaaaaaaaaaaaaaaaaaaaaaaaaaaaagcggccgcttttttttttttttttttgcttttttttttttttttttttttgcttaaatcacagatctaaagattggaaaagctttggaagataagattgttctaaaaatagccgtgtgccagtgcatgataaaaaaaaggcaaacaaaatccttagagcagataaacagagtcaaaccctattatttgcagaagaaagaagatgaaactgagagcacgcgcatgccgacggggaactggtcctcagccccgtgaccgccgttggccctcgcgtgtagcttcagctccttggcggtcatctcctccagctccgcgaatccaattgcgcgtctgctcgctctttctggagccaggcggcgagtcggcgaccagcaaggccagtgcgacccctggtcccttctaggacagccgaag

SEQ ID NO: 1148 - DNA, 188 bp, Zea mays
  Clone ID: PAT_MRT4577_144533C.1
aaccccgaaaaaccaaattttattcataaccaaaaggggttcacagatttttttccatacgtacatgctaattggggtaaacccagttgaccacctaaagctgcatacttacttattcaaactgatccagcttgtggcaacgtcggaagttcacatgcttacagacgacaaattttcataacaatagc

SEQ ID NO: 1149 - DNA, 284 bp, Zea mays
  Clone ID: PAT_MRT4577_144569C.1
aattccctggggggggcacgcgtcctaaacatactcctgccgaagcgctgagaagtatctagacaagagtaatggggttcaggggggcacaggaaggggggggcctcctttcatggaaaggcatgaatagcgactctgaggccactggtcttaagttcttcctcaggatctttggtatcgggccgggtgccaaacagatgttctccttcctgggcgacacctgcgacgcgcctgtggataaacactccaagctcaagggccacgccgtcaccggctttcgtatg

SEQ ID NO: 1150 - DNA, 200 bp, Zea mays
  UNSURE (1)..(200): unsure at all n locations
  Clone ID: PAT_MRT4577_144800C.1
  unsure (1)..(200): unsure at all n locations
cactaatnctacccatatcccagagcacttgtcaccactactgatgccattccctaccatgaacccataaatgcagtacttcatgaagcaacaagtggttgccaacttaatagcgatcccgaccctgattctgcatcaactgctgacctcaccgcttcatcagtgccagataccaatgattactccgggtatgatgccac

SEQ ID NO: 1151 - DNA, 3734 bp, Zea mays
  Clone ID: PAT_MRT4577_14481C.1
cgacacgtcccaagcggagttcgactcacaacttgttcctcaaagttcttatttgccaaaattccttccgtaagtgaagtggtgatgtaccacgaagcgacagagttggctcttatgttgtccttagcccattcacaagctaaattcttggttagctggttaatggcacctttagtcatagcatatatagttccactaaagattcctatcgctccagcaacagatgatatgaatataatgctgcgaggatgttgagcttgccgccgaagcggtcggcaacctcgcggagcaaccgctcccgctggtccctctcggagaggtcgcagacggacccggtaacgctgaatcccctggcctcccactccttgatgcgctcgccgagctcctccgccttccgggagcatgtgtgcacggccgcccccagcgccgccagctcctccactaccgcacgcccgatgccgcgggtgccgccggtgacgagggctgtcttgccgtgtagtgcccatctcccggaggaccctatcgccgtgcccgaggtctcccccgtggccatctcgcagttgtcgttaccgcagtcgtaaacggccacggcaagctgattcaggaaccgaatttttttttttgattttttttttttttattttacctctctgtctattatttttttttttttttttttttttttttttgatctaaacacaacgttcttcacattgccctgatagaattatgtaatgtaatgaacagtatcaacatgacaaccttacctttacatacattttattagattttttttctcaacaaccaagaacaacagctattgtcgtttcctcagcacaaagaaacatggcagctgccgcctagggcttgggagggtaaaacccgttcacagtcatacctccgtcgaccgcaatcgtctggccgctaatataagtggaacccggcatgcaaagaaaagcaacaagtgccgatacttctccaggttctccgacacgtccaagcggagttcgactcacaacttgttcctcaaagttcttatttgccaaaattccttccgtaagtgaagtggtgatgtaccacggagcgacagagttggctcttatgttgtccttagcccattcacaagctaaattcttggttagctggttaatggcacctttagtcatagcatatatagttccactaaagattcctatcgctccagcaacagatgatatgaatataatgctgcctgacccagataatttcaaaagaggatgtgcaatttggcacaagtgatatgcagattcaagattagtagccatcagaaacgagtattcctctgcagtaaactcagtagttggtttccttatgtttgttcctacattgtttacgaggatgttgagcttgccgccgaagcggtcggcaacctcgcggagcaaccgctcccgctggtccctctcggagaggtcgcagacggacccggtaacgctgaatcccctggcctcccactccttgatgcgctcgccgagctcctccgccttccgggagcatgtgtgcacggccgcccccagcgccgccagctcctccactaccgcacgcccgatgccgcgggtgccgccggtgacgagggctgtcttgccgtgtagtgcccatctcccggaggaccctatcgccgtgcccgaggtctccaccgtggccatctcgcagttgttgttcccggtcacgatagcggccgaggcaagtggattgtggaactgattgatagatatattgatctgggtccccaggaacgggctcgatgtgatagcatcgtcctttgtaacgatcaagactggtaagtccatcagtccaaacagttgtccatgtaccagtagaagattccgcagctactgcagctcctgcttcttcaggcggaaccccgagctgaggagttactcggaatgcttgctgccaagatatcagtatccttggtttcgtactccggggtgtagtaagtcaatttataatccttaacaccagctttaaatccaacacttgctttagtttctgtttgtggtgacataagtccctccctacaactcatgaattaagaattctcacaacgacagggtctactcgatatggattaggcgtaaatgaaacctttgcaaaaatctaaaaaaaaagatatttaattaatatcaactcattaaataaaaaaaggagtatgcttaagttaatgaatatgtttcattcatatataatgtgtacaccctgtgtacgttctatcctataggaattttactataggaattcgataggaaggaattcgataggaattgagttgttgttatggtaagttaacacggttcgttattaaaccgtggatttgattcaccaaatccatcattattgtatactctttgatagatatagcgcaacccaaaccctaatctttattttacaatttttaaagttcttcccctttgatattttgaatctaaatacctaaatactaagaaaattctctgttgacagcaatctatgcttcacagtagtatatattttgtatatcgaagtcctagataggaaagtagagtaggcacagatccttcacaaaaggcgaaatttatatgaaaaaaatggattgaactttccaacggattcattccataagtaaacgattgaatgggattcgcttgggcaacgaaatcaagtgcgagtccccttttcttttttattgaattaactaattcatttccttttgacttttggatttttggatattttttttgatttggcattattcaacaagaaaaaaaatttcgacaaattcctttttttttgaaaattatgtgataattatgagaaccaatcctactacttcgcgtcccgggatttccacaattgaagaaaaaagcgtagggcgtattgatcaaattattggacccgtgctggatatcacttttcccccgggcaagttgccttatatttataatgctttgatagtcaagagtcgagacactgccgataagcaaattaatgtgcccgggcaggtacaacaattattaggaaataatcgagttagagctgtggctatgagtgctacagaggggttgatgagaggaatggaagtgattgacacgggaactcctctcagtgttccagtcggtggagctactctcggacgaatttttaacgttcttggggagcctattgacaatttgggtcctgtggatactagtgcaacatttcctattcatagatctgcgcctgcctttatcgagttagatacgaaattatctatctttgaaacaggtattaaggtggtcgatcttttagctccctatcgacgtggaggaaaaatcggactgtttgggggggcaggagtaggtaaaacagtactcatgccgcgaccaatcaataacattactaaagctcatggaggcgtatccgtatttggcggagtaggggaacggactcgtgaaggaaatgatctttatatggaaatgaaggaatccggagtaattaatgaaaaaaatattgaggaatcaaaggtagctctagtctatggccaaatgaatgaaccgccgggagctcgtatgagagttggtttaactgccctaactatggcagaatatttccgagatgttaataagcaagacgtgcttttattcatcgataatatctttcgttttgttcaagcaggatcggaagtatccgccttattaggcagaatgccctccgcagtgggttatcaacctacccttagt

SEQ ID NO: 1152 - DNA, 226 bp, Zea mays
  Clone ID: PAT_MRT4577_14490C.1
agataaggaatatgagggcaatgttgaggccactggtgaggacttctctgttgaaccagctgatgagacgatgcctttccgtgctctcttggatgttagcctgtatgaggactacaactgggacccgagtcgttggtgccatcaagtgatctttggatggtggcctgtatatgcagcacaccgataagagatatgctgctttcaacaacgatgacaagcagctgta

SEQ ID NO: 1153 - DNA, 424 bp, Zea mays
  Clone ID: PAT_MRT4577_145492C.1
aaaacaactaaacatggaagtaaatcagaggtgcatacattttttggggcctcggaccacgatcatacccaagcgcatgcatacccacacgtatacatacgatagattacgtagccacgcttattcgggcataaaacgagggcatacaaacgtacccgcgcacaaaagggggggcgctcgatatcactttcacacacccccccgtagcacacggggggggacgacgatacgggggggatcaatcagccgaaaaaggggggctttttttcgccggcggcctcctcggggtccttgggggcctttttctttttggggggctcggggaaggggaagccgccggaaccgacgggcggcgccgccgcaaccccctcctcgatcttgggggggggggcgtgctccggggtccttttttgcctcgggcttt

SEQ ID NO: 1154 - DNA, 603 bp, Zea mays
  Clone ID: PAT_MRT4577_145816C.1
tacaacccccccccctcgagtttttttttttttttttttttttttttttttttttttttttttttttttttttttttttttttttttttttttttttttttttgcaaaccgccaaggcgccaaggcccgaacatagtatataaatattactttgttgactccatagcgctagggggatcttttgcagtcaaccacaaaaattgacaactagagtcttatttattgggtactctaacgttgggaatcagggggctactatcagcaatgggaaggaccacttaattttcaaatctgtcgacaaaaatgcccaataagaaaaaccgcctaattttaaaatctgccaaaaaaaatgatacgttgtattaaaaattacgtgtcatttttttaaaccttgcgctgtttgatctttttgctcaaattggcgaacaaactgtcctcggacccgtggccgttgttaaaaaagccttttcctgttttggtagcaaacctttttaccaaagttccaatctttccgcttaagtctgaatttgttaaatgcagcttctcgttgcaggaaccgattctgatacatgtcattgccactcccactcccacttacaatgc

SEQ ID NO: 1155 - DNA, 1682 bp, Zea mays
  Clone ID: PAT_MRT4577_145875C.1
gctgatcacctcatcggccgggaacatagcatggtcatacaaataggaaaagaatagtatatcagcccccctattgatcctccccacgtcgccgtgctcgttttgcgcgtccaccagcccgccccccaaccccacccagcgcgacgaagccggggggcgatcgctccagcgccgccggcgacctcgccccgggagccgccggcggtaccccgctctctgtcccgcctcaacgaaccctcaggtccaagtagttcgtttcgtgagttatccaaagttgcgccgcaaagatgagtactgctaatcgctaccaacacatcaagtcaactaagcctgttgtaggcaaagcaagaaaattgaaggatctcatgataaaaagtgacaataggatatgtgctgactgtggtgcacctgatcccaaatgggcatctgctaatattggagtgtttctttgcttaaaatgtggagatgttcatagggcacttggacctgacatctcaaaggttttatctgtaactttggatgattggtctgatagtgatatcgactccatggttgaggttggtggaaactcatatgcaaattcaatttatgaggcttttcttccaaaagatcacccaaaacccaaaccagattcaacgatggaatataggacaaaatttataagagctaagtatgagacacaagattttttgaagccaagtttgcgcatttcatcaagatcatcttttaaatctaccacttctgtgaagagtgtagatagcaatttctctagcacttcaaggaaggatgtctttgaagatacaagagaatttgttggagagttgaatatcacactggtcaaaggcaccaacttggccgttagagacatgctaacaagtgatccatatgttgttttaacgctcggagggcagaaagttcaatcaacggttaaaaaaagtgatctgaatccggtatggaatgaagtgcttaagatatctgttcctcgaaattatggacctctaaaacttgaagtgtatgaccatgatatgttctcagccgatgatatcatgggtgaagcagagatagatctccagccaatgatcacagccgccatggcctttggagatacttcacgtcttggtgacatgcaaattgggaggtggttcatgaccaaagacaacgccctgatgaaagatagcacggtgaatgttgtggcaggtaaggtaaaacaggaggtgcacttaaagctacagaacgtagaatcaggtgagttggagttggagctagaatgggttccgatcctctagactaatgataactcccctgatctttgtctaaaaatctatactcaagatgcatcgatgtttccaagctgtccacttgatggtcttggacatttttgctggatggtttgaatttgttaaaaatgtcactgtagaatatcatggtgtaactgtcggttgtactcgcgcctttcaccccccctcccggtaactggttatcatgccttgtaagcactcgctgtctcttgattgttgttgcattgtcccattgaaaggacctgtgtcttgtaagagatggcaattatagccagtgaactctttgtgctgatgccatgttggcgctgtagtagctaagaaaaaaaaaaaaaaaaaagcggcctcagcatgatgctctgagtgcatatacgctacaagcctaca

SEQ ID NO: 1156 - DNA, 1671 bp, Zea mays
  Clone ID: PAT_MRT4577_145926C.1
cttggtagcgactggactgcttatgttgctgactttgggcttgcaaagctgattagtgaatccatggaccaaccaaatttgaatattgggactgaaagcactattcggatacgaggaaccactggatacgtccctccagaatatggagcaggtggtcaagcatcagttgctggtgatgcctacagctttggggtcactctgcttgagatgttcacggggaaagcaccaactgatgacatgttcatagaaggcttgaccctgcacttgtttgctgaggcagggttacctgacaggatatcagcaatcattgacccagaacttttcaatgcggagctgtatgaccatgatcctgagatgctcagttgcttagcttctgtgatacgagttggtgtctcatgttcaaaggacaacccgtcagaaagaatgaacatggaacatgctgctgctcagctgcacagaatcaaggagtacattgaagaaatcccttagggtttaaatgggtataacttgatgtcctttatttatttttccaatgcagagcacttctaacaacatcattaccattgaggtggcccttttgaatgatatcctggcattcagatggacttgtgcaaatatctgtatcaccacatcaatggaataagaatagagcattgtcaggtttacctacttgttcataagcttttattatgcatgtgcaatcttcgtggttcctgaatgctcaattattataaggtgtccaaaaataacttccaagatatatacaaatttcacgtcatctcaaaaaaaaaaaaaaaaggggccgctcgcgatctagttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggctacggcggcggcggtgggggatacggtggtgcaaaccgcggcggcggctacggcaacaacgacgggaactggaggaactgagcggtggggtccgctgaggcctagttatcttgttcgcttctgctaccgtgttcaccctagtctagagggggtttatcttcgtctgtggtcgtctcgtgtccgtatgtttcgtttcgtgttcgttgttgttgttgcccatctgtgtttttgaccgcaagctcgctcctctgatgttgttagtgatgtctacaatcgtccaatcccgagcctgcattgagctccaccgattatcttatctggctatacctgcagttgtgcatttgattccgacgggcctaaacctgaacacgccaatattaaacattgtacaaactacaagtgctccaataaagaacacaaagattcaggaaac

SEQ ID NO: 1157 - DNA, 338 bp, Zea mays
  Clone ID: PAT_MRT4577_146023C.1
cgcacagggctacaccaaccaacagcaggggaaattctcccattccactttattttatgcgggtaatatatggctgcccgcaacgggcggcaagggcctgtgcaaggacggatctaaccgccaccggaaggtgctccgggacaacatccaggggatcacgaagccggctatccggcggctggcgcgcaggggcggcgtgaagcgcatctccgggctcatctacgaggagacccgcggcgtcctcaagatcttcctggagaacgtgatccgagacgccttcacctacaccgagcacgcgcgccgcaagaccgtaacagccatggacgttttttacgcac

SEQ ID NO: 1158 - DNA, 379 bp, Zea mays
  Clone ID: PAT_MRT4577_146083C.1
aaacattcaagaccagaaaaccttattattcgaactattactcataagaaatccaaaagagggcaccaccaatgatgggttggtcggagaacgctcctgggtttgtcaaagcacggtggctgaatggcagaaattgtggcacatgtaagagggggccagagctaggcgcacagagctgggagaacgggaacaactgtgggtgtatcgagaaagtagcagggctcataccagctagctgcttgaatggtagtagctgttgctgctgcagataagcagcagagtagaatgctgccagctggttgaatggaagaaaatgctggggggaggtaggcagcagctggctgaatggtagttggtgctgctgcaaataagaagcaga

SEQ ID NO: 1159 - DNA, 718 bp, Zea mays
  Clone ID: PAT_MRT4577_146094C.1
ggaggaaagtcgagagaagaaagggaccaaagaagagaggaagggaagatgagcaacgcagctagcacaacccccctcctcgcccactacaagatggggaaatttgatctttctcacagggtggttcttgcgccgctcacaagggagcggtcgttcggaaacgttcctcagccccatgccatactgtattatcagcagagagcaaccaaaggaggccttttgattgctgaggccaccggagtttcagacactgctcaagggtacaaagatactcctggcatctggaccaagaagcaggtagaagcatggaagccgatcgtcgatggggttcatgccaaaggaggaatatttttctgtcaggtttggcatgtaggaagagtctccaatcatacttttcagcctaatgggcaggctccaatttcaagcaccgataagccaatcaaacctgcaacgagagccgatggcattggattggctaaagtctcaactcctaggcgactaacgactgatgaaatcccgttggtcatcgatgatttcagggtcgctgctagaaatgcaattgaagccggatttgatggcgtcgaaatccacggagctcatggttatttgatcgaccagttcctgaaggaccaagtcaacgatcgcaccgacaaatacggtgggagcttagagaaccgttgccgctttgcgctagaagtagtccaggccgtagctgatg

SEQ ID NO: 1160 - DNA, 2104 bp, Zea mays
  Clone ID: PAT_MRT4577_146234C.1
ggacgggggtcgccctgcgccggcaactggaggccaatagaatcgctcgcttgcgttatctggttcggctcgtcagttgtcgtttcctcccttcccatcccccactgctcagcagtcagtcagcactcgccacccacacgcctccgctccgcccacggttccactccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatctccttgagcctatcaaagcaaagaatccaaagataacatatgcagacctgtatcagcttgctggagtggttgcagtcgaagtgactggggggccaactgttgaatttattcctggcagacgtgattcgtcggtgtgcccccgtgaagggcgtctgccagatgctaagaaaggtgcaccacatctgagggacatcttttatcggatgggcttatcggacaaagatattgtagctctatcagggggacatactctgggaagggctcaccctgagaggtctggattcgatggtgcctggacaaaggagcctcttaagtttgataactcatactttcttgagctgttgaatgaggaatctgagggacttttaaagctcccaactgacaaggcactgttatcagatcctgaatttaggcgctatgtggagctctatgcaaaggatgaagatgcgttcttcaaagattatgctgaatcacacaagaaactctctgagcttggcttcacgcctcgcagcacagcaccatccaaatcagatcttccaaccgccgccgtgcttgcacagagtgcctttggggtagcagttgctgcagccgtagttatcgctggctacttgtacgaggcttccaagaaggccaagtagagggcgaagttcttctccacatggctttgctttagtaagtctgaagatcgaataacaggaccatatctgaagatcgaataacggatcatataaatgagttactcggaaaatgttctgaaatccttacgaacagaacgttgccttcatgtttacactgtactcatgagtcacagtgatatggagatggcatagcctactattggaagtatatgcattctgtgtaatctatgcatcggattgcagctggaacttccgtggaaattgacagtgatgtgtcgacataggaactgcgatttggttcaatgaccacgtagagggaatgtactggcgggatccttttatttatagcagatagtgttggtgagggaggcctatgtcgcgttttcttgactgagcaagtacagccgactgctggctataaagatgcttccaacgtctctgtcataccaaaaaaaaaaaaaaaaaaaaaaaaaaaagtctgcgttgttaccactgctttgtctgaagtgcaaccggtttggatacaagaagtagtcaattcctatatcactgatgctgaagctcaggaactgctgaccaaactgctaatccagagcccagatgagcaaggcttctgtcttcaacaaggcattattaggaggggcaggcaagtgtggattggtgcaaactcagctctcagaactaagctgatttcagctttgcatgccagtgctaattggtggacattctggtggtccagctacctaccaaagggtggagagattcttttattggaaagggctcaaatctgatgttatgctatttgtgcagcagtgtcaaatttgtcagcaagccaagtctgagagggtgcacccagcaggcttacttcaaccattacctgtccctaggggagcttgggaagaaattacaatggattttattgagggcttgcccaaatctgaaggttttgatattattctggttgtggtggacaggtttaccaagtttgcacgttttctacccttaaacatcctttcactgctcaaa

SEQ ID NO: 1161 - DNA, 1412 bp, Zea mays
  Clone ID: PAT_MRT4577_146362C.1
cattgggtacctcgaggccggccgggactcgaccagggagggaaagataatagaagcgagagagcgagcagcagtaggcagcggcgcgggcgaggagcagaccagcacccagcagccctcgtcggggggcggcagctgcagcttcaccagccgccgcctttccccgtctcctctgcctctgcctctccccctaacccccttccatttctccaccccaccccgctcccgcttccgcttcctcgccacttagttcgttccgcacccgcagccgcggctgcgttcgcattgggggcacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgaggtacttcaaggcccttgaagtggtacagtgccctgctaaatgtgcttgacgttgcattaacatttgtatgagctgagtcgcccattcctttttatgaacgccgggactcttctcattctccccctgcatttttgtcattcagctggatatttcgaatctggtgtgttttgagatgtattaaagaacgtcaaatagattccccccttggtctctgtccattgaaagtaaatatccgtcatatgtttaaaaaaaaaaaaaa

SEQ ID NO: 1162 - DNA, 2658 bp, Zea mays
  Clone ID: PAT_MRT4577_146436C.1
gactattaaatactcaaattgacattcaaacattacgatgatgtgacacggactaatgaaaccaaacaccggaactcaggcaaaacgacatgtagaacatgtactatactagtaggattacagataacaagaacaaactgtaaaacagagtaccatatagctatacaacaaactcattgcctggccggcaggagaaccgttaacgtgcggaaaacctcaaacagtagtcaagatttagcttatcatatgtaattagggataaacgacagtgatccgaagcttagtcgacctcctccatcttgctttcgccggcgtcatcctccagcggaggcatctcagcttcggcctcagcagactcgtcctcatcgatgctcagaccgagctttagcatgcgatggatccgggtgccaaaggtgttggggtcatccaggctgaagccggaggtcaggagagctgtctcgaacagcaacatcacaagatccttgactgacttgtcattcttgtcagcctcggcgcgcttacggagctcatccatgattgggttctccgggttgatttccatagtctttttgctcgacatgtaccccgacatgctagagtccctcagggcctgcgccttcatgatcctctccatgttggctgtccagccatactcaccagtgacaaggcagcacggtgagtccacaacacggtcagacaccacaaccttctcaaccttgtcgcccagaacctccttgatgatcttgcacagaccctcaaacttctccttcagctcctccttcctcttcttctcatcctcggtctcatcaagcttcagaccctccttggtggccgagacaagcttcttgccctcaaactccttgagctgaccaacagcatactcatcaatggcatcaaccatgtacaggacctcgtagcccctcttcttcagcttctccaggaaaggggagttctccactgccttcttgctctcaccagtgatatagtagatgtcattctgtccctccttcatcctggtcacgtagtccttgaggctggtcagctcatcaccactcttggtggagtggtatctcagaagctcggcgatcttggtcctgttctgcgagtcctcatggatgccaagcttgaggttcttggagaaagcctcataaaacttgttgtagtcctccttgttctcagcaatctcaaagaagagctcaacacacttcttcacaaggttcttcctgatcaccttcaggatcttgttctgctgaagagtctcacgagagatattgaggggaaggtcctcagagtcaacaatacccttaacaaaactcagccactcagggatcagttcctcacagttgtccatgatgaacaccctgcgcacatagagcttgatgttgttttgcttcttccttgtgtcgaagagatcaaagggggccctcttaggaacaaagagaacagccttgaactccagctgaccctccacagagaagtgcttcacagccagatgctcctcccagtcatttgtcaagcttttgtagaaggcagcatattcttcctttgtgatctcttctggcttcctcatccagatgggcttctgcttgttgatcaatgaccactcgtgagaaacctccttgatcttctttttctttttttctttctcttccttctcctcgtcaacatcctcaacctttccctcctcagcgtctttcttctcttcctcatcttcatcatcagaaatctccttctccgttgtcttttcggtccacagggagatggggtagctgatgaactcagagtgcttcttgaccaaatccttgaggcgacgctcctcaaggtattctaactgatcttccttgaggaaaagtgtaatcttagtacccctgccaagctgctccccagacgtgtcacgagtaacagtgaacgacccgcccgcctgggattcccacacgtactgctcgtcatcgttatgcttggtggtcacgacgaccctctcggcgacgaggtaggcagagtagaaaccgacaccgaactgcccaatcatagacacatcagcgccagcagcaagggcttccatgaactccttggtcccggacctggcgatggtaccgaggttgttgacaaggtcggacttggtcatgccgatgccgctgtcgatgatggagagcgtgttcgaagccttgtctggtacaatgtggatgaacagctccggctgcgcatcgagcttgctcttgtcagtgaggctctcgaacctgattttgtccaacgcatcggaagagttggaaatgagctcccggaggaagatctccttgttggaatagaaggtgttgatgatgagtgagagcagctggttgatctcagcctgaaaggcgaaggtctccgtctctgtcgccatggcgccctgactcttgagctctgaagcttgcagcagtcggctagggatggaggcgttgtcggatcgcggctagggttggagccttggaggttttccgaatcgagaggggcagcgaggattgaggtagtggggtatttatttggcgccgcgcttctagaaagttcgacatagacccagactcgttcgctggtgctggagtgccatttgcgcttccgggaggttcggcatgggcggatgggcctcgctgctggaggagtgagggtatcatttccggccgg

SEQ ID NO: 1163 - DNA, 2619 bp, Zea mays
  Clone ID: PAT_MRT4577_146438C.1
actctcgagttttttttttttttttttaattgggaaacgaaaccagtttcatttcctggcatagccgatttgctacaacatgcctaaaatcctaaccattcttttttcaccactactcaaactatgggctacccaaagagaaaaaggggtagtaccctgatctgtctgtcccaatctcacacaacccaatgggcaaaacatgtactacatttttaccattacgaataataacgacaaactgttaaaaagggtaaacataacagataaaccagacttatagcctggccagcaggacaaccgataacgtgccaaaaacctcgaacaatagtgaaaattaagctatcacaggtagcttagctagggataagataaacggcaagcatgcgatgcgacacttagtcgacctcctccatcttgctttcaccagcgtcgtcctcaagctgaggcatctcagcctctgcctcaacaggctcgtcctcatcgatgctcagaccgagtttgagcatgcggtggatccggttgccgaaggtgttggggtcatccaggctgaagccggaggtcaggagagcagtctcgaacagcagcatcacgagatccttgactgacttgtcattcttgtcagcctcggcacgcttgcggagctcatccatgatagggttctctgggttgatctccattgtctttttgctcgacatgtagcccgccatgctcgagtccctcagggcctgtgccttcatgatcctctccatgttggcggtccagccatactcgccagtcacaaggcagcacggtgagtccacaacgcgatcagacaccaccaccttctcaactttgtcacccagaacctccttgatgaccttgcacagcccctcaaacttctccttcagctcctccttcctcttcttctcgtcctcagtctcatcaagcttcagaccctccttggtggcagagacaagcttcttgccctcaaactccttgagctgaccaacagcatactcgtcaatggcatcaaccatgtacagaacctcatagcccctcttcttcagcttctcaaggaagggggagttctccactgccttcttgctctcaccagtgatatagtatatgtcattctgtccctccttcatcctggtcacgtagtccttgaggctggtcagttcatcaccgctcttggtggagtggtatctcaggagctcggcgatcttggtcctgttctgcgagtcctcgtggatgccaagcttgaggttcttggagaaagcctcgtaaaacttgttgtagtcctccttgttctcagcaatctcaaagaagagctcaacacacttcttcacaaggttcttcctgatcaccttcaggatcttgttctgctgaagagtctcacgagagatattgaggggaaggtcctcagagtcaacaatacccttaacgaagctcagccactcagggatcagctcttcgcagttgtccatgatgaacaccctgtgcacatagagcttgatgttgttttgcttcttcttggtgtcaaagagatcaaagggggccctcttaggaacaaagagaacagccttgaactccagttgaccctccacagagaagtgcttcacagccagatgctcctcccagtcatttgtcaagctcttatagaaggcagcatattcttcttttgtgatttcttctggcttcctcatccatatgggcttctgcttgttgaccaatgaccactcatgagaaacctccttgatcttctttttcttcttttctttctcttccttctcatcaacatcctcaacctttccttcctcagcatctttcttctcttcctcgtcttcgtcgtcagaaatttccttctctgttgtcttttcagtccacagggagatggggtagctgatgaactcagagtgcttcttgaccagatccttgaggcgacgctcctcaaggtactccagctgatcgtccttaaggaacagtgtgatcttagtgcccctgccaagctgctcccctgacgtgtcacgagtaacagtgaacgacccgcccgcttgggactcccacacgtactgctcgtcatcgttgtgcttggtggtcacgacaactctatcggcgacgaggtaggcagagtagaaaccgacgccgaactggccaatcatggacacatcagcgccggcagcaagagcttccatgaactccttggtcccggacctggcgatggtaccgaggttgttgacaaggtcggacttggtcatgccgatgccgctgtcgatgatggagagcgtgttcgtggccttgtctgggacaaggtggatgaaaagctcaggctgcgcatcgagcttgctcttgtcagtgagactctcgaacctgatcttgtccagcgcatcggaagagttggagataagctcgcggaggaagatctccttgttggagtagaaggtgttgatgatgagtgagagcagctggttgatctcagcctgaaatgcgaaggtctccgtctcactcgccatggcgcagattcctgagctctgaaacttgcaggaggcggctagggtttgagaggtttccggatcgagagttttttttttttttttttttttttttttttttttttttaaaaagaaggaaaccccggcc

SEQ ID NO: 1164 - DNA, 3280 bp, Zea mays
  Clone ID: PAT_MRT4577_146439C.1
acatggttgatgccattgacgagtatgctgttggtcagctcaaggagtttgagggcaagaagcttgtctctgccaccaaggagggtctgaagcttgatgagactgaggacgagaagaagagaaaggaggagctgaaggagaagtttgaggggctgtgcaaggtcatcaaggaggttcttggtgacaaagttgagaaggtggtggtgtctgatcgcgttgtggactcaccgtgctgccttgtgactggcgagtatggctggaccgccaacatggagaggatcatgaaggcacaggccctgagggactccagcatggcgggctacatgtcgagcaaaaagacaatggagatcaacccagagaaccctatcatggatgagctccgcaagcgtgccgaggctgacaagaatgacaagtcagtcaaggatctcgtgatgctgctgttcgagactgctctcctgacctccggcttcggcctggatgaccccaacacattcggcaaccggatccaccgcatgctcaagctcggtctgagcatcgatgaggacgagcctgttgaggcagaggctgagatgcctcagcttgaggacgacgctggtgaaagcaagatggaggaggtcgactaagtgtcgcatcgcatgcttaccgtttatcttatccctagctaagccacctgtgatagcttaattttcactattgttcgaggtttttggcacgttatcggttgccctgctggccaggctataagtctggtttatctgttatgtttactctttttaacatcttgtcgttattattcgtaatggtaaaaatgtactacatttttaccattacgaataataacgacaaactgttaaaaagggtaaacataacagataaaccagacttatagcctggccagcaggacaaccgataacgtgccaaaaacctcgaacaatagtgaaaattaagctatcacaggtagcttagctagggataagataaacggcaagcatgcgatgcgacacttagtcgacctcctccatcttgctttcaccagcgtcgtcctcaagctgaggcatctcagcctctgcctcaacaggctcgtcctcatcgatgctcagaccgagtttgagcatgcggtggatccggttgccgaaggtgttggggtcatccaggctgaagccggaggtcaggagagcagtctcgaacagcagcatcacgagatccttgactgacttgtcattcttgtcagcctcggcacgcttgcggagctcatccatgatagggttctctgggttgatctccattgtctttttgctcgacatgtagcccgccatgctcgagtccctcagggcctgtgccttcatgatcctctccatgttggcggtccagccatactcgccagtcacaaggcagcacggtgagtccacaacgcgatcagacaccaccaccttctcaactttgtcacccagaacctccttgatgaccttgcacagcccctcaaacttctccttcagctcctccttcctcttcttctcgtcctcagtctcatcaagcttcagaccctccttggtggcagagacaagcttcttgccctcaaactccttgagctgaccaacagcatactcgtcaatggcatcaaccatgtacagaacctcatagcccctcttcttcagcttctcaaggaagggggagttctccactgccttcttgctctcaccagtgatatagtagatgtcattctgtccctccttcatcctggtcacgtagtccttgaggctggtcagctcatcaccactcttggtggagtggtatctcagaagctcggcgatcttggtcctgttctgcgagtcctcatggatgccaagcttgaggttcttggagaaagcctcgtaaaacttgttgtagtcctccttgttctcagcaatctcaaagaagagctcaacacacttcttcacaaggttcttcctgatcaccttcaggatcttgttctgctgaagagtctcacgagagatattgaggggaaggtcctcagagtcaacaatacccttaacgaagctcagccactcagggatcagctcttcgcagttgtccatgatgaacaccctgcgcacatagagcttgatgttgttttgcttcttcttggtgtcaaagagatcaaagggggccctcttaggaacaaagagaacagccttgaactccagttgaccctccacagagaagtgcttcacagccagatgctcctcccagtcatttgtcaagctcttatagaaggcagcatattcttcttttgtgatttcttctggcttcctcatccatatgggcttctgcttgttgaccaatgaccactcatgagaaacctccttgatcttctttttcttcttttctttctcttccttctcatcaacatcctcaacctttccttcctcagcatctttcttctcttcctcgtcttcgtcgtcagaaatttccttctctgttgtcttttcagtccacagggagatggggtagctgatgaactcagagtgcttcttgaccagatccttgaggcgacgctcctcaaggtactccagctgatcgtccttaaggaacagtgtgatcttagtgcccctgccaagctgctcccctgacgtgtcacgagtaacagtgaacgacccgcccgcttgggactcccacacgtactgctcgtcatcgttgtgcttggtggtcacgacaactctatcggcgacgaggtaggcagagtagaaaccgacgccgaactggccaatcatggacacatcagcgccggcagcaagagcttccatgaactccttcgtcccggacctggcgatggtaccgaggttgttgacaaggtcggacttggtcatgccgatgccgctgtcgatgatggagagcgtgttcgtggccttgtctgggacaaggtggatgaaaagctcaggctgcgcatcgagcttgctcttgtcagtgagactctcgaacctgatcttgtccagcgcatcggaagagttggagataagctcgcggaggaagatctccttgttggagtagaaggtgttgatgatgagtgagagcagctggttgatctcagcctgaaatgcgaaggtctccgtctcactcgccatggcgccctgactcttgagctctgaagcttgcagcagtcggctagggatggaggcgttgtcggatcgcggctagggttggagccttggaggttttccgaatcgagaggggcagcgaggattgaggtagtggggtatttatttggcgccgcgcttctagaaagttcgcggacgcgagggta

SEQ ID NO: 1165 - DNA, 1325 bp, Zea mays
  UNSURE (1)..(1325): unsure at all n locations
  Clone ID: PAT_MRT4577_146470C.1
  unsure (1)..(1325): unsure at all n locations
acatttttttattttttttttttttttacttttttttttacttttttttttttttttttttttttttttttttttttttttttttttttttttttttttatttttttttcttttttttttttttttttttnntttatttattataattcggcacgaggcacactgcccctctaccctgcctgccgtttccatctccatccagttctccgcacccacccacccacccactccactcctttccccaacccatggccgccgccgccgccgccgccggcacccgggaggagatggtctacatggccaagctagcggagcaggcggagcggtacgaggagatggtcgagttcatggagaaggtcgcggccgccgccgagctcaccgtcgaggagcgcaacctgctctccgtcgcctacaagaacgtcatcggcgcgcgccgcgcctcctggcgcatcgtatcctccatcgagcacaaggaggagacgcggggcgcggcggggcacgccgccgccgccagggggtaccgcgcgcgcgtggaggccgagctctccgggatctgcgcggggatcctgcgcctcctcgacgagcgcctcgtgccggcggcggcggccgtggacgccagggtcttctacctcaagatgaagggggactaccaccgctacctcgccgagttcaagaccggcgccgagcgcaaggacgccgcggactccacgctcgccgcctaccaggccgcgcaggacatcgccgtcaaggagctgccgcccacgcatcccatcaggctcggcctcgccctcaacttctccgtcttctactacgagatcctcagctcgccggaccgcgcctgctcgctggccaagcaggccttcgacgaagctatttcagagctggatagtcttggggaagagtcgtacaaggatagcaccctcatcatgcagcttcttcgtgacaacctcaccttgtggacttctgacatgcaggaggatggtggcgatgaaatgcgggatgcaaacaagcctgacgaggagcagtagtagccaaacatctccatcgtcatgccatgccatgccatgcttgtacaaggaccattttcgtgtgtcctttccttcaatcgtcgacctttcgttttgttgttatactgctattgtggaaccctgttactgttactgttagtgtatcctattggcaataatcaaatgtggtatggttgactactaaaaaaaaaaaaaaaaatcatgagactagttcctcgtgccttctacacaaagaatgagccgcttttttttttttttttttcgatatttgacgcgaattcgcgcaccacagttctt

SEQ ID NO: 1166 - DNA, 2355 bp, Zea mays
  Clone ID: PAT_MRT4577_146477C.1
aattcggcaccaggtccccctccacccccgagcccaaacgcagctagctccccattccacccaagctcccgcagccagatgctctcccccgctcgagccccaccgccgccgcccgtccccgccgccgggtagaccgcccgatccgacggcgcccgccgcacccatgggccgcggcggcgcgcgcgcggcccccgccgccgcggtgccgccctggcacgcgctcccggacgaggtctgggagcacgccttctccttcctccccgcggactcggaccggggcgccgccgcgtgcgcctgccacgcctggctccgcttcgagcgccgctcgcgccgccgccttgccgtcgccaactgctacgccgcgtccccgcgcgacgccgtcgagcgcttccccgccgtccgcgccgtcgaggtcaagggcaagccccacttcgccgacttcggcctcgttccgcccgcctggggcgccgacgccgcgccctgggtcgccgccgccgccgccggctggccgctgctcgaggagattagctttaagcgcatggtcgtcaccgacgactgcctcgagatgatcgcggcctccttcaggaacttccaggtgctgcgcctcgtctcctgcgagggcttcagtacagccggcctcgctgccattgccgctgcttgcagaaatctaagagaacttgaccttcaggagaatgagattgaggattgctctattcattggctcagtctatttccagtatctttcacttctttggtaactctaaatttttcatgcctagagggggatgtcaatatcactgtacttgaacaattagtaaccagatgcagcaacctcaagactctcaagctcaacaatgctatacctcttgacaagcttgctaacctccttcgcaaggctcctcagattgtagaactcggaacaggaagattctctgcagattaccatccggatctcttttcgaagcttgaagcagcatttgctggctgtaaaagcttaagaaggctctctggggcttgggatgccgttccagaatacctgccagcattttattgtgtatgcgaaggcctcacatcactaaatctgagctatgctactgtacgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacggatgaccaacgaggcccttattaccatcgcgaagaaccggcccaacttcacttgcttccgcctatgcatcattgagcctcacacaccagattacattacacaccagcctcttgatgcaggttttagtgccattgtggaatcatgcaagggcctcaggcggctttctgtttcaggccttctcacggacagtgtatttaaatccatcggggcacatgctgaccgtcttgagatgctctcgattgccttcgccgggaacagtgatttgggcctccattacatcctatcgggctgcaagagcttgaagaagctagagattagggactgcccatttggtgacaagcccttgctggcaaacgctgccaagctggagacaatgcgatccctttggatgtcgacgtgctcaatgaccttgggcgcatgccggcagcttgcgcgcaagatgccccgtcttagtgtggaggtcatgaatgatcctcgacggggattccccttggactctctaacagatgagagccctgttgagacgttgtatgtctaccggacaatttcaggtccaaggtccgacacaccagcttgtgtccagattctctaaggggcagctgtggtctacaaaggtactatggaagcatccattttcaatcacatcatgtaccttcaacaccttactagcataacctggatcgtctccttgaagtagcaaggctggtgacctcggtaatcctgtcataatctctgcttagctgtacaactgtttctgggagtttagggtgagagactcagggtccctttcaggtgttaataactgtagggaggacactcgatgagttacaggaactactagatagcgtcttgaggaaacttgggtttgttttcttagcgtgcctagttcttttcatgtataaaaaaatatgggatcattccaatgctgccacaatgtactgtactattggaacaattgtacttggagcctctacttttttgagttttgaccccctccgaaaaaaaaaaaaa

SEQ ID NO: 1167 - DNA, 1830 bp, Zea mays
  Clone ID: PAT_MRT4577_146531C.1
caccgcactagcctagcctccccccgccgctcggccgaatagaatcgattccccctcctccgtcgctgtccggccgaccgcggagagcggagtcgatcgggggcgacaacgatggtggttagcgtggccgcgaccgggcccggcacggacgccgagccggtgagctccaccttcttcgcgtcccgctacgtccgcgacccactcccacggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagacagctattggggtcggaacagtgggatcctcggaagcgatcatgcttgcaggtctagcgttcaagaggaaatggcagaacaagaggaaggagcaggggaaaccgtgtgacagacccaacatcgtcaccggtgccaacgttcaggtctgctgggagaagtttgcaaggtattttgaggtggagctgaaggaggttaagctatcagaagggtactacgtcatggaccccgtcaaggctgttgagatggtggacgagaacactatctgtgtcgcggcgatcttggggtcgactctcaccggagagttcgaggatgtcaagcagttgaacgaccttcttacagagaagaacaaggaaactgggtgggacgtgcctatccacgtcgacgccgcgagcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcatcttccatatcaactacctggggacggaccagcctacgttcacgctcaacttctccaaaggttcctgtcagatcattgcgcagtactatcaactcattcgcctaggcttcgaggggtacagaaacatcatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgccaccgccgagcagtcgggcgacggcgtcgtggccaagaaaagcgtgctggagatcgagcgggaggtcgccgcgcgctggatgaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggtttggtgctaaaaaaaaaaaaaaaaaagcggcc

SEQ ID NO: 1168 - DNA, 671 bp, Zea mays
  Clone ID: PAT_MRT4577_146534C.1
actccactagctcacgggccagattccggcgtcgctgggggcgctctcggcgctccaggtgctccgcttgggagacaacccgggcctgtcgggcgccatcccggacgcgctaggcaagctcggcaacctcaccgcgctcggcctagcctcctgcaacctcacctgcccgatccctgcgagcctcgtgcggctcgacgcgctcacggcgctgaacctgcagcagaacgcgctgtccggcccgataccgcgcggcctcgccggcttggcgagcctccaggcgctctcgctcgccggcaaccagctcacgggcgcgataccgccggagctcgggacgctcgcgaggctccagaagctcaaccttgggaacaactcgctggtgggcgccataccgccggagctcggcgcgctcggcgagctccagtacctcaacctcatgaacaatcgcctcaccggccgcgtcccgcgcacgctcgccgcgctctcgcgcgtgcacacgatcgacctgtccggcaacatgctctctggtgcgctgcccgccgagctcggccgcctgccgcagcttattttcttggtgctatccgacaaccaactcaccggcagcgtccccggcgacctgtgcggcggcgatgaagcggagtccagtagcatcgagcaccttatgctctcgatga

SEQ ID NO: 1169 - DNA, 452 bp, Zea mays
  Clone ID: PAT_MRT4577_146736C.1
cccgcgcgtacgcaagcttcgcttcatctgcaacatgtacaggaccgggtgctgggtgcgggagtatcaccggacaccgtcgggcgtctgcaatggcacgagcggatgtcaggcgatgcttatcagatgctacatcgaccgctaaagcatgttcagcatgacgccgtaggcctgcgcagcactgggggccatgacctacagatgcatcaaggcggtggaatgcgagccccatgcggtcacctacggacgtctgctgacctccatgaaatccattatgaccaacgccagcggctgctaccagcatctgaagggcgcttgcgcaaccgcccgctaggtcgtaagcttcagcagaatgcaggaacctaacctgtcttgctcggacatgttcgacggctaccgctagcgctttgcgctgtgaacctggtctgcatcgccatcgcctttgcagacta

SEQ ID NO: 1170 - DNA, 1172 bp, Zea mays
  Clone ID: PAT_MRT4577_146756C.1
gtagaccactacgcgattgggtcgctcgaggaggcccgctagcgaccggccagtgctcccccgaccccgagtcccgaggccgacgccattcctgattcctccatcttccgttccgccgcaccgccgccggagatatgtcgaggctcgctgctgccgccctccgctgcgtcgtcactgcatcgagagatacctcctcatctcgcttcgccgtgtctgcgccggtgtctgctcggctcttctccgcggatgcatccggtgaagccgccgccacggccgcagagtcgcaggatgactctttcttcaaggcatcccgcgaaggattagcctatggaaggttttacagtgtcattggtggaggcagtcgtcttgagaagaacatattgaaaactgatattatccatcaccttgacagatgtggattgtcattggatgatgtgaagattgaatacaacaagggatatgctccattggccgctttgttgaggttttcttcgaaggcaatgtttaccaccgcaattaggcaagcaaatcagaatcgtctgcacaggattgatgagataagtcgtgaaacatgggatctcaaaaagtccttcgatgggaaagcggtattactgcaaggagtcccacgaaatgccctcgcagatgacatagagcgttttttgtgtggcacgaactttgaacctccaccgtttgaaacctttctaagagctggtgtcccagagcccataagaatgatgctggttaaattccacacgaagactgatgcgatgaatgccttcatcaccaaaaacaggagtttctgtctgaacagtcaagttagcatgcgtgttctccagtaactgagtagccagtcgaatctcgtgatgtttgccccggctttgtcaaacaaaaagccttttaagtccgatctgaggtctatccagtatccacaaatgttgccgtattgtgtggttgtgcaggttatattggactggcagcctgctttaggttttgattcctactagtttgtggtttcagctgtactgcaccgcttttatttcatgagtactctggaaaatgtaccaccattccgctttacaatgaaataattaacggcacaaacgctaagggttcgaatctgcaaaaaaaaaaaaaaaaaaaaaaaaaacaaaaaaaaaaaaaaaaaagcggcc

SEQ ID NO: 1171 - DNA, 463 bp, Zea mays
  Clone ID: PAT_MRT4577_147020C.1
gggagcaccaaaaagcaccattttttccttaagaataacttaaaaaaaagccggggggggggaaaagcatccatcgacccgcagcccatgctgttggaggcaggggtctgctgaaaccgggggtgaacacagcactaacaactgacacagagggaccttgcaataaaaaacacagggggggaacaacaaacacgacacgaacgaagataaacccttgggactaggggaaacatcacgggagcgaaaaggaaaacttgggcgggcgggccccaccggtaagttcctccagttcccgggggagttgccgaaaccgccgccacgggggccaccgccgaagccgccgccaccaccaccggagccgccgccgccaccggagccgccgccaccgccggagccgccaccgccataacggggcccgccaccgccgaaaccgccgccttcacgggcaccaccggacccaccg

SEQ ID NO: 1172 - DNA, 1840 bp, Zea mays
  Clone ID: PAT_MRT4577_147063C.1
gcacgagccgcatcgttcgcttcctttcgtcaactccactcctcttggccgccgcattacctcctcttcgccgctgccgccaccgctccaccgggcagccagccagccatggatgaggagtacgacgtgatcgtgcttggcacggggctcaaggagtgcatcctcagtggtctcctttccgtcgacggcctcaaggttttgcatatggacagaaacgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacactgatgtgacaaagtacttgtcattcaaagctgttgatgggagctatgttttcagcaaagggaagatttacaaggtccctgccactgatatggaggctctgaagtcccctttgatgggtctattcgagaagcgcagagcaaggaacttcttcatttatgtccaagattacaatgaagctgatccaaggacacatcaaggattagaccttactagggtgacaactagagaacttatagcaaaatatggtttaagtgatgatacagtggatttcattggacatgcacttgctcttcatagagatgatcgctatcttgatgaaccggcacttgatacagtgaaaaggatgaaactatatgcagactctcttgcgcgctttcaaggaggctcgccatatatctatccattgtatggtctgggtgagctaccacagggttttgcacgattgagtgctgtttatggtggtacttacatgttaaacaagccagagtgcaaggttgaattcgatatggaggggaaagtgtgtggtgtcacatctgaaggtgaaactgcaaagtgcaagaaggtggtctgtgatccttcgtatttaccaaacaaggttaggaagattggtagagttgttcgtgcaattgctatcatgagccacccaatccctaatacaaatgagtcccactcggttcaaattattttgcctcagaaacaacttggacgcagatcagacatgtatgttttctgttgctcatacacgcacaatgttgcaccaagagggaagttcattgcatttgtgtctgcagaagcagagactgataatccccagtctgagctaaagcctggaattgatctacttggttctgtagatgagattttctatgatatctatgacagatatgaaccagtgaatgaaccatctcttgataattgctttgtctcgacaagctatgatgccaccacacattttgagacaactgtaacagatgttctgaacatgtatacaatgatcaccggaaagactgtagaccttagtgtggatttgagtgctgctagtgctgccgaagaatactgatttcagtcatagtgtcatgtttatcaaagatcacatcgttggcgacagcacatgacccacattaatgaatggctggaatgcgtttattcggttccagattatatcatgccacatgtactgttctgcgtaatgtctattgggcacttgttgctgacagaactgtgcacaatgttgattcaagttgatggatggtggtggttctgttatttactagttagtcgaatggtgcacaacattaaacagtgaccatcatggctgtgtgatgtatcataataactgttcagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1173 - DNA, 158 bp, Zea mays
  Clone ID: PAT_MRT4577_147104C.1
gacttctactccccctcttaccaagtcctcctcggattagggttccttacggttttgtgggggggctatggcagcgggtggtgtggaataccgtttcttataccgcaggctttccttggccaccaacaacgaatccttggataaagcctttctcttct

SEQ ID NO: 1174 - DNA, 1630 bp, Zea mays
  Clone ID: PAT_MRT4577_147208C.1
cgagtagttccctctcctctctctgattcttctgcttctcggtctagctagctagctcggtgcctcggccaaccgggcgtcgcgcgctggccggcctgccaggcaagcaacaatggcagattcaggggaggggcgtcgggtgtgcggcatgccggagaaggcgcagctgcacgtggcgatgctgctgctgcagttcggctacgcgggcttccacgtggtgtcgcggctggcgctcaacatgggcatcagcaagctcgtcttccccgtctaccgcaacatcatcgcgctctgcctgctcgtgcccttcgcctactttctggagaagaaggacaggccgcagctgaccctcaacttcgtcgtccagttcttccttctcgccctctgcggcatcacggcgaaccaagggttctacctgctgggcctggacaacacgtcgccgacgttcgcgtccgccatccagaactcggtcccggccatcaccttcgccatggccgcggcgctgcggatcgagaaggtccggctggaccgccgcgacggcgtggccaaggtggcgggcacgctggcgtgcgtggcgggtgcgtccgtcatcacgctctacaagggccccaccatcttcggtcccagcggcagcggcggcggcggcggcggcctcgagctggcggcggtgggcggcgacaagaactggacgctggggtgcgtgtacctgatcgggcactgcctgtcgtggtcgggctggctggtgctgcaggcccccgtgctgaagaagtacccggcgcggctgtccgtcacctcctacacctgcttcttcggtgtcatccagttcctcgtcatcgccgccttcatggagagggacgcggaggcctggaagttccactccggatccgagctcttcaccatcctatacgccgggttcatcgcgtccggggtggcgttcgcggtgcagatctggtgcatcgaccgtgggggcccggtgttcgtggcggtgtaccagccggtgcagacgctggtggtggccatcatggcgtcgctcaccctgggcgagaagttctacctggggggcatcatcggcgccgtgctcatcgtcgccggcctctacctcgtgctctggggcaagagcgaggagagggcgcgcgtcgccagggacgccgtctccggcggcgaccgcgaggggctccttgtcgcggccgcggccggaggtggtggcggcggcatcgtcaggagcgccggcaataaggcggcgtcggccgcgacgcagcctctcctgctgccgtcctccacccccactgacaacgtctgaccgatccatggatggatgaatcgtcatccatgcttgcctttggtgcgtggagatctgaggcagcatgcagaattaccagttattagtcatttctttgaggttttccttgttgattttcacgcatgtatgtatgctgctacctacgtgtacgtacgtacgtatatgcatgcatcactatggttgttacgcctttgatcacaagacaactacgtagctaggatcgtcggagtgtgttgacgacgtttggtatgtgcatgcgcaatgcctcatcacaggaggtgtgtaataatattagtttgcaggtataaatatgcgttttattaaaagaaaaaa

SEQ ID NO: 1175 - DNA, 1774 bp, Zea mays
  Clone ID: PAT_MRT4577_147210C.1
gctcgatcttgcctgaatatagttcatttcctctgtctgactcttctttgttaatcggccttgctagctagctatctatctagctatctatctagctcggccaagtaataaccgccaaccgggcgtcgtcgcgcgaagtagagcgcacgcagcaacaatggcggacgccggggaggggcggcgggtgtgcggcatgccggagaaggcgcagctgcacgtggcgatgctggcgctgcagttcggctacgcggggttccacgtggtgtcgcggctggcgctcaacatgggcatcagcaagctcgtcttccccgtctaccgcaacatcatcgcgctctgcctcctcgtccccttcgcctactttctcgagaagaaggacaggccgcagctgaccctcaacttcgtcatccagttcttcctcctcgcgctctgcggcatcacggcgaaccaagggttctacctgctggggctggacaacacgtcgccgacgttcgcgtcggcgatccagaactcggtgccggcaatcaccttcgccatggcggcggcgctgcggatcgagaaggtccggctggaccggcgcgacggcgtggccaaggtggccgggacgctggcgtgcgtggcgggtgcgtccgtcatcacgctctacaagggccccaccatcttcggccccagcggcggcggcggcggcggcgacaagctccagctgcagcaggtggccgtggccgtggccgccggcgagaagaactggacgctgggttgcgtgtacctgatcgggcactgcctgtcgtggtccggctggctggtgctccaggcccccgtgctgaagaagtacccggcgcggctctccgtcacctcctacacctgcttcttcggcgtcatccagttcctcgtcatcgccgccttcatggagagggacgccgacgcctggaaattccactccggatccgagctcttcacaatcctatacgccgggttcatcgcgtcgggggtggcgttcgcggtgcagatctggtgcatcgaccgcggtggtccggtgttcgtggcggtgtaccagccggtgcagacgctggtggtggcaatcatggcgtcgctcaccctgggcgagaagttctacctgggcggcatcatcggcgccgtgctcatcatcgccggcctctacctcgtgctctggggcaagagcgaggagagggcgcgcatcgccagggacgccgccgccgccctcgtcgtctccggcgccggcgaccgcgaggggctccttgcggccggcggcggcggtggtggtggcatccggagcaaggcggcggcgtcggcggccgtcacgcagcctctgctgctgccgtcctccacctccaccgacaacgtctgacctatcgagatggatgaatcctaaatttgtggtgcagcatggagagatcagaggctgcatgcgtacgattcatgaggctgccatgctgcggctctgcacgaactcatcatggattggagcagccataagatccgatccagtattattgtcagttagtcttcttttgaggttttccttgttgatttcaggcatgtatgtatgtatgtatgctgctacctacgtatatgcattagtactattgtgtgtgtgtgtggtgagcgagcagacgacggcaggtcattacgactttgatcacgacctgcttttttaattcgtacgtacgtagctagctaggattgtttggaacgagcatgcgtatatgcatgatcatctcgtcagtgtgtacgtcaatattaattgattggtgtgttc

SEQ ID NO: 1176 - DNA, 205 bp, Zea mays
  Clone ID: PAT_MRT4577_147268C.1
cgccgtcgtcctccgatacctcgcgggtgaggttctcgaacttgccgggaacgccgcgagggacaacaagtaagacccgcattgtgccgcgccacatccagcttgctgtgcgccacgacgaggagctgaacaaactgttggggggtgccaccatcgcgagcggtggggttatgcctaacatggggggaacatctgctccccaaga

SEQ ID NO: 1177 - DNA, 443 bp, Zea mays
  Clone ID: PAT_MRT4577_147335C.1
ttcgatctggacgcgcgcgcgacccacgccgtgagggtctccgccgccaccgccgagcagtcgggcgacggcgtcgtggccaagaaaagcgtgctggagatcgagcgggaggtcgccgcgcgctggaggaacgctgtgaacaagaagaagacgggggtctgttgatgcgtcgtgggtcggagaatcggaggtttccccatggcagcttcgtctatatgtcgcgtgcttgtgtctgtgcagggcgcttggatgcgttggtccagttccgcatatgcgaacaacgtgatgtatgcagtatgcaaatgttcaggatcgaggaaccacaaataatgcatgtaaatgttggatttgtgccgtatgttgggtgtggagtatatttcttcgccaggtattttctgtaatcctgtctctaatattaaacgagagcgttacgttcgttaggc

SEQ ID NO: 1178 - DNA, 843 bp, Zea mays
  Clone ID: PAT_MRT4577_147337C.1
tgggtaccgggcccccctcgggtcgacccacgcgtccggctcaacttctccaaggttcctgtcagatcattgcgcagtactatcaactcattcgcctaggcttcgaggggtacagaaacatatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgacgccggccgacgcggagcacgtggcggtgctccgcgtcgtcgtcagggaggacttcagccgcagcctcgccgagcggctggtctcggacgtccgcaagatcctgcgcgagctggacgcgcgcgcgacccacgccgtgagggtctccaccgccaccgccgagcagtcgggcgacggcgtcgtggccaagaaaagcgtgctggagatcgagcgggaggtcgccgcgcgctggatgaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggtttggtgccgtatgttgggtgtggagtatatttcttcgccaaaaaaaaaaaaaaagggcggccgccaccgcggtgga

SEQ ID NO: 1179 - DNA, 729 bp, Zea mays
  Clone ID: PAT_MRT4577_147424C.1
tttgggtccctcgggctgggatcattcttgctctaacgcattcctccatctcccaggcctcctcagacccgagaagccaccgaagcgcagctgcggccatggacgccaccggcactggagctggagggaaggccaagaagggagcggccggtcgcaaggccggtgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgccgaggtcctggagctcgctggcaacgctgccaaggacaacaagaagacgcgcatcgtcccgcgccacgtgctgctggcgatccgcaacgacgaggagctcgggaagctgctggccggcgtgaccatcgcccacggcggcgtgttgcccaacatcaacccggtcctgctgcccaagaagacggcggagaaggcgtctagcggcgggagcaaggaggccaagtccccaaggaaggtcgccaagtcccccaagaaggcctagggtttggaggcggatccgatgttgtcatgtgtaggttgtaagcggggtcaatgtgcttggctgtgcaccttctttgctcaagttgttttctgtcattcctaatggaataggaaatgccgtgtttctgaaaaaaagaaaaaaaaaagcggcc

SEQ ID NO: 1180 - DNA, 646 bp, Zea mays
  Clone ID: PAT_MRT4577_147426C.1
ccaagacctcctcagaccccgagaagcgcagctgcggccatggacgccaccggcactggagctggagggaaggccaagaagggagcggctggtcgcaaggccggtgggccgaggaagaagtcagtgacgaggtccgtgaaggccgggctccagttccccgtcggccgcatcgggcgctacctcaagaagggccgctacgcgcagcgcgtcggcagcggtgcccccgtctacctcgcggccgttctggagtacctcgccgccgaggtcctggagctcgccggcaacgctgccaaggacaacaagaagacgcgcatcgtcccgcgccacgtgctgctggcgatccgcaacgacgaggagctcgggaagctgctggccggcgtgaccatcgcccacggcggcgtgttacccaacatcaaccctgtcctcctgcccaagaagacggcggagaaggcgtccagcggcggcagcaaggaggccaagtcccccaggaaggccgctaagtcccccaagaaggcatagggtttggaggcggatccgatgttatcatgtgtaggttgtaagcggggtcaatgtgcttggctgtgcaccttctttgttcaagttgttttctgtcatttataatggaacaggaaatgccgtgtttctt

SEQ ID NO: 1181 - DNA, 2629 bp, Zea mays
  Clone ID: PAT_MRT4577_147427C.1
aaaaatacttgtagttccgtgattttttttcaactattatagttattgtcaatgtcacgatctgtttgaatagatttacaacaaatattaactctgaccaattggtccaaaattcctaatgttttattgtcaaacaaatggtctattgttaacgccatccctagttccctatctactcgagcaatattttgatagttcatgtcaaaaaaacctagaagaattttgaaatgtaatctattgtcaggtacatctgaactaggtcctctgagcttcctgatttcatgtttcatacttgcattgcacctgaatttagcaattatgcatcaggcactcatcctattgatgttagcgaatgtagaaaactgcaatgtgtctgtgtggagcattctccagtttgtgtatagcattgaagtatgcttgtaatgttgacaattttggcggaccttttcctaaagcagtagtgtgtatgggcttgctttggcctgccagagcctgactgccaataccaacataacgaagagtcatccatcagagatgaatcaaagagccaagactgatttctctgatagatcattctcttcaagcatggacatattgtcccctttcatggtgggcagcagaagccttcagttcttatgaaatagtaacaataatctagtacttcacaagggctggtattacagtatagcagtccgataagcaatggaaaagccagttcagaagtagggtatctggcaaattcacgaggagttcagccttaatttccttttcagcaaatgatagggaattccgatgtgtctcagaagtcattgcttctgtcatgagcctaaataccttcttgttcatgtttgttttcatgaatatcatcttgccagatggatatatccgactgataccaagatctgcagccatccgccttacatagagctttttcagtagtaactccatatcacggggctcctttccgtatcgtcgacggaggtcttctgtaaactgtatcaaggtccatagatctttctctgcagcttttgccgcttcattgagcaactcaacaggattttccagataacttatgtattcagaagagagacgtggagaaatgtttatatccagctgaacatctttgtatggtactgggactaggcaaaactggtcaacctttgacaagctatcaaaaagcatatcaaagaataaatcgatgccaacatttgcaacatctccagactgttgctcaccaaacaagcttccaaatcccctgatacccatatccttctctgcaacatggaaaccttggccaagctctgaatgctcctcaatagctccgagtcgttgcaactcttgagagcaaagacttatcagtgtagaaaaggtatgcgaagccttctgtacctgatcttcctactcttcctcgtaactgatacagctgggcaagtccatatagttcagcaaactggataatcattgtattggcatgtgcaatatctattccactttcaatgatatgtgtgcagacaagaatttcccacgcgtccgcccacgcgtccgcccacgcgtccgcccacgcgtccgcccacgcgtccggcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaatggaataggaaatgccgtgtttcttacgcctgcttttggttctgcattctactgaaaaagcgtacgataattaacacattcacctttgaagaatcacgattgaaaagtacattaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccccttttaaaagaatcaaattttacttcccctttcttgcaaaggtaaaagcttttttttttggggcccctaaaataaaattaattggcccggggttttaaaaacgtcggggacctggaaaaaaccttggcgtttccccaaattaaatgcgctttggaaaaaatatccc

SEQ ID NO: 1182 - DNA, 1611 bp, Zea mays
  Clone ID: PAT_MRT4577_147438C.1
gggtccttcctccttcctctcgctcgctcgctccccccccttcccccgctccctctcctcctcctcccttcattcctacctccgctcgcgccactctcctccgaccgaggggcagggaacggtgcccacccgcccgcccgtccgaccgccatggtctcctggcggcgcagcgcgtcctggctgtcgtcggcgtcgcgctcctcgctcggcaccgccgtcggcggggaggccaaggtcacgccggaggcggatccggcggcgcagcacgacgaggccgacgaggagcgctggtcgcgcctgctgccggagctgctcacggagatcatgcgccgcgtcgacgccggcgccgagcgctggccgccgcgccgggacgtcgtggtctgcgcctgcgtgtgccgccggtggcgcgacgccgcggtctcggtcgtccgcccgccgctcgagtgcggcaggatcaccttcccgtcgtcgctcaagcagcctggaccaagggatgcgccgatgcactgttttatccggagggacaaaaaaaattcaaccttttctctctatctcagcttaacgcaggccctaacggataaagggaagtttcttttggctgctcgaaggttcagacaaggagcacatacagaatatatcatctcttatgactatgatgatctgcacccaagaagcagttcatatgttggaaagttgagatctgacttcttggggacaaagttcatcatctatgatagccaggcgccatatgacggtgccaaaccttcgaggacccgatccactcgccgctttgcaagcaagcagataagcccacaggtttcaggcggcaatttcgaagttggacaagtgacctacaggttcaacttcatgaaatcaagagggccgagacggatgcagtgcaatatccagtgccctgtaggccagggcagcgcttcggatccgtccaaggagaaaacaccctcgccgagttccttggacctgaagaacaaggctccaagatggcacgaccatcttcagtgttggtgcttaaatttccacggccgggtgaccgtcgcctccgtgaagaacttccagctcgtcgccacagctggctccggcggtccatggggcgtcggagacgaggagacggtgatcctgcagttcgggaagatcgaggacgatgcgtttacgatggactaccggcagcctctgtccgccttccaggcgttcgccatctgcctgaccagctttggcacgaagctggcctgtgaataaatggttgccggtttaccaactatgttggggatcagattgtagggggtagtctgaactagttgccctgagcacctcagatgggagaaaactggcgataagaaacagggcggacgttgtccctataagctttgactccttgtaatcgcctaaatgattgatttatatatatatgatgtgcgcctatgttgttgaagagatgacgatgacttatcgttgtaaatggcactccacttcgtttggtgacatccaataataatgtgctcatgaacttccacataaaaaaaataaaaaaaaaaaaaaaaaaaaaacctcaaaaaaaaaaaaaaaaaggggcgggccggttttagaaggaatcca

SEQ ID NO: 1183 - DNA, 1721 bp, Zea mays
  Clone ID: PAT_MRT4577_147484C.1
cttttctcgtgggcggacgcgtgggcggacgcccccttccggtcttctcttctccactaccacccgcccgcccgccttctcctccaccactgccccgtcgtggaataggggcaagttcaggcatctcgcttctgtcctggtcgaggggatcggagaaaaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcgcgcctcggcaaccgctgggccgccatcgcgcgcctcctccccggccgcaccgacaacgccgtcaagaaccactggaactgctccctcaagcgcaagctcgccgccgcgtccgccccggcgggttcctccgacgtcgacgcgcgcccgaccaagcgcgtcagcctctcgcccgacagcccgtcggggtcggggtcagggtccgggtccgggtccgggtccgaccgtagcgacctgagccacggcgccggccaggtttaccgccccgtggcgcggtccggtgggttcgagccggcggactgcgcgatgagccgtccgctggaggaagaggaggaggaaaaggaggacccgctcacctccctcagcctctcgcttcccggcacggaccagcggttccaccacgaccgcgcccacagccagttccaggagctcccggcgtcgccgccctcgccctccccgcctccgccgccggcgggtccgacctcggcgtacccgttcagccccgtgttcatggaggcgatgcaggagctgatccgcacggaggtgcagcggtacatggcgagcgtgggcgtgcgcgccgggtgcggcgccgccggcggggccgacctctgcatgccgcagctcgtcgacggcgtcatgcgcgccgccgccgagcgggtcggccggatgcagtagctcctgggcgtgcatgagccatcaaatactctcccaaaccgtcaatcgatcttctaggacgaacgcgcagcagctgttcttatcagtagcaaacttccaagttattattttcctttttttaaaactttattctctcgaaccgctgtgaaaccgaaacagcagtgaaaagagtcagcaactgaaaaaaaaaaatatgtgggaactgaaaggtggagaaaaatgtagtaaaggcttgctgaaagccgtgtaaagcgctgcctgcctcctctctctctctctctctctacaggaatgaatcggatcggaacggaatgaaacgagaagagggggacgacgcacattctggtttcgtcgtcacacggccgtagaaacccggaaacggaccaaatcagatctgatcagtgcgaagcattgtgttaattaagatcccgtccgtcctgtgtagcagcgctacgtagactactactactactagtcgttctctggccgttgtatttagcagaggagctcgcgtttgtttattcttcggcggctgtcgctctgaatccagaaaggaacagagcggcggtgtaaagccgggagcggaagcggaggttggcaataatcgagatcgagcctgccattttaaaaaaaaaaaaaaaaaaggggcggcc

SEQ ID NO: 1184 - DNA, 344 bp, Zea mays
  Clone ID: PAT_MRT4577_147564C.1
tacaataccctaaagtgagtcgtattacctgcgccgccgcgggttagcgccgtcgccgatcgggggctcccgcttccccctgagggcggcgcgcgcccggagattgaccgcggtgctggcggttgcgccagtcagaggaatgtcccatcgtcatctggatctagtaggagtgtcgtgcgctccgagagcaggcatggtcatgatctcgcaccgggttcattcggttctccgtctcggtcacccggggacaaatgacgtcactggctggcaagaggtgcgttctgctgctgatcgagtcgaccgtctcgacgatatcagatcacacaacggtgcaccaggcttgt

SEQ ID NO: 1185 - DNA, 343 bp, Zea mays
  Clone ID: PAT_MRT4577_147568C.1
atctacctgctcctacgcctacttctggatccaggcaagccagggatcgctatgttggacttgtaggagcacgacttagaatcgaaagccgacgccggagcgtccaagacctacgctcatcacgctggtactgtccgtaagaacggtttcatcggcatcaagaaccggccctgaaaggttgtggtggttcctacatcagagactgttcaccatggacatgccaaatgccactttgctgccatagacatattcaacgggaaaaagctcgaagatattgctcattagtcacacaactgtgatattacctatgtgaaccgtactgagtaccagctgattgatctat

SEQ ID NO: 1186 - DNA, 301 bp, Zea mays
  Clone ID: PAT_MRT4577_147672C.1
ggaaaaaaaccttggtcattcttctttcggctcgtttaatagcgggggcaaacaggggggggggcgggggtccccacccctaatccaaggggggaacgggccctaacccggggaccgaagcgaacgggaccccgatcctttagatgggtaagataactcggcccaagccagggggggcccacacataagtccctccagccgccgccgccgccgccgtagccgccaccaccaccctggggccgaccggcgtagccgccaccggctccgtagccgccggcaccacccttgggccaaccgggcc

SEQ ID NO: 1187 - DNA, 2546 bp, Zea mays
  Clone ID: PAT_MRT4577_147684C.1
ctgtgcggggctcctgccggccgggccgggaccgctccttcccgttcatccatcacaccatccccactctctcctctccacccggcgagcggacacccccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagggcaaccgaaaacccctcgatccggctctcctcgcgctgtagcttttataacgccgtagacgacaacgaaagagaacggaaagaaataaaacccaccacacctaccgtcgtccgtaaaggaaggaaggactcgagatggacaccgtcggcgtccccgtggtggccgttgcgaatgggatcggggaggtggagcgcaaggtgcagaagagctactgggaggagcactccaagtgcctcactgtcgagtccatgatgctcgactcccgcgccgccgacctcgacaaggaagagcgacccgagatcctgtctttgcttccctcttacaaagggaaatcagttctagaacttggtgctggaataggacgctttactggagatctggcaaaagaagctgggcacgttctggcactagacttcattgaaagtgtgattaagaagaaccaaagcataaatgggcatcacaagaacataaccttcaggtgtgccgatgtgacatctaacgacttgaagattgaagataactctgttgatctgatattttcaaactggctattaatgtatctttcagatgaggaggtccaaaagcttgtggggaaaatggtaaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacaagtgggatattacgttatgagcgtgtctttggtgaaggttttgtgagcactggtggaatcgagactacaaaggaatttgtgggcatgctcgatcttaaaccgggccagaaagtacttgatgtcggatgtggaattggaggcggcgacttttacatggctgcaaactatgatgtccatgttcttggtattgatctttcggtgaacatggtttcatttgcaattgaacgtgccattggacgcaagtgctctgttgaatttgaagttgctgattgcaccacaaaggattacccagaaaatagttttgacgtcatctacagccgtgacaccatccttcacatacaagacaagcctgctctgttcagaagcttcttcaaatggctaaagcccggcggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagataggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcaggagggctcttcggaataagaatggatgtggctgtaactctgcttctagaccggtgatggttcagcttagaagcaggggatcttcatcatcagaataaaaacgtgtgttgttgtgttgctgtgtctacgccactagtatttctgttgttacttatgttctaggtaaactgcgcagccagagcagagctgaagaatatgtactgcttgctcgctcttgtgtggttgtgtctaccctactagcatttcagctttgttgtaggtaaactgcgaacccagagttgcagaacccgtactgctcgtttaagttcatggtgaactacgagctaaaaggctgttgccagagtcgatgtcacttgtcactggaggtccccggttcaattcagatgttgctttggcaaaaaaaaaaaaaaaaaaaaaaaaaaaaaaaaaaaaaaataaaaaaaaaaaaaaaaataaaaaaaaaaaaaaaaaaataagaaaaaaaaaaaaaagggggccccccccttttggcacttgtcccccggggtctcccggttcagttcagatgttgctttggcacgtgtttccttttcccccggaggtcagctctcgtggagaaaa

SEQ ID NO: 1188 - DNA, 626 bp, Zea mays
  UNSURE (1)..(626): unsure at all n locations
  Clone ID: PAT_MRT4577_147695C.1
  unsure (1)..(626): unsure at all n locations
cggccgcgtgggcgcccatgcacgcacccgccgcctacgtgcgcctccctacttgcccctgccggcctgccctgttcatgtacccaccacaatcttacacctaggaggacgctacgagctcaagctctgggctgtggcgagcggcgagcattgagtcgaggggcanccganaagatggcaatgacgcggccgttcttggcgccgctgatgatagtagcggctgttcttctttcacgcatggcggcggcggcagcggacgacggcgacgtgctgctgcaggtgaagagcgcgttcgtcgacgatccccaggggtcttagcgggctggaacgacagtgctggctccggcgccggctcgtcggggttctgttcctggtccggcgtggcgtgcgacgcgtcggggctcagggtcgtgggcctcaacctgtccggcgccgggctggccgggacggtgtcccgcgcgctggcgcggctcgacgcgctggaagcgatcgacctgtcgtcgaacgcgctcacgggccccgtcccggcggcgctcggtgggctacccaacctccagttactgctgctctactccaaccagctcacgggccagattccggcgtcgctgggggcgctctcggcgctc

SEQ ID NO: 1189 - DNA, 660 bp, Zea mays
  UNSURE (1)..(660): unsure at all n locations
  Clone ID: PAT_MRT4577_148063C.1
  unsure (1)..(660): unsure at all n locations
gtacgcccgcagtatcggtccggaatcccgggtcgaccacgcgtccggtggtattggtatgacacagtcagaatcttgtgaacaacctgggtaccattgccaggtcagggactaaggagtttatggaggcactggctgctggtgctgatgtgtccatgattggtcagttcggtgttggattctactctgcctaccttgttgccgagagaagtagttgtgaccaccaagcacaacgatgacgagcagtatgtgtgggagtctcaggctggtgggtccttcactgtcacacgtgacacatctggggagcagcttgggaggggtactaagatcaccctctacctcaaggatgatcagttggaataccttgaagagcgccgcctcaaggacctgatcaagaagcactctgagtttatcagctaccctatctctctatggactgagaagaccactgagaaggaaatttctgatgatgaagatgaggaagagaagaaggatgctgaggagggcaaggttgangatgttgatgaagagaaggaagaaaaggagaagaaaaagaagaagataagggaggtttctcatgaagtggtccctggtcaacaaacagaagcctatctggatgaggaagcctgaggagatcactaagggaggagtatgctgctt

SEQ ID NO: 1190 - DNA, 1890 bp, Zea mays
  Clone ID: PAT_MRT4577_148084C.1
acatgcatagtaaagttagcgtgggtgtcgatggattacttggctgctgctgtacccgtgaccttggctctgggagtgggagctatcttgttggtcttacgatggacgtactgccgccgccgaacaagcgccgaagaagcaagactgcccccggggtcaaggggcctcctgttcctgggggagacgctccactacctggcagcgtcctccaccccgggggtattgccaccattcttccagcgacggttggagaggtatggccccatcttccggacgaacctggtcggggaggatctcgtcgtgtcgctggacgcggagctgaacgcgcacgtgctgaagcaggaggagcgcggcttccagatctggtacccgccctccttcatgcgcgtcttcggcgccgacaacatcaccgccaagctcggcgtgctccaccactacatgaggaccctcgtgctccgcctcttcggccaccagaccgtccgctccgtgctgctgcacgacgtgcagcggagcgcgcgcgacgagctgcgctcatggctcggccgcccggacgtcgaggtcaggacggccacctccaggatgatatttggcgtcactgccaagaagctgatcagccatgacgacgcagcatctggagaaacgttgtggagatgcttccacgactggacttcggggctgctctcgtttccggtttccattcccggcacaaccttctacagatgcatgcagggacgtaagaaggttatgacgatgctgaaacagcagctcgtcgagcgtcgacggaacgcagcggagcgcgagacgacagaggatttcttcgatctcgtgatcgatgaactgaacaagccagaccctatgatggacgagagcaccgcgttggacttgctgttcaccatgttgtttgcgagccatgagacgacgtccatggtattaaccgtcatactcaagtatctgactgacaacccaaaagctttgcaagagctgacagaggagcacgaaagaatcctggaaagtagggccgatccaggctctgacctcacgtgggaggagtacaggtctatgaaattcacatctcatgttatacatgagtcgctaaggctcgcaaacatcgcactggccatgttcaggaaagcaaatcaggatgtgcacataaatgggtacacaattccaaaaggatcaaagatcatgatgtgtgcactagcatcgcacttgaatacggaggtctacgaggacccctcagtgttcaatccatggagatggaaggatattcctgaaccagtcggcacctctaaggactttatggccttcgggggtggtttgcgcctatgcgctggtgccgagttttccaagatgcagatggctatgttcctccattacttggtcacaaattacagctggaaacccgtcagcggtgggacaatgttattctatccaggactgcaatttccagaaggcttccacatccagcttcttccaaaaatcccaaacgtggttccataaaccctatgaagaaatatgaatacgaataatttaagcaaatattctaaatgtaccctggggaattgaagttcgataacgatgtggtacgggctgatttggtaaccatggatcacaggaggatgggagaggattgatggagaaattagttcatttctccctcaacctctttcaatcctcttatgatccacttatcaccaaatcaaccctaatgatagcaggtcgaattgtcggaacaaataatagtttcaccaaacagaaggggagtatgcatgtgtgtaactttttatagttataaataatagtagagtaaattcagctcgttgtgtaacaactatgcaggtgagtaaaaattggttcagcatattgtatatattatgcccagttcaatgg

SEQ ID NO: 1191 - DNA, 2070 bp, Zea mays
  Clone ID: PAT_MRT4577_148098C.1
aaattacaaaaaaaaaaaaaaaaacggtcagtcttttgctgtgctggctgtggcacttctttgatgatacgagtactagcaaataatgaagagctctggtagtggcaacttccgtttcagcccgccgcgcgtaggccgctggttggccaggggacaccacgccttccattattagagtaccactactccattagtaccagtgtaccacccccacaaaccaccaccaccaccaccgaaaacgaatcccagaacagtaccgcagcggcagccatggtgctctcgcacgcgagctccggccgggacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagacagctattggggtgggaacagtgggatcctcggaagcgatcatgcttgcaggtctagcgttcaagaggaaatggcagaacaagaggaaggagcaggggaaaccgtgtgacagacccaacatcgtcaccggtgccaacgttcaggtctgctgggagaagttcgcaaggtattttgaggtggagctgaaggaggttaagctatcagaagggtactacgtcatggaccccgtcaaggctgttgagatggtggatgagaacactatctgtgtcgcggcgatcttggggtcgactctcaccggagagttcgaagatgtcaagcagttgaacgaccttcttacagacaagaacaaggaaactgggtgggacgtgcctatccacgtcgacgccgcgagcggagggttcatagcgccattcctctaccctgagctcgagtgggacttcaggctgcctctggtgaagagcatcaatgtcagcgggcacaagtacggcctcgtctaccctggcgttggctgggtcatctggcggagcaaggaggatctgcctgaggagctcatcttccatatcaactacctggggacggaccagcctacgttcacgctcaacttctccaaaggttccagtcagatcattgcgcagtactatcaactcattcgcctaggcttcgaggggtacagaaacatcatgcagaactgccaggacaacgccgcgatactgcgggagggcatcgcggcgacgggccggttcggcgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgccaccgccgagcagtcgggcgacggcgtcgtggccaagaaaagcgtgctggagatcgagcgggaggtcgccgcgcgctggatgaacgccgtgaacaagaagaagacgggggtctgttgatgcgtcgtgggtcggagactgggaggtttctcgccatggtagcttcgtctatatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggtttggtgccgtatgttgggtgtggagtatatttcttcgccaggtatttgctgtaatcctgtccctttacgttcgtgcactgcaatgagaataaaaaaaaataagtgtcgttcacggaac

SEQ ID NO: 1192 - DNA, 2634 bp, Zea mays
  Clone ID: PAT_MRT4577_148101C.1
ccacccccacaaaccaccaccaccaccaccgaaaacgaatcccagaacagtaccgcagcggcagccatggtgctctcgcacgcgagctccggccgggacgacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccaggtagtatgttagcaccacagaaggtagaagaaaggagatcagagattagagctaggaagacggaaggaagacgagagctagacggggtctaagtaaattggtattttgtatttcgttgtttgatgccttttacagctgactcagcctatatttatatctcctcaagcccacataacccatagctcatctactacacctaatatatctaacatagtactacaactaataaatctcttataagcttgactagatctataaaaaaaatagcattggtgtttatacatctttactataaaattacattattctatagttaattcaattattgcataataaatattagtaatcttgttatatatttgatcgaacttttattgtgaatcacagagaataagttttctattctacttgggaaaaccatatatgagcaatgccaaaagttctcgagtttttcgaccggaaaatcctgaatatacctgataaacaatgaacatatatggacgacctgaagagaaaaaaaaaagttcgattgttttgtgtttcccagttcagactaataagttacagtaacagatggtttgtagagatgtttaacttgtctctgccaaacaataactacgacctgtttatacactcctgttatgttacttgccactgtgcatttgcttactgcctgccctctattcctgcagaaccgctgcgtaaacatgatagctcacctgttcaacgcgccgatcaaggaggacgagacagctattggggtcggaacagtgggatcctcggaagcgatcatgcttgcaggtctggcgttcaagaggaaatggcagaacaagaggaaggagcaggggaaaccgtgtgacagacccaacatcgtcaccggtgccaacgttcaggtctgctgggagaagtttgcaaggtattttgaggtggagctgaaggaggttaagctatcagaagggtactacgtcatggaccccgtcaaggctgttgagatggtggacgagaacactatctgtgtcgcggcgatcttggggtcgactctcaccggagagttcgaggatgtcaagcagttgaacgaccttcttacagagaagaacaaggaaactgggtgggacgtgcctatccacgtcgacgccgcgagcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcatcttccatatcaactacctggggacggaccagcctacgttcacgctcaacttctccaaaggttcctgtcagatcattgcgcagtactatcaactcattcgcctaggcttcgaggggtacagaaacatcatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgccaccgccgagcagtcgggcgacagcgtcgtggccaagaaaagcgtgctggagatcgagcgggaggtcgccgcgcgctggaggaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggtttggtgccgtatgttgggtgtggagtatatttcttcgccaggtatttgctgtaatcctgtccctttacgttcgtgcactgcaatgagaataaaaaaaaaataagtgtcgttcacggaaaaaaaaaaaaaaaaaaaaaaaaaaaaaaaaaaaaaaaaaaaaaaaaaaaaaaaaaaaaaaaaaaaaaaaaaaaaaga

SEQ ID NO: 1193 - DNA, 1722 bp, Zea mays
  Clone ID: PAT_MRT4577_148134C.1
gggacctcgagccggccggaaaaaaaaaaaaaaaaaaaaaaattggctagggacatgtaaaaccttgtacaccactagtccattacctagcaagcagcagcctgatccaacaagtgcagtgtgtgcacggtacgtgatctcaagccgccaaagttaacaatggcagaacagcacaaaggcccaacaaacagggtagcctccgatggcctcccggacggtgttgcgccgccgcggaagaagagcaacgtccggttcgccttcgcctgcgctatcttggcatccatgacctccatcctcctcggctacgacatcggggtgatgagcggcgcggcgctgttcatcaaggaggacctcaagatctcagacgtggaggtggaggtcctgcttggcatcctcaacctctactcgctgatcggctccttcgcggcagggcgcacctccgactggatcggacgccggctcaccatcatccttgcggccgtcatcttcttcgtcggggccttcatgatgggcttctcggtcaactaccccatgctcatggccggcaggttcgtcgcgggcatcggcgtgggctacgcgctcatgatcgcgcccgtgtacacggccgaggtgtcccccgcgtcggcccgcggcttcctgacgtcgttcccggaggtgttcatcaacttcggcatcctcctaggctacgtgtccaactacgccttctcccgcctcccgctccgcctgggctggcgcgtgatgctcggcatcggcgcggccccgtccgtggtgctcgccctcatggtgctcggcatgcccgagtcgccccggtggctcgtcatgaagggccgcctggcggacgccaaggtggtgctggggaagacctccgacacgccggaggaggccgcggagaggctcgctgacatcaaggccgccgccggcatcccgcaggagctcgacggcgacgtggtggccgtgccaaagaagcgggacagcgaggaggcgcgggtgtggaaggagctcatcctgtccccgaccccggccatgcgtcgcatcctcctctcgggcatcggcatccacttcttccagcaggcgtccggcatcgacgccgtggtgctgtacagcccgcgcgtgttcaaggccgccggcatcaccagcgacaaccagctcctgggaacgacctgcgcggtgggcgtcaccaagacgctcttcatcctggtggccacgttcctgctcgatagagtcggccgccggcctctcctgctggcgagcaccgggggcatggtcgtcagcctcgtcggcctcgggttcggcctcaccgtcatcggccaccaccaagagggcaccaccatcccctgggccatcggcgtctgcatcgcctccatcctcggggtggtggccttcttctccatcgggctcggccccatcacgtgggtgtacagctccgagatcttcccgcttcacctgcgcgcgctcgggtgcgctctcggcgtaggcttgaaccgcgtcaccagcggggtcatctccatgaccttcctgtcgctgtccaagggcatcactatcgggggcagcttcttcctctacgcgggcatcgcctcgctcgcctgggtcttcttcttcacctacctccccgagacacgcggccgcacgctcgagcagatgggcgggctcttcggcatccccaacatggccggcgacagcgaccagctgaccagcagtcgcccgagaaggagaagaccttga

SEQ ID NO: 1194 - DNA, 2698 bp, Zea mays
  Clone ID: PAT_MRT4577_148316C.1
ggcgagggagctcaccaggagagaggggcctgtgtgagcattgagcaaagcaaacgaagcagtacatacatctctcgtgggaccctgcaggccggccggctccatgcaacaagggaggacgacgagcggtggcggtgggcgatgatgatgatgatgatggcgggggagcacgtgctggccgctctgggcaccctgctgctggcctcgctcctgaccctggtgctgaaccacttcctgcccttgcttctgaaccccaaggcccccaggggaagcttcgggtggccgctcctcggcgagacgctcaggttcctcacgccgcacgcctccaacacgctgggcggcttcctcgaggatcactgctccaggtatgggcgggtgttcaagtcccacctgttctgcaccccgacggtggtgtcctgcgaccaggacctcaaccacttcatcctgcagaacgaggagcggctgttccagtgcagctacccgaggccgatccatggcatcctgggcaagtcctccatgctcgtcgtcctgggcgaggaccacaagcgcctcaggaacctcgccctcgccctcgtcacctccaccaagctcaagcccagctacctaggcgacatcgagaagatcgcgctgcacgtcgtcggcgcatggcgacggcacggcggcgtcagggtcgtcgcattctgcgaggaggcaagaaagttcgcattcagtgtgatagtgaagcaggtgctggggctgtcgccagaggagccggtcactgcaaggatactcgaggacttcctggccttcatgaagggcctcatctccttccccctctacatcccagggaccccatatgccaaggctgtccgggcgagagagaggatatccagcactgtgaagggcatcatcaaggagcggaggagcgctgggtcatggaacaagcagggcgacttccttgacgtgctgctgtcaagcaacgagctatctgacgaggagaaagtgagctttgtgctggactccctgctgggagggtatgagaccacctcgctcctcatctccatggtcgtttatttccttggccagtctgctcaagatctggacctggttaagagggagcacgacagcataagatccaacaaaggcaaggaggagtgcttgacttcagaagactacaagaagatggaatatacccaacaagtcatcaacgaggcgctgagatgcggcaacatcgtcaagttcgtccaccggaaggcgctgaaagacgtcaaatacaaagagtatctgattccatctggctggaaggtcctaccggtcttcactgccgttcatctgaacccctcacttcatggagacgcgcagcagtttcagccctgtaggtgggagggcacaagccaagggacaagcaagaggtttacaccgttcggtggtggcccccggctctgcccaggatcagagctcgctaaagtggagactgctttcttcctccatcaccttgtcctcaattatagatggagaattgatggcgatgacattccaatggcatacccgtatgtggagtttcagagaggtctgccaatagaaatcgagccaacgtcccctgaatcttgactgtcctggagctacagccatcagttatcacaccagagagaaaaggggaaggtgcatggagtatacatgaatggtcagtgacagatctcacaagtgaaggaacactgagggcgcgtgctagtagctagcatatgaggcagctgagactgtaatttaatgtacatggtgtagatatattttgtccatggcaattgcttgaagtggctgattcacttcaccctgtaaaacattctccagtggtttcaactgctatcctataaaaaagaagggcccctgtgtttagtaaaaaaaaaaaaaaaaaaagcagctcatatagtttcgccaagatatacgcagtgaagcagacaaacaaatttttttttttttttccaaaaaaaatattcatcatagaatcagttgaacctgtagtctacactctaaaccaagcgacaggagtttgcacacacgtacggtccacggaggagctaccacacacacgtacaaatcaacacgcacgctggcaccgatcccgaccgaggcaggcaggagcagggcacggccggtggctcggtcagttggtacctgttgtgttgcagtcgaagcaggtgtggttgcggccgatctccgtgatcctgtcgtagccgtgcctgaagacgccgaggccgaagaggacgccgacgaggaggacgatgaccaggatcaccagcaggtagcaccccacccactccttggtgcacctgagcttgcacatggctctctcccccggccctggctgccgcctctctccctctccctctccctctccgggaccgggaggagggggttcttatcggaggagggaaatatgctaggcgagtgcctgtcgctcgcccggtcgcccctgtcccttcggcggtatggcgacggtatcgggcagagctgtgctgtgctgtgtgttgggctgttagtgatgatgatgtgccttttgcctttgtgccatgccaagaatctgatcgccgcggactgcgtggactaatgccacgaacacatacatatatggctatctttttctcccgccgtacgaatcatcggcgtgtaaagctgtataatagtgtggccgggagatggcacaggcgactgagagagggac

SEQ ID NO: 1195 - DNA, 804 bp, Zea mays
  Clone ID: PAT_MRT4577_148470C.1
ttgggtacctcgaggccggccgggacggcctcacccgtccacccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggctgtagcgtcggttggacgtcgtgagcgtgcagagcaattaagcaaagcagggcttggcggagtttgtaccgtcatttgttaaaccatcttttggaaatggtacagttctagataagtcagatttcaggggttcttctggaaaaacaattctagataggcctgagccatcaaagtctaataactcagatgatgaggcacaccagttttggcataagcagcttccggatgacattattccagacttcacttcttttgagaaagttgaacaagggcctgaactgtcccttgctggattatccttgaatgcaccccccttttatgggacaacttccagtcgcttctcaagagaatatcacgaattatcttctccagttaccaagggcctggaactggaactagaacatactaatatgctatatgaagataaaagcaactgggagcaaaattatattggtgatcttcatattgctaatggaaaccaga

SEQ ID NO: 1196 - DNA, 848 bp, Zea mays
  UNSURE (1)..(848): unsure at all n locations
  Clone ID: PAT_MRT4577_148473C.1
  unsure (1)..(848): unsure at all n locations
cgattgggtacctcgaggccggccgggaccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaagcaagtatgtactcagaatcaaggggagaggctcgtgattttgctagggtccggaatacctgctttgagcaggctagacaggcttacttggttggcaacaaggctcttgcgaaggagctcagcatgaaggggcaggcctacaatgtgcaaatgaaagcggctcatgagaaagctagagaagctatttaccgacaaaggaatcctgtttcttcccaacgtgggggtggtgaccacctgattgatttacatggcctgcatgtgaacgaagcaatccacatcctgaagggtgagctcaccgccttgaagagcgcggcgagggcagcaggggagaggatgcaagtcatggtttgcgttggaacaggccaccacaccaagggctctcgcactgcgaggttgcccatncgctgtggagcagttcctgctggatgaaggcctccagtacacgcagcctcaggcgggtctgctccgagtgatggtgtactaacatctcttaggtgagacatcacggntgaggaaaaaaactccaaaaaaaaaaaaaaaaagcggcc

SEQ ID NO: 1197 - DNA, 826 bp, Zea mays
  UNSURE (1)..(826): unsure at all n locations
  Clone ID: PAT_MRT4577_148474C.1
  unsure (1)..(826): unsure at all n locations
attgggtacctcgaggccggccgggacggcctctcccgtccacccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggctgtagcgtcggttggacgtcgtgagcgtgcagagcaattaagcaaagcagggcttggcaagtatgtactcagaatcaaggggagaggctcgtgattttgctagggtccggaatacctgctttgagcaggctagacaggcttacttggttggcaacaaggctcttgcgaaggagctcagcatgaaggggcaggcctacaatgtgcaaatgaaagcggctcatgagaaagctagagaagctatttaccgacaaaggaatcctgtttcttccncaacgtgngggtggtgaccacctgattgatttacatggcctgcatgtgaacgaagcaatccacatcctgaagggtgagctcaccgccttgaagagcgcggcgagggcagcaggggagaggatgcaagtcatggtttgcgttggaacaggccaccacaccaagggctctcgcactgcgaggttgcccatcgnctgtggagcagttcctgctggatgaaggcctccagtacacgca

SEQ ID NO: 1198 - DNA, 955 bp, Zea mays
  Clone ID: PAT_MRT4577_148475C.1
cattgggtacctcgaggcgtcgggcataattatcatattgcccttacctgacctcgccttcacctcagctgacggcctcacccgtgcccccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggctgtagcgtcggttggacgtcgtgagcgtgcagagcaattaagcaaagcagggcttgggtaaatcattattgaaagcatctcccttttacatgtaaccttgcatacaatatctgttaagatgagttcactaaataaagttgtttcaaatagtggagatgcatgttcagtcttagctagtaaagtcacatcattaaatcccaatgcagcggagtttgtaccgtcatttgttaaaccatcttttggaaatggtacagttctagataagtcagatttcaggggttcttctggaaaaacaattctagataggcctgagccatcaaagtctaataactcagatgatgaggcacaccagttttggcataagcagcttccggatgacattattccagacttcacttcttttgagaaagttgaacaagggcctgaactgtcccttgctggattatccttgaatgcaccccccttttatgggacaacttccagtcgcttctcaagagatatcacgaattatcttctccagttaccaagggccttactggaactggaacatactaatatgctatatgaagataaagcactggagcaaa

SEQ ID NO: 1199 - DNA, 626 bp, Zea mays
  Clone ID: PAT_MRT4577_148478C.1
cagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggctgtagcgtcggttggacgtcgtgagcgtgcagagcaattaagcaaagcaggtgcactctttgctcaacttttttattgctattttggctgcgctcaagtgtaattattagtatgattgtggctggagttgcaagcaattgatgggtttgaagccttgagggcttcagtttgagaacggctactagggcagcatctcaagtttatccgttgctggctcatttgataacagcattaattcgttattttgttgcctattgtctgcttcgattgctgtttatgtatgtatacacaacaatgtttagttgaccagaaaaaaaaactacacggcgttcgctttagctaaagcacagctgcaaccgctgcagctatggct

SEQ ID NO: 1200 - DNA, 4590 bp, Zea mays
  Clone ID: PAT_MRT4577_148479C.1
aattcggcacgaggcgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggtattggtttcctgtttccctgtttcttctctagatagatctggtgaattccacgaagatctggtccgaatcgggtacactgggtcggtcggttggtaattcctgttccgtgtgtggagttaaaaaacagctcttcttttttcacgccgctgtaggctgtagcgtcggttggacgtcgtgagcgtgcagagcaattaagcaaagcaggtgcactctttgctcaacttttttattgctattttggctgcgctcaagtgtaattattagtatgattgtggctggagttgcaagcaattgatgggtttgaagccttgagggcttcagtttgagaacggctactagggcagcatctcaagtttatccgttgctggctcatttgataacagcattaattcgttattttgttgcctattgtctgcttcgattgctgtttatgtatgtatacacaacaatgtttagttgaccagaaaaaaaaacatacacggcgttcgctttagctaaagcacagctgcaaccgctgcagctatggctggaaactactcagtgaagcactgttgaatggctgcagcagtcgtctgtttaagctcagctgaacagcttatagttgtgaaattggagggtgcaaacgaacaccatgttgcaaagaaaacacttcctttatgatgcagtaccctgctgcatcttcttttagtaaaggacgcatgcatatgagtgacaggaaacatctgctttttgtttctgtttgaacatgctatcggttttgggaaagaaagctacaattcttgggtcttgatttcaaccatactattgaaatcctcacccagccagagatgcaagatgatgctacacacaatcacacactgaatctgccccacagcacaccgaacttcagcactggggatttccctgcacttccaacagctgaggaccaaaatggtttcaatcagggtaatgtggatgtacttggcatgttcaatgggcgcagttcatctgcgatgcctactggagctggtgattttgtttcagccgttcgcaaacttgcatcgcagaactctggccagtggaagtttaaaaaaggtcctgagtatggtaatggcatttcagctctttctgtacccaagcagtacagttctagcactaaacaatcgtctgggaacaagtttcaaagcatcagcagtggaagagttgccccatggcttgagactggtgatgcagtggcaagtatgtactcagaatcaaggggagaggctcgtgattttgctagggtccggaatacctgctttgagcaggctagacaggcttacttggttggcaacaaggctcttgcgaaggagctcagcatgaaggggcaggcctacaatgtgcaaatgaaagcggctcatgagaaagctagagaagctatttaccgacaaaggaatcctgtttcttcccaacgtgggggtggtgaccacctgattgatttacatggcctgcatgtgaacgaagcaatccacatcctgaagggtgagctcaccgccttgaagagcgcggcgagggcagcaggggagaggatgcaagtcatggtttgcgttggaacaggccaccacaccaagggctctcgcactgcgaggttgcccatcgctgtggagcagttcctgctggatgaaggcctccagtacacgcagcctcaggcgggtctgctccgagtgatggtgtactaacatctcttaggtgagacatcacggtgaggaaaaaaactccaaaaaaagagaaaagagatgtacgaaaacgcaggaaaaaaaagcgtcgttggagcacgcactgttattccgtgtagctgtatattaaaagaggcagcaggagaatagcctgacaacaggatacagtgtaaaattatacgtagcttccttcattcaattcacattccttttccaaaaaaaaaataacaaaaaaagttaccaagggcctggaactggaactagaacatactaatatgctatatgaagataaaagcaactgggagcaaaattatattggtgatcttcatattgctaatggaaaccaggaccttcattatgattctgaatctggtgtaagcttttctgatagctttgctagtgagtatgttgccccatcagatggcctttttgctcccctggagtacttggcatctcagttccctggattttcagcagagagccttgcagagctttactacgcaaatgggtgtgatttcaaccatactattgaaatcctcacccagctagaggtaattccttctttactgcaacactaatttaagtcttccagatatccactcagaattagctttacccccaaaagggaagtgattaaattcatgctcttttgctcagatatcagatcagtgttctttagaattattgtcaaaagtggtttggaagttttttttgggacatctgtggttggaaatattctttttgttccaattataagatgtgctggcttctttctagatacatgtcttttgctatgcacctagatatacattatatctagatacatagtaaaagctatatctctagaaaagctagaaggtcttataatttggaaaggagtaattattagatatacattatatctagatacatagtaaaagctatatctctagaaaagctagaaggtcttataatttggaaaggagtaattattatacgcaatggaatatgtctcccaccatttcaatcaaaatgttcggttgccacctgttagacaagaaccatatactagcatgagatttttttgtggagctcatcaagcatgccatggactggttgcacagcatcgttatcatgctgtttataagagtactatttactaaagcagtaatgctacatgaaaagacaatttgaatcatcacatctttgattgcaatgctgcattgattttataatgcttggttacatccagaacattttggcactatccataattatgttttctctgatttttcagatgcaagttgatgctacacccaatcacacactgaatctgccccacagcacaccgaacttcagcactggggatttccctgcacttccaacagctgaggaccaaaatggtttcaatcagggtaatgtggatgtacttggcatgttcaatgggcgcagttcatctgcgatgcctactggagctggtgattttgtttcagccgttcgcaaacttgcatcgcagaactctggccagtggaagtttaaaaaaggtcctgagtatggtaatggcatttcagctctttctgtacccaagcagtacagttctagcactaaacaatcgtctgggaacaagtttcaaagcatcagcagtggaagagttgccccatggcttgagactggtgatgcagtgggtaatactcatctgatactctgaagtccttctggtccatattgcacagttccctctacgtttcatgtttggatgagtattgctcttgcccgttttcttcatttagtgaaaaatcgggaatggatagatagaaatcagggagaattatgctaacttttgagttcctttactgtgatccaattatcgctgattaatttgtctctgtatatgcaatccaccagcaagtatgtactcagaatcaaggggagaggctcgtgattttgctagggtccggaatacctgctttgagcaggctagacaggcttacttggttggcaacaaggctcttgcgaaggagctcagcatgaaggggcaggcctacaatgtgcaaatgaaagcggctcatgagaaagctagagaagctatttaccgacaaaggaatcctgtttcttcccaacgtgggggtggtgaccacctgattgatttacatggcctgcatgtgaacgaagcaatccacatcctgaagggtgagctcaccgccttgaagagcgcggcgagggcagcaggggagaggatgcaagtcatggtttgcgttggaacaggccaccacaccaagggctctcgcactgcgaggttgcccatagctgtggagcagttcctgctggatgaaggcctccagtacacgcagcctcaggcgggtctgctccgagtgatggtgtactaacatctcttaggtgagaaaaaaaaacctccaaaaaaaagagaaaagagatgtactaaaacgcaggggaaaaaagcgtcgttggagcacgcactgttattccgtgtagctgtatattaaaagaggcagcaggagaatagcctgacaacaggatacagtgtaaaattatacgtagcttccttcattcaattcacattccttttccatccaaaaaaaaaaaaaaaaaaaaaaaaaaaactcgagagggg

SEQ ID NO: 1201 - DNA, 1523 bp, Zea mays
  Clone ID: PAT_MRT4577_148480C.1
cattgggtacctcgaggccggccggcctcacccgtccacccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaagggcttgggtaaatcattattgaaagcatctcccttttacatgtaaccttgcatacaatatctgttaagatgagttcactaaataaagttgtttcaaatagtggagatgcatgttcagtcttagctagtaaagtcacatcattaaatcccaatgcagcggagtttgtaccgtcatttgttaaaccatcttttggaaatggtacagttctagataagtcagatttcaggggttcttctggaaaaacaattctagataggcctgagccatcaaagtctaataactcagatgatgaggcacaccagttttggcataagcagcttccggatgacattattccagacttcacttcttttgagaaagttgaacaagggcctgaactgtcccttgctggattatccttgaatgcaccccccttttatgggacaacttccagtcgcttctcaagagaatatcacgaattatcttctccagttaccaagggcctggaactggaactagaacatactaatatgctatatgaagataaaagcaactgggagcaaaattatattggtgatcttcatattgctaatggaaaccaggaccttcattatgattctgaatctggtgtaagcttttctgatagctttgctagtgagtatgttgccccatcagatggcctttttgctcccctggagtacttggcatctcagttccctggattttcagcagagagccttgcagagctttactacgcaaatgggtgtgatttcaaccatactattgaaatcctcacccagctagagatgcaagttgatgctacacccaatcacacactgaatctgccccacagcacaccgaacttcagcactggggatttccctgcacttccaacagctgaggaccaaaatggtttcaatcagggtaatgtggatgtacttggcatgttcaatgggcgcagttcatctgcgatgcctactggagctggtgattttgtttcagccgttcgcaaacttgcatcgcagaactctggccagtggaagtttaaaaaaggtcctgagtatggtaatggcatttcagctctttctgtacccaagcagtacagttctagcactaaacaatcgtctgggaacaagtttcaaagcatcagcagtggaagagttgccccatggcttgagactggtgatgcagtggcaagtatgtactcagaataaggggagaggctcgt

SEQ ID NO: 1202 - DNA, 376 bp, Zea mays
  Clone ID: PAT_MRT4577_148566C.1
ggattcccggtcgactcacgcgtccgcccacgcgtccgcccagcgtccgggctcaccacaccaaccaacaagcaaaaattccggagatggtactagtctccgcggcgaagatgtcagtgcgcggcaagggcggcaagggcctgggcaagggcggcgcgaagcgtcaccggaaggtgctgcgcgacaacatccaggggatcacgaagccggcgatccggatgctgtcgcggcggtgcggcgtgaatcgcatctcggagctcatctacgaggagacccgcagcgtgctcaagaactttctggagaacgtcattcgatactccgttacctacaccgagcacgcgcgccgtaagaccgtcaacggcatggacgattacta

SEQ ID NO: 1203 - DNA, 581 bp, Zea mays
  Clone ID: PAT_MRT4577_14870C.1
tccaaacagggtctcaagccaccatcgactttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaggcgccgccggtgacctttaggtgtccggatgcatgtgagcgcacgctggttttcggtttgtaccatgatgtaaactattgttcaatcgacaaggaataattgtgttcattgtc

SEQ ID NO: 1204 - DNA, 2257 bp, Zea mays
  Clone ID: PAT_MRT4577_148772C.1
ttgggtacctcgaacgagaatatccacctcctcctcgcccctctctctctctctctaaaagaatgaaaagataagggggaaatcctcaagtgctgcttacataaacgctttcatcgttgcatcgggggcggtcggaccgggaaggaaaaagcattccaacgctgcatctgcactgcacggtacctcatcctcctctatctctaagaatttaaaagagaaggaggaggaaagtcctcgactgctcgttccataaaccctaacctcgttggattctcggcaaaaatcctcccaattcggaaccctccgatgttccagctacctgcgggagctgagccgtgctcggtttggcgaaattttgcacccctcttgtgctaggaccacccggttcaagctgttcctcgctcctcggaaggatcaggtcttcaccggtgctctccggcgccggatccaggtttgtttcggcgagaggtcgggctcttggcgggggccagcccagcttcgagctcaatttgccggcctgagatggaatcgcgactgcggtgccggtgccggtggctcagctagtcgcgtcgagtcgacgcgcgattcctgccatttgggtgggccagcctttcctggcaatctcggggggcgtttcgcctcgctgcgtggcagaaaggtgtgacgtgtgatgcatcccaaggcacgaatccacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcgtttccctcgtccatgatgtgtatgtcaagattgaccgcgtcgttgcggtcgacggcgacgccgagggcacgctcaacctgtcctcgccgaagcctcggagcatcttctcgcacttcctgaagctgatgctcttcacaatcatcaagccgttccacaacatgcgcagccctaatggtactgcgaggccattgttcccgcagctctcgcagcactcaccggcacaggtgctcaggaacttcacgcacgtcaggaaccttcggatcgagctcccctctggggatgtgggtactgaggagggagttctcctgaaatggcgagcagagtatgggagcacacttgagaattgtgtgatcctggggggtacccgggttgaccgcaagcctgttggtggagagcatgagccagctttggaggacaatggaagcatgccagagtctttctataccaatggtgggctgaaacttcgtgtcgtctggacaatcagctctctaatcgcggcatcaacaaggcactatcttctccgctcaatcatcaatggccatcccacactacagagcttggtactgacagatgctgatggccaaggcacattgtgcatgggggcaaagcagctggaggagttcagagagaaccagttgtcggcctcggcatgttccaacaggactcaggtcccagcctgcaacatgaagctcaagtatgctccatatgttgaactgcctggtggtatggcgttgcaaggcgctactttggtggctatcaaaccctcacctgagggaagcaatggaagccaccctaaccgcaaggaagccgaaggattcgtctttggagcattcgatgggccatttaaagctgctgtgaaggcgctgatgaagagacgcacttaccttctggagatgaatggcttctaggaatcttggtatctagcttgttggtgctatgcatggtacatttagctgagtgtctcatatgtgtaatattcaagaaggcaccatctctagttttgatgcttgctgtctgctgttttagctatttgtacagtgttaacatttggttagataaagatcatatcaagtcctctagcgcaatagtgaatctctctacagttcactattctggcccatgatgtcctgtgtgatatggaagactgaagcatcctactgttaactcttttcaagtgaaacagccttgtgaccatctaatgtgtcagcactgggattgagatattcagatgctctcaccagtggacacaagttattatatatataatgtacatttttctcctctttcagtttcatgcacaaagtctcgaaaatttttctcctctttcagtggaagttgaaggtaacctggaaaaggagccagattatgccttcatgcacatgtcattcatttttggattgtgaaatgaaaaaggctcatctgatgctgac

SEQ ID NO: 1205 - DNA, 1480 bp, Zea mays
  Clone ID: PAT_MRT4577_14878C.1
tgggacctcgaggcggcgggaccgtcaaaatgcttgctagatagttatctcgcctcctctcttcctcgacacgcacagcaaccgcaccaagctcgacccaccgcccagccgtctgcactagctaggagcctgcgcccggagttccgcccgcgtcgtgctcgccccgccgtcgacgatcaccatgagcaggctgcctttggtgcaatcgatgctcaggtaaaggagaagaaagtgtcgaggcagatctccaggagttctaggacatcgacgagttcgaggattaggctagcgatctcccccagtcagctgcctatggtgggttgtttacgttggctatgtttctattatgtggactttgatttatattatgtaaatgacgctagtctttaatattatttactctatattgttattcgaaggattgtgctatgataagtcatttatataaaaaaaaaaaaaaaaaagcggccggccgggagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcgagcgaggcccgcgtgacgatgcgcaagacggcgagaaaggccaagccggcggcggcgtccgcgagcccgtggaacgaccccgaccgcgtgctgaacctgagcccactgtccggcgagccgccgagctacctgacgggtgagttcccggccgactaccgctgttacaccgcgaagctgtcgttggatccgtagacgttcgccaagaaccgggagctggaggtgatccactcccgctgggccatgctgggcgcgctcggctgcgtcttccccgagctgctcgcccgcaacggcctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaggcgccgccgccggtgacctttaggtgtccggatgcatgtgagcgcgcgctggttttcggtttgtaccatgatgtaaactattgttcaatcaacaagcgaataattgtgttcattgtcattattttcccctctctctttttcgttcctgccgattttatctaaatcaggtgtttgataaacggcataattggtttcctgcttggccgtgtccagtctcccccccagtgttgaccgtgtgcatgcatatgattggtgacctacactggctgtgcgtagtctgtgcatgcatatgattggtgacctacactggctgtgcgtagtctgaatgtacaagcacaacctagtcattttaccacc

SEQ ID NO: 1206 - DNA, 541 bp, Zea mays
  Clone ID: PAT_MRT4577_148808C.1
gccacccgtccgcccacgcgtccgggtccttattatcgccattctcaacgacggcactatcatgaccatctctaaggacagcagataagccgcctgcggtgcacggacagctgggaacctgaaggagatctttgccacgggcatcgtgcttggaagctacctctctctgatgactgacatcgtcttctgggctatccacaagaccgacttgttctccaacaacttcggggttaggacgatcagggacagggaccatgaaatgatgttcgcgctgcaccttcaaatgagtatcgcgagccacgctctgatcttcttcacccggcccccgagctggttcttggtggagcgccctgtgctgctcctggtcaccgcgatcctgctcgcccagctcgtcaacaccttcctcgctgtctacaccaactggggcttgggctggatcaagggtatcgggtgtggctggaccggtgtggactggctttacagcatcgtgaactacttccctctggacctgctcaagttcttgatccggtacatgctcatc

SEQ ID NO: 1207 - DNA, 3319 bp, Zea mays
  UNSURE (1)..(3319): unsure at all n locations
  Clone ID: PAT_MRT4577_14887C.1
  unsure (1)..(3319): unsure at all n locations
gttgtgtgcgaccgacgacgcacagacgatcagagaggtctcctgccgccgtgccacggacgcgaccgacgcgtaaaagttacgctccgcctaggtcgcgcacgggcgccttgcatccgcgccccagtggcctcatttccaggaggcctggggcctgggcacggaacgtgcagcgggcctgtgctttatgccaaacacgaaagggttattaggccccgctcaatattggttttggtctaagagccaagcctggaacgcttggttgggctacgatcctttcggcccacgattgctgtgagatcatcgactgaaagcatgtgatggcggcaatgctttccgctgcttttctttaccgtcctcctagtagacactgacattttaaagactacgattctagtggttgtaataaacagcgacacgtgactgtcgactgtcgttatagccggcagtaaccgccatacagcttgtttcacttgtctcactgagtcactatcagcttctttcatccataaccaaagcaatttgttttctcaccattccttttaaaaaaaggtgaaataaacatgagtccgagtgagcactgagtcgcagaaatatcaaacctaggaccggagacgaggtgctacttcttcaaaatctgaactgtgccatcacaaaagaaagaaagaaagaaaaaagaagagaaatccacaccacagccaccgcaagatcccgggcgcccaatcacccttctccacggagattcctagcctcagccacagcccacatctgcctcatcgtctccctgaggctcccgtcgcgccacgtgttccagcatcccggacgcaccaatggcatccaagcatcagatttattttttattttctggcaacattcaagatagaacttgctcgcggcggtgtttccctccgtcgctttaaataccttcgtcgcctccacaagtccacagcatctcaagccaccatcgaccttcaatgtctcgctacgtagcagtgcaatacaaaaaaagcagctcgcaatggacgagcaggaccatggagcctctcctccacggtgcttcgccaggtgaggtgcgtgtaacgtgacgtcgtcggccgccttcggagaggcccgtgtgacgatgcgcaagacggttggtgcaaggccaaccggcgcggcggcgtccgggcagaccgtggtacggcccccgaccgcgtgcttgtaccttgggcccacttgtcctggcgagcccgccgagcctacctgacggggccgagttccccgggcgacttacggctgggacaccgcgggggctgtcgtcggacccaggagacgtgtcgccaagaaccgggagcgtggaggtgatccactcccgctgggacatgctggggcgcgctcggttgatgctctcacggagctgctcgcccgcaacggcgtcaagttcggcgaggcccgtgtggttcaaggaccggctccccacatcatcagcgagggccggcatgaactacctcgggaaccccgaacctcattccacgcgacagagcatcccttgctatctgggccttgccaggtcgtgctccatgggccgggccgtccgagggctacccgcatttcgcccggcggcgccctttccgggcgaggggtcgtcgaacccgctcctatcccccggcggcagctttcgacccgcttcggggctcgccgaacgaccccgaaaggccttcgcttgagccttcaagggtgaagggagcttcaagaacggccggcctccgccatgtttctccatgtttcggattctttcgtccaggccatcgtcacccgggaaagcgcccgctcgagaaactgcgctgaccacattgccgaccccgtcaagcaacaacgcttgggcctacgccaccaacttcgtccccggcaagtgagggaggcgccgccggtgacctttaggtgtccggatgcatgtgagcgcacgctggttttcggtttgtaccatgatgtaaactattcgctcaatccccaaggaataattgtgttcattgtcaaaaaaaaaaaaaaaaaaaaaaaaaaaaaccagcggcatctatagcaaccgtgtccaacactttcacgctcaggcgctcagctctagcaatggctgcctccacgcatggcgatctcctcccacggcgatggccccggcacccccatcaaggtgggctccttcggcgaggggccgcatcaccatgcagaaagagcgagttccacgacctatactccggcgctcatcgcgcgcagctccctgctcacgtgacccgcagcgcgtgcgagtacctgcgnctctctctctaccggcgagcccccgagctacctcaccgtgcgagttccccgagagactacggtatgggacaccgccgggatgaccgccgaccccgagacctctcgccaagaaccngcgagctggaggtgatccacttcccgctgggccatgcttcggcgcgctcggtatgcgtcttcccccgagctgctctgcccgcaacggcgtcaagttcggcaagggccgtcttggttcaagggccgggctccccagatcttcaagcgagggcggtgctgagactacctcggcaaaccccaagccctgatcccacgcgccagagcatcctcgccatctgggccttgccaggtcgtgctcatgggggcgccgtcgagggctttaccgtattgccggcgggcgccttctcgggcgaggtcgtcgacccccgctgtacccctggcggggcagcttcgacccccctcggcctggccgaacgacccccgaggccttctccgagcctcaagggtgaaggagctcaggaccgggccgcctccccatgtttttccatgtttcggcttcttcgtccaggccatcgttcaccggcaagggtgccgctcgaagaacctcgctggacacatcgctgacccagtcaacaacagacgcatgggcctacgccaccaacttcgtccccggcaactaaagctcatcagctgctcagttggctatgcaactttcatggtctttcggatcgcagatgggtgtacgtacgtggattgattgatgctgcaaagttaattagctgcatgtgtgtcttttgtttccccgttgcatttcagggggcaagtcgggatgatgagttggcgttgtacactaaaatgaatgatgcttgtgcaatagtagttgtggttttgtttcccggtggttaattgttgaaatccattaatttgtttttcttctatactcctttttctctctagctctttatcttaagaaggcaagcataaatgtgcttggataaacagcagatatcaatgaaaatgaaagtagtcttatacc

SEQ ID NO: 1208 - DNA, 860 bp, Zea mays
  Clone ID: PAT_MRT4577_148946C.1
aattcggcacgagggttatgacagggttatggcttacaagttccatgaagatgagcatggggaggtctttgctgagatcaccaaacctggtattgagccctatataggcctgcactatccagccactgatatccctcaagctgccaggtttctcttcatgaagaacaaagtcagaatgatctgtgattgccgtgcaagatccgtgaagattattgaagatgaggcactctccattgatattagcttgtgtggttcaactcttagagcaccacatagctgtcaccttaagtatatggagaacatgaactcgattgcatctcttgtcatggctgttgtggtcaatgaaaatgaagaggatgatgaacccgagcctgaacaaccaccacaacagcagaagaagaagaggctgtggggtctcattgtttgccaccatgagagccccagatatgtcccgttcccactgcggtatgcctgtgaattcttggcccaagtgtttgctgtccatgtaaataaggagtttgaattggagaagcagatacgagagaaaagcattctgcgaatgcagacaatgctctctgacatgctattcaaggaatcatctcccttgagtatcgtatccgggagtccaaatatcatggacctcgttaagtgtgatggtgctgctcttttgtatggggacaaagtatggcggcttcaaacggctccaactgagtctcagatacgtgatattgccttctggctttcagaagttcatggggattccactggcttgagcactgatagcctccaggatgctggatatccaggagccgcttcccttggtgacatgatctgtggaatggcagtggctaagatcacgt

SEQ ID NO: 1209 - DNA, 347 bp, Zea mays
  Clone ID: PAT_MRT4577_149075C.1
atctgttcttcacctcactaacaccagctagcaactctttctctcctgcaataatggccgggcgctcgttctcctgccagccgcagctggtcgcggcggcggcggtcctggcagctgcgctgctgctgctggcggcggtggcctggacggcgtcggcggtcgtgagctgcggcgaggtgacgacgtctgtggcgccgtgcctcatgttcgcgatggtcagcgcggcgtcgccctacgtggtgatctgcagcggtgtgcgctagatcaacagcctcgcgtcgttcgcgacctaccggcaggtcacctgcaactgccttacgagcatgacggggcgcttcgggggccgc

SEQ ID NO: 1210 - DNA, 1032 bp, Zea mays
  UNSURE (1)..(1032): unsure at all n locations
  Clone ID: PAT_MRT4577_149280C.1
  unsure (1)..(1032): unsure at all n locations
aagggcggtttctaaacaacaaactttcgggatgaagggggttttccccctcacattcacgaaaacaaagaacgcctctaactatcgaaggcagccatagaaaacgctggctacactcgaaaggtgggcattggaatggatgttgctgcttctgagttcttcggggagaaagacaagacttatgatcttaacttcaaggaggagaacaacgatggctcaaacaaaatttcacgcgacagcctgaaagacctgtacaagtcctttgtttatgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtctaagcgcgccgggtggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaaccctttttttcaatctctctagattctgacgagtggtggtctgcactcgtcgtaatgtcgtttgcctaaactgattttgatggaacaggaaatcttgctggtcttgccataaaaaaaaaaaaaaaagggcgccgctcgcganctaga

SEQ ID NO: 1211 - DNA, 1083 bp, Zea mays
  Clone ID: PAT_MRT4577_149284C.1
acggtcaggatgcgacaattgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggaggagaacaacgatggctcaaacaaaatttcaggcgacagcctgaaagacctgtacaagtcctttgtttctgagtaccccattgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaggagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttcttctctctctctagattctgacgagtggtggtctgcactcgtcgtaatgtcgtttgcctaaggccccgttcggtttggcctgaacgacctggaatacagcatattccagctgaaattatgtcacttggattaaaactggatcaatcctaaatatctgttcggataagaaaaaaaaaaaaaaaaaagcggcc

SEQ ID NO: 1212 - DNA, 191 bp, Zea mays
  Clone ID: PAT_MRT4577_149388C.1
ctgttttctgctcatgcttctgtcgtatcgtttcctaacagggagcaaacaaagggaacaacaggggtaccaacacctaatccaaaggtagaacggacactaacaccgtgacggaagcgaacggtaacacgatactatagatcgataagataactatccgcgacgccaggatgggcccacacatcagtccc

SEQ ID NO: 1213 - DNA, 520 bp, Zea mays
  Clone ID: PAT_MRT4577_149407C.1
tcggccgggccgtcttctccctcactcccgttccatttccccatctcccagatccaattcgcgagttctccctcctctgccgccatggcgctctctgtggagaagacctcgtctggacgggcagtacaaggtcaaggatctctcgcaggcggacttcggccgcctcgagattgagctggccgaggtcgaaatgcccggcctcatggcgtgccacgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttcttcacgcaggaccaccccgccggcggcattgggcgcgaattgggcggcggggtcggctggaagggggagaccctcgaagaatactggtggcgcaccgagcgctggctggactgacgcgaggcctacggaccccaccttatcctagacaacggatgggacgacacactg

SEQ ID NO: 1214 - DNA, 1812 bp, Zea mays
  Clone ID: PAT_MRT4577_149410C.1
gggtacctcgaggccggccggggccgtctcctccctcactctcgttccatttccccatctcccagatccaattcgcgagttctccctcctctgcggccatggcgctctctgtggagaagacctcgtctggacgggagtacaaggtcaaggatctctcgcaggcggacttcggccgctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatcatatacgcagtcgcgtagcaggtttgcttttgctgaagaataatggtgtagtcggctggggtgaggcgatgtgcgttgccagatacagttttgtcttgttgactctacttatctgattatcatttgtaagcgatttgctcaagttatttgtcgtttatg

SEQ ID NO: 1215 - DNA, 1687 bp, Zea mays
  Clone ID: PAT_MRT4577_149511C.1
aggctcccactagaaaagcacacccaccttctctctcttcaccagcctgtccccaacaggccaacaatgcacaccaacatccactctctcgtcaggctcctctcccccaaaaatgagcgctgagttctgcgctgctgccggtgtcgtggccatggagctcggagtcggagatgtgctggggctgcagcaaggcatcgcaatcaccgcgccatcgcccagggacagcgacctgggtcttctcaagcgagcaggcctcacccaggctgcggctgctgccccctacccctcccccttccttgacgaggagaagatgctcaggttctccaaggcggctcacacattgcactcaggcttggattttggaggcccaggtgagcaggctttcctgctgtccaggaccaagatgccatttactccctcgcagtggatggagctggagcaccaggctctgatatacaagtacctcaatgcaaaggcccccccataccttccagcctgctcatttcaatcagcaagagcttcagatcatccaatagagtgagctggaggcctctgtatcaaggctacacaaatgcagactctgacccagaacctgggagatgccgacggacggatggaaagaagtggcggtgctccaaggaagcaatggctgatcacaagtactgtgagcggcacatcaacagaaaccgtcaccgttcaagaaagcctgtggaaaatcaacctaagaagaccaccaaggaggtgcctgctgctgctggctcattgccatgtgctgggccacaaggtagcttgaagaaggcaaaagttaatgactccaagccaggcactgtcagctattgggcagatagtttaaacaggacaatgttgagcagagagaaagcaaacaaaccgacggaagatagctctttgctgcttacttctacgaacagccaacccaccttgtccctgctctctcagctgaagcagcaaaacaaaccagataagttaggccccacactggaaaatgagtcaaacccagacacaatattgaaagcctggggtggcaaccagcctagccacaagagcatttcctctacagagcgccatgatgctgaatccctccaatcagtccttcaaaatttcagcctagcccagaatgagaagatggagtcagaaaagaacaaatattctgattccgtgctagtttcatcgactttctattctgcagacggtccaagagctacctgccttacacctaacatgacacaggtgaagcaggattgcatatcaagctcttgggagatgcctcaaggtggacctctaggcgaaatcttaacgaactccaagaatagcaaggacttaagcaagtgtaaaccaaggtcatatggttggttgttgaatcttgaccatgcaccatgattcctcaatccatgaagagcttgacatagatatcccatcatgtaggcaaacaatggtcagaaaaaggttatgaccacattgcttgccccatgcatgcttgctatctacatttgtatttctgttacgtagcatttagctagttgaattatcagttcttctggatacggctgtatcttaaacaagttctagtttgtgtcagatgatatcttgcttgctagatgtttcatgttacactttcaacaggaacttcagacaaccactttgattgacaaaaaaaaaaaaaaaaaaa

SEQ ID NO: 1216 - DNA, 1678 bp, Zea mays
  UNSURE (1)..(1678): unsure at all n locations
  Clone ID: PAT_MRT4577_149626C.1
  unsure (1)..(1678): unsure at all n locations
ttgggtacctcgaggccggccgggagctgtgatgaaaagacctgcactggtgggtccagtgcgatcttctgatcttgtgatgtgtctcgctactctgagcttggacaacgaattgcgcgcggaaaacatctccgttccccaccaccaccttcgctccttctgcttcgcccgtccccctccgtcgcgtcgactcccaagatggataagctcagtggttctgcacgtcttatgattgtttcagatcttgaccatacaatggttgatcatcatgacgaggagaacctgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgagataacatatggggaggcaatggttcctgatgatggctgggaagaatatctgaacaataagtgggacaggaatattgttgtagcagaaactgtgagcttttctgagctgaagcttcagccagagacagaacagcgcccgcacaaggtcagcttttttgttgataagaagaatgcccaggaagtgataaaatctgttgccgagagattggacaaatgtgggctagatgccaaaataatatatagtggtggccaggaccttgatatattacctcaaggagctggaaagggccaagcacttgcatatttgcttgaaaagctaagctcatgtggaaaaccgcccaacaatactcttgtttgtggtgactctggtaatgatgcagaattattcagcatccctggtgtacatggtgtcatggtcagcaatgcccaagaggaactacttcagtggtacacagaaaatgcgaaggataacccaaagataattcattcaaatgagagatgtgcagctggtattatacaagctattggacacttcaagctaggacctaacatttctcctagagacctgcagtttccnttaggcaaaggaagcctctttcaaacctacagatgctgtagtgaagttctacgttctctatgagaagtggcgcagggctgaggttccaaagtctgattcagttataaagtacttcaaaaacatcactcatgcaaatggagttaccatccatcctgctgggcttgaactctcactccatgcatccattgatgcgttgggatcatgttatggtgacaaacaagggagaaagtaccgagcatgggtggacagactttttatcacacagactggttcagatagttgggtggggaggtttgacttgtgggaatcagaaggtgatgtgcgtgtgtgttctctgtcaagtcttgctttgattctgaaggctgaatccccagagggctttgtgctaacccacatccaaaagacatggctgaacggatactcgtcaggggttgagcaggcgtttaagctgtagagcagtataccgtctcggctcgtggttggagttttcttgagaatagaatagaataatgtacctgtttataatattaacttcccaaaaccgcactggaggatcaccagggagaggattcggtgccttctcttatttggctttcatgagaagatgaaattgactcatcttggtatatatttacaaatcttgaataaaaaaaaaaaaaaa

SEQ ID NO: 1217 - DNA, 1743 bp, Zea mays
  Clone ID: PAT_MRT4577_149629C.1
gccaacgaattgggatcgaaaaacatctccgttccccaccaccaccttcgctccttctgcttcgcccgtccccctccgtcgcgtcgactcccaagatggataagctcagtggttctgcacgtcttatgattgtttcagatcttgaccatacaatggtgaatgtcgtccaactcatatcttggtctgccttaagctatctgtatgtaaactcttcattcttttgggatggctaaaacttgcaggttgatcatcatgacgaggagaacctgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgagataacatatggggaggcaatggttcctgatgatggctgggaagaatatctgaacaataagtgggacaggaatattgttgtagcagaaactgtgagcttttctgagctgaagcttcagccagagacagaacagcgcccgcacaaggtcagcttttttgttgataagaagaatgcccaggaagtgataaaatctgttgccgagagattggacaaatgtgggctagatgccaaaataatatatagtggtggccaggaccttgatatattacctcaaggagctggaaagggccaagcacttgcatatttgcttaaaaagctaagctcatgtggaaaaccgcccaacaatactcttgtttgtggtgactctggtaatgatgcagaattattcagcatccctggtgtacatggtgtcatggtcagcaatgcccaagaggaactacttcagtggtacacagaaaatgcgaaggataacccaaagataattcattcaaatgagagatgtgcagctggtattatacaagctattggacacttcaagctaggacctaacatttctcctagagacctgcagtttccttatgcaaaggaagcctctttcaaacctacagatgctgtagtgaagttctacgttctctatgagaagtggcgcagggctgaggttccaaagtctgattcagttataaagtacttcaaaaacatcactcatgcaaatggagttaccatccatcctgctgggcttgaactctcactccatgcatccattgatgcgttgggatcatgttatggtgacaaacaagggagaaagtaccgagcatgggtggacagactttttatcacacagactggttcagatagttgggtggggaggtttgacttgtgggaatcagaaggtgatgtgcgtgcgtgttctctgtcaagtcttgctttgattctgaaggctgaatccccagagggctttgtgctaacccacatccaaaagacatggctgaacggatactcgtcaggggttgagcaggcgtttaagctgtagagcagtataccgtctcggctcgtggttggagttttcttgagaatagaatagaataatgtacctgtttataatattaacttcccaaaaccgcactggaggatcaccagggagaggattcggtgccttctcctatttggcgcgtaagataaatgttttgtctcatggctttcatgagaagatgaaattgactcatcttggtatatatttacaaatcttgaataatgcagcgttatctatatccagggatgtcaacggcaatccagggaaaaaaaaaaaaaaaaaagcggcc

SEQ ID NO: 1218 - DNA, 429 bp, Zea mays
  Clone ID: PAT_MRT4577_149992C.1
cctcgatccgatccggcgagtgcacaccacctttccccactccgatcgaatcaatggccgtcgagggcgataagaagatggtaaccctcaaaagctccgatggcgaggagttcgaggtgaaaaaggcggtggcaatggactcccagaccatccgccacatgatcgaggatgactgcgccaacaacggcatccctcttactaacggttactccaagagcctattcaaggtaatcgagtactgcaacaagcacgtacatgccgtcgacggcgccgtcgccgtcttgaaggccggtttcgacgacgtgggtgccgtctgcgccaacagcaaacgcgtcttcggtgaggactctaagaactgggatgcggactttgtcaaggtcgaccaggccacgctttttgaccttatcttggctgcaaactatctgaaca

SEQ ID NO: 1219 - DNA, 301 bp, Zea mays
  Clone ID: PAT_MRT4577_150003C.1
tcggctaattcttcccctcttaccaagtcctcctcgggttagggttccttagggttttttagaagggcgatggcagctgctgatgtggagtaccgatgcttcgtcggcgggcttgcctgggccaccagcaacgagtcgctggagaatgccttcgcctcctacggcgagatcctcgactccaaggtcatcaccgaccgtgagacggggaggtcccgcggcttcggcttagttaccttattctacgaaaactccatgcttgacgctattaagaacatgaacggcatggagctcgacggccgta

SEQ ID NO: 1220 - DNA, 1475 bp, Zea mays
  Clone ID: PAT_MRT4577_150025C.1
cagctagcaatgtcggggatggcggcgcgcatcggcgagtggaagccggtgatggcgatgctcatcttcgacctcatctccgccgtgacgacggccctgatcaagaaggcgctgcaggaggggctggaccgcctggtgctcatcacgctgcggcagctcgtggccaccgtcttcctcgcgccgatcgcctacttcagagagcggagcacgaggcctaagctgacactggagatcctagtctacctcttcttcagcgcagcgtttggcgccgctctctcccagtacaccttcttctacgggctgcagtacaccaccgcgacgttcgccataactttcaccaacgtggctcctgtgctcactttcctcattgcagtcttgctaagggtggagtcactgagcatgaagaacaaggcaggagcagcgaagatcgccgggacgctgacgtcgttcgccggcgtcatgctcctcaccctctacaagggcgtctcactgacgcaccagcaagctggagaagcgagcccggaggatcacaacctcggagcagcagcagcatcgccgtctgacaggaagagctggacgctgggcaccctggcattgctcgccaactgcctgtgcttctccttctggctcctgctgcagtccaggctgaccaagaagtacccggcgctctactccagcacggcctacatgttcctcatcagctcgatgcagggaggggccctcacggcggccattcagaggcgagcgtcggtgtggcttctcacaaggccgatagagatcgtcacggtcttatatacaggaatcatggggtccggagtgggctacgtgctgatgacgtggtgcgtggagaagcgagggccggtgttcacgtcagccttcatccctgtcatccagatcatggtcgccatggtcgacttcttctttctccatgagaatctctatctcgggagtgttctgggatccatactcttgatcctgggcctctatattctgctgtggggaaagaagagggatgcctcatcatcagcggctgccaaggaagaggaagatggagagaaagaagatgaggaggaggaggacaaagagaagcaagtcagatcatgaggaccagaccactctcatatatatatatggattaggaccaaattaaagatacagttcttcggactgtgtgatgatctatacttgacagagatatatatatatatatatatatagtatttgtttaatatataactctgctagtatatatagtatttgttctgaattcaaaatcagtataaatttataagtgttctctctagcaaaaagagcaaaacaaaaataaaaaaaaacagaacagggggccgctataaaggagcccatattacgcaacccgttataggaaagcatacatcttctaaacgagaccctgaagaaaaatcaacgggccgacttttaccaagcacagggctgggaaaaaccgggcctaaccc

SEQ ID NO: 1221 - DNA, 260 bp, Zea mays
  UNSURE (1)..(260): unsure at all n locations
  Clone ID: PAT_MRT4577_150162C.1
  unsure (1)..(260): unsure at all n locations
ggagcaaatcgcttccaaaggataaacagaaaagncgaggcaacaagacaaaactgtttgaggcaacgcacttcgccttacccgagccgagctcaccattttttttcaggaaaagcaaacaggtccttccttcccccctcagctcaagcgataaccataagaaaccctgctacgcgactgcgnctattgcatatgcgtgcaaaagataactgacaggccagtgtagcgatcttcatagcacacaacggcccgagggagct

SEQ ID NO: 1222 - DNA, 365 bp, Zea mays
  Clone ID: PAT_MRT4577_150265C.1
aaaaagcatcaggcagcacaaagaaccaccattttttccttatgataaacttaaaacaaaccctgacgggggtaacagaattcattgatcccaaaaccatgctgtttgacccatggctttgctggaccctaggataaacacagcattaacacctgacacatagggaccttgcaatcaaaaacacaaatgggcatcaacaatcgagacgaacgatgatagcccctttggactagggtaaacatcacgtgactgaacaagataacttggtcgcgcgggccccaccggtcatttcttccatttcccgcctgagttgccgcagacgccgccactgttgccaccggcgtaggcgccaccaccaccaccgt

SEQ ID NO: 1223 - DNA, 238 bp, Zea mays
  Clone ID: PAT_MRT4577_150347C.1
gtgaggttctgcggggttcggtttcgcgggtgagcggatcgagatgggcggcgtcagatgttgagtacccgctgcttggtaccgcggcctcgcctgagccacggacgaccacttcctccacaacgccttcaggacctacggtgaagccctcgagtccaagattattcctcgatcgggagacgcagaggtccctgcgcttccggcttcgtcacctttctccacggacgagggcgatgca

SEQ ID NO: 1224 - DNA, 194 bp, Zea mays
  Clone ID: PAT_MRT4577_150619C.1
gatcctgcaccccgagccgaacaccacagctactcgccagaagttgcaggagcggagcacaactacgtgcagagaacaggacatatgactacgccggacggcgaagggtgacgccgtggggtatctcgccgtacggatcgcgcgctgctgctggcccgggagcgagtcgagatcgactacgagctccgccccat

SEQ ID NO: 1225 - DNA, 590 bp, Zea mays
  Clone ID: PAT_MRT4577_150645C.1
ggggggttttttttttttttttttttttttttttttttttttttttttttttttttttttttttttttttttttttttctggggaaaaaaagatttttttgggggggcaatttatgcaacaggccccccggctttataattattccaaagggggcgggcccccccaatcacccgggaaggggggccccggggggagagaaaagcctttttagaggggggggggaaaaggcccaaattaaaaaataaggggaccctctggcccgtccactcctcatatatccaacgaccccccccggccgggcggtttactcgctgcccggcccggagggagctttcgggaccccggggaaaatgaccctggggccgaccagctccttgccgacctcgggggggaatgggtcctaccggaggaagagctcgacgaggaggagcctgccgaccagcaccacaaagtttttcccggggccctgcttgttgccaaccctggggttctcggcctcacggccgtgggaccagtacacgtactgcagcagcttgctgccctcctcgccgaggaagcggccgggcacaaagtccccggcggggtcccc

SEQ ID NO: 1226 - DNA, 400 bp, Zea mays
  Clone ID: PAT_MRT4577_150676C.1
cagaatcagagccgaagtcaacacaaaagcttatatctagaaagcagcaccaagagagggcttttgtaaaaacatgggtccgatcgccacaaatgtggagctgaacatgaatggtaatagtagtgttagtttaataagcgagaaggaatcagagtaacattgtggcactgccatcatgttagacattatcatagatgacaccatgctcgacatcatcatcgttggtatcatacttaacatcattatagatggcatcatactcagcgtcatcatcgaaagcttcatactcggcatcattattggagaaaccaagtttggcataattaacgatggcatcatactagctatcgtctttgatgacatcatagtcggaaccatcataaatggcatcatattcgga

SEQ ID NO: 1227 - DNA, 2251 bp, Zea mays
  Clone ID: PAT_MRT4577_150748C.1
cattgggtacctcgaggccggccgggccggatagaaactagacgcaaccagtttctctttccctcccgattttctgtttttcttctcttggattgggctcaccctgctcaaaacttcggcggcagcggcagcggtagcggtggcggcgccggctttctccatgaacacggtggctttgttgtccttggcgccgcagctgctcattaagccctccctcacctgtttctccagaaagggcgttggccgctatggcggaatcaaggtgtacgccgtgctcagagacgacggagctgagtttgccaagaacaacaacctggaggccctgttccatgtggatgaccccgggccgagggtccccatcaagaagggcaagttcctggacgtgaacgaggctctcgaggtggtccgttttgacatccagtactgcgactggagggcgcggcatgatcttctcaccatcatggttctccacaacaaggtggtagaggtcctcaaccccctagcgagggagttcaagtcgatcgggaccttgaggaaagagcttgccgagctacagcaggagctggcaaaagctcacaatcaggttcatctctcggaaaccagagtctcatctgcgctcgacaagctagcgcatatggagaccctggtgaacgacaggctgttgccaccggacggagcctctagtacgtccacggcgcagcccacttccttggttccaagcacttcgtccaccgcccgtgtccgagccaagaaaccgccacgtcggggccttaacgtgtctggcccggtgaagccgtacaatcccagcctgaagaacttctggtacccagtcgccttctccagtgatctgaaagatgacaccatggtgccgatagcttgcttcgaggagcagtgggtgatattccgtggaaaagacggaaggcctgggtgtgttcagaacacatgtgctcacagggcttgcccgctgcatcttggttcagtgaacgagggtaggatccagtgcccttaccatggttgggagtactctactgatgggaaatgtgaaaaaatgccatcaacaaagatgctcaacgtgcgcatccagtcattgccatgctttgagcaggaaggaatggtctggatttggcctggggatgacccaccaaaggctacaatcccttctcttctgcctccttcaggatttacagtacacgcagagatagtgatggaactgccagttgaacatggactactcctggataacctcttggaccttgctcatgctccttttacacacacatccacctttgccaagggctggagtgttccaagtttggtgaagttcttaacacctgcgtctgggctccaagggtactgggatccttacccgatcgacatggagttccgaccgccatgtatggtcttgtcgaccattggcatctcaaagcctgggaagctagaagggaagagcacccagcaatgctccacgcacctccaccagctccacgtctgcttgccctcctctaggaacaaaactaggctgctgtaccggatgtcgctagacttcgctccgtggctcaagcatgtaccgctcatgcacctgctgtggtcacatttcgcagagaaggcatgtcagtcaatgtgataaagtcttgaacgaggacctacggcttgttcttggtcagcaagaacggatgatcaatggcgccaacgtctggaactggccggtatcatatgacaagctcggggtccggtaccggttgtggagagacaccgttgagaggggctctgaacggttgccattcagtaaccaagctgagagtggatcatagccggccggtgggtctcttaatttcctcctcgtcacatttattcgcgagacgacggccagaattagttacctaggcgtgcgtctctgtgctctgctccctgatgctgctgcgtctatctggaaggcgaaggttgatgggtaacatcatcgtgtctctctctcccctctggtgttggaatgtacactagcgtcgttatcatgagatgcaattgtaatctgaggttgatattttctttctttctttctttttccttttcgctttcttcttttcttcaccctttttgtgtaaagattcagcgaatgttactttgtcaaagcatgtataatcaatcatactactaactatggagacatgttcatatgagaaatggcagcagcacatctttgcttataaaaaaaaaaaaaaaaaaaaaaaagaaaaaaaaaaaaaaaaaagcggcc

SEQ ID NO: 1228 - DNA, 177 bp, Zea mays
  Clone ID: PAT_MRT4577_150830C.1
tcgcaacaccctagagtgagtcgtattatactggaccatcgcgctctgcctggtcatctccgtcctgccctacctggtgctcacggtgagcgcagcaggtgtgctggacagcggtgccttctactcggggctgtagctgcgggcgctgggctgtgcgcagcaccctgtgctgtcgtc

SEQ ID NO: 1229 - DNA, 526 bp, Zea mays
  Clone ID: PAT_MRT4577_151076C.1
agaaatgtacttgcttatttctgggaagccacggacatctgacaaaaaactttattattgaactataactcatacgaaatctaaaagagggcaccgccaccgacggggtggtggtagaatgctgatgcgtttgtcaaagcaagatggttgaatggcaacgattgctgcagttgtaagagggtgacagcgttaggcgcagcctgctgctagaacggcaacagctgtggctgtgtctagaacgtaacagggctcacaccagctagctggctgaatggtaatagctgttgctgctgctgataaacatgagagttcaatgctgtcacttgcatgaatggaagaaattgatgggggtaggcatcagataactggctgaatggctggtgatgttgttgcaaatgagaatcagagttcactgcaggtagctgggtgaacggaagaaactgctgatgctgatagtaggcatcaaagtttgctaacacaagttgcagaacttgttgtgccctgacgttttgcgccaataaatgca

SEQ ID NO: 1230 - DNA, 351 bp, Zea mays
  UNSURE (1)..(351): unsure at all n locations
  Clone ID: PAT_MRT4577_151226C.1
  unsure (1)..(351): unsure at all n locations
ggaaggcncggccgcgcgtgcggcccatacaaagcacaatattgtaccaacaatttcatccaaactatttagcctccttatcgtcggtgatctttctgcaagtgctgctactgccaccatcttcccgaaatgctcacacgctcctatagcttccctacttcccccgtaccatatcaccagctgtgtcttccatatgtgaaaacccaattcttcaaccctacaggatccaacaggcaatcacagttagcattttacctttatcacccttgttcctacaacaatcattaaccctattacatcaattacctttcgtgcatttattggcacaaaacattatggcacaacatctac

SEQ ID NO: 1231 - DNA, 224 bp, Zea mays
  UNSURE (1)..(224): unsure at all n locations
  Clone ID: PAT_MRT4577_151308C.1
  unsure (1)..(224): unsure at all n locations
cganacnggacatatgacgnaaacntcancncagagangatccggganangatgtggcangagangcttcactaccacccggaagttgccacancaanaagcatgtcatgagagaagccanagcccccaggacatcagcgggggcgcaccnctgcttgtttgtctttgataanagccgactgcgagtagccgattatngcggcacctagctgttatantncant

SEQ ID NO: 1232 - DNA, 702 bp, Zea mays
  Clone ID: PAT_MRT4577_15138C.1
atcgccgggctcatctccatcgacctcgcgcgcgacatgctccaggtgcatcccaactcgaacgctctggtgatctcgacggagatcatcacgcccaacttctaccacgggagccggcgggacatgctgctgcccaactgcctgttccggatgggcgcggcggcgatcctgctgtccaaccggcggcgggaggcgcggcgcgccaagtacaggctggtgcacgtggtgcgcacgcacaagggcgcggacgaccgcgcgtaccggtgtgtgtacgaggaggaggacgacgaggggcactcgggcatctcgctctccaaggagctcatggccatcgccggcgaggcgctcaagtccaacatcaccaccatgggcccgctggtgctgcccatgtcggagcagctgctcttcttcttccgccccgtcgggcgcaaggtgatcaacaacaagtggaagccctacatcccggacttcaagctggcgttcgagcacttctgcatccacgccggcgggcgcgccgtcatcgacgagctgcataagaacctggagctgtcgccgcggcacgtggaggcgtcgcgcatgacgctgcaccggttcggcaacacgtccagcagctcgctgtggtacgagctcgcctacatcgaggccaagggccgcatgcgcaagggcgaccgcgtgtggcagatcggcttcggcagcggcttc

SEQ ID NO: 1233 - DNA, 249 bp, Zea mays
  Clone ID: PAT_MRT4577_151489C.1
gggcggcccacgcggacggggaaagccgcccaagagaatgttcaccaacaggcggaagctgactcagatgaagggagggaaaagggggagggggaggccaacaactggcacagagcgccaccgacaggcatgcagcagggggaagagcataaggaggaacaaagacaaagcagcgactgggagagggacctaccggcgaagacactgagaggcttgctgggggagaacgaagacccaactcggcagggg

SEQ ID NO: 1234 - DNA, 906 bp, Zea mays
  Clone ID: PAT_MRT4577_151621C.1
cattgggtacctcgaggccggccgggagatagagagagagagcatagacaggagagagagagagaggggaagagagagagagagagagagagatagatgtggtaactcaagaactgttcttatgcatgcagcagccataagcattgctactagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgcctcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtatgcggaggatgccacaccctcctcatgtacatacgcggcgcgacgagcgtgcagtgttcttgctgccacactgtgaacctggctatggaagcaaatcaagtcgcgcatgtgaactgcgggaactgccgcatgctgctcatgtaccagtacggggctcggtccgtgaagtgcgcggtctgcagttttgtgacatcggttggaagcagaagcccagcagctgagctgatagtgtccctgaaagtgctgtgagaccacctatgaaaaggatgctttgagtgcacatgtatagagttcttccctgaagcgattctttcactttcttttcttttggtttcttttcttttttgggtcctccgtcacatctccaccccacccgtccacttctgcgttccttcgatggatctggcgagcccgcggaataaatgagagtttttggatatatagctagggg

SEQ ID NO: 1235 - DNA, 1431 bp, Zea mays
  Clone ID: PAT_MRT4577_151622C.1
gagagagagagagagagagaagacaggagagagagagagaggggaagagagagagagagagagagagagagagatagatgtggtaactcaagaactgttcttatgcatgcagcagccataagcattgctactaggtgccgattcccctcttcttctttgttttttattcccctcttgctcttctttgatgatgatgattggctgggaactacatcttggaattcctttttttctctctctcgctttcgttgtttgattattggccttggtaaggccatggtgggtgattcctcgcctgttttatctgcaaactggattagctgcgagtttttttcttcttctttcaacccgctgcgttatcctacctaagctcggtttactcgttgcatcaggccaacaatggcaagtggcttccatgaacatggctgtccatgaaaaatcccccgtatgcatgctcggtctaatctcctcaagctagcgaaacgaaatttcctaaaagccggtctggtcctcgaatacagcttgttgcctgagccgctgggagtcctatggagtagtagagttcttcaccttcttctgcgcgcgattactgttagccggcttgaggagaagctggaacgatcttgacgtgcattcagagaatcgatttttccccgtctcccaaggactcctcgtccattagtaatcgattttactgctactgaacagctctttgcgtgcattttctccgagatttctgtggatttcaaatatcaatgcaactgaagacactctgtctctctccctcgctctgtttcgtcagcgtctcctgcacgtgctgtgtcgtttccagggtttcatgcggggcgaagcagctggtctctgccgcctgaacgccgccggaatctgcgaggcctccccgagctgcgtgcgtcgtcaaataaggcagccgccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtgtgcggaggatgccacaccctcctcatgtacatacgcggcgcgacgagcgtgcagtgttcttgctgccacactgtgaacctggctatggaagcaaatcaagtcgcgcatgtgaactgcgggaactgccgcatgctgctcatgtaccagtacggggctcgaagactaccattgtttcgctgctattcttactgtaaaacaacttgtgtttctcatgagaaacagagaactaaccgccaagtttcactctactcagacctcacctggtgcagagcagaagcccagcagctgagctga

SEQ ID NO: 1236 - DNA, 963 bp, Zea mays
  Clone ID: PAT_MRT4577_151624C.1
cattgggtacctcgaggccggccgggagataccttttcggcccccatctatactctgtctgctgttcttccctataaattcgtcgacctctccatatcacagagagatagagagagagagagatagacaggagagagagagagaggggaagagagagagagagagagagagagatagatgtggtaactcaagaactgttcttatgcatgcagcagccataagcattgctactagcgtctcctgcacgtgctgtgtcgtttccagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtgtgcggaggatgccacaccctcctcatgtacatacgcggcgcgacgagcgtgcagtgttcttgctgccacactgtgaacctggctatggaagcaaatcaagtcgcgcatgtgaactgcgggaactgccgcatgctgctcatgtaccagtacggggctcggtccgtgaagtgcgcggtctgcagttttgtgacatcggttggaacctcacctggtgcagagcagaagcccagcagctgagctgatagtgtccctgaaattgctgtgagaccacctatgaaaaggatgctttgagtgcacatgtatagagttcttccctgaagcgattctttcactttcttttcttttgggtttcttttttgggtcctcctcaacattctcaccccacccgtccacttct

SEQ ID NO: 1237 - DNA, 511 bp, Zea mays
  Clone ID: PAT_MRT4577_151786C.1
catgcgaccaccccaagagcccctcctgagacatgaagccgtgcattgacaaaaacagctgcatgttgatatctgggtgatggagacacaccaggggccattgcccactcccagcgaccatctctatgcttagcaagcccatatgcactcgataggggcacactattggcatcccttccaccacaaagcaaaaggagaccatcagaacgggcactagcagttgcatacatgcatggtggtggtccttcaccttccggctcaagttttctccattcatatggcttagccgcagtatcaagggcccatacatctgccaggggccgttttccatcattgccaccaattgtcaataagaatcgctgcccaaccaaggccatcacatgtccataccgtggaccaggaccaggaccttgaaccaccactctatgccatcgcggtcgttgttgtgtaagatccagaacatgaaggtcccagcagataagccggcagggccaattccaccctgaatgac

SEQ ID NO: 1238 - DNA, 1444 bp, Zea mays
  Clone ID: PAT_MRT4577_151969C.1
cgtagagtcggttgaaaaaagaggtgggtggcgccggtgctgcggactaggtcgatcagcgcgacgacagcgtcgctggagcggcgggtgacgaggcgccaggcgccgagccggcggagcgaggcgtcgaggtgcttcaggctttggctgagccaccaccgggacaccctgccggggtagtagggcccgtcctcctctggcgaccacacgtacgccggcacgacctccccggccgtccgagcggccgccgccagcgccgggttgtcctccacacgcaggtctcgcctgaaccagaccaccgtccgcacccccggctccccgccgccgctcatcgaggactgcgatgctgtcatggcaccctcaccctatccggcacggctgaccaagaattccagacacagcaagctcttggccctttggcaagatccgcagcagctcaatcaagaatcggtcaagcagccaagaacaagctcttggctcccttctatgactatcagttgcgcaggcgaatcaagctgcttcacgcactgagccaggattgctccaggaactgcggaaaggctggactggatgggcctcttctcttcagagaggctgcagtggagatcggataatctgacaaatccaatctaccctcctctgattgaaaatctgattgaaaaaaagggtccagagtattttttttcgcctggggaatcgatgatgttgtgcagagattggcagaggggctctgggttgcgggaaaggcgagggtgtggtgtggtccagtgcagagggaggcctgcggatattgggattggttgacggtcttggctgagattgggaggcacgttgtggaaggcagggagtgggaggtctacagattgcacttcggtgaggagcacgagctctcgtctgtgctgcggaagaagattgtggatgcagtcaccaacatgctgatggggtgggactgatggcactgctgctgccgtgcctcggtctgaaacattatgcttagtgttcttccagaaactaacctatttggtgcaagcaaagaagaaacagctgatctctatctcttagattgcagcggttttcagctaatgcagagaccatgaaacctttggttatccaaacatgcactaggaaccggggtcctactagttagtgggcaccagacctgatgtatatgcatatactgaagcatgagatagggagatatgttgcataaaataaaaaaaaggaagtctacagattgcactttggtgaggagcatgagctctcgtctgcgctgcggagcaagatcgtggatgaagtcaccaacatgctgatggggtgggactcatgacactgctctgccgtgcctctgaaaaattatcattactgttccagcaggaatcaattaacttatttggtgcatgtaaaaaaggaacgacttatctcttaaatgtagcggtatttaact

SEQ ID NO: 1239 - DNA, 3461 bp, Zea mays
  Clone ID: PAT_MRT4577_152093C.1
cattgggtacctcgaggccggccgggacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgttccacttcggcaagggcaagagcgagggcaacaagaccatgaaggaactgctgggcggcaagggcgcgaacctggcggagatggcgagcatcgggctgtcggtgccgccggggttcacggtgtcgacggaggcgtgccagcagtaccaggacgccgggtgcgccctccccgcgggcctctgggccgagatcgtcgacggcctgcagtgggtggaggagtacatgggcgccaccctgggcgatccgcagcgcccgctcctgctctccgtccgctccggcgccgccgtgtccatgcccggcatgatggacacggtgctcaacctggggctcaacgacgaagtggccgccgggctggcggccaagagcggggagcgcttcgcctacgactccttccgccgcttcctcgacatgttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctggcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcaccaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactacaaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcagagaccagccctgaggacgttggtggcatgcacgcagctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtcctggaccagaggggagtgggcgagctggtgaagtttgctacagagaggggccgcaaagctaggcctaacttgaaggtgggcatttcgtggagaacacggtggagagccttcgtctgtggccttcttcgcgaaggctgggctggattacgtttcttgctcccctttcagggttccgattgctaggctagctgcagctcaggtgcttgtctgaggctgcctcctcgttggcaaccggattgcctgctgctggtggatgtggtgatcaacagtattattacagagccatgctatgtgaacattactagtagcagtgctcataaaagctacaatcccatctcccttttttttccagtcatgtaaaacttccaaactgctccatggttcaaaactctgttcttcaatacatcatcaattatcgattatataaaaaaaaaaaaaaaaaaaaaaaaaaaaaaaaaaaaaaaaaaaaaaaaaaaaaaaaaaaacaaaaat

SEQ ID NO: 1240 - DNA, 1094 bp, Zea mays
  Clone ID: PAT_MRT4577_152094C.1
cattgggtacctcgaggccggccgggaaggattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgtcggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggggaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaggtgcttgtctgaggctgcctcctcgttggcaaccggattgcctgctgctggtggatgtggtgatcaacagtattattacagagccatgctatgtgaacattactagtagcagtgctcataaaagctacaatcacatctcccttttttttccagtcatgtaaaacttccaaactgctccatggttcaaaactctgttcttcaatacatcatcaattatcgattatatatgtggcaaggttttttccaaaaaaaaaaaaaaaaaagcggcc

SEQ ID NO: 1241 - DNA, 3924 bp, Zea mays
  UNSURE (1)..(3924): unsure at all n locations
  Clone ID: PAT_MRT4577_152095C.1
  unsure (1)..(3924): unsure at all n locations
ttgggtacctcgaggccggccgggcacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagcccgccggcgtcatccgctccgactccggcgcgggacggggccagcattgctcgccgctgagggccgtcgttgacgccgcgccgatacagacgaccaaaaagagggtgttccacttcggcaagggcaagagcgagggcaacaagaccatgaaggaactgctgggcggcaagggcgcgaacctggcggagatggcgagcatcgggctgtcggtgccgccagggttcacggtgtcgacggaggcgtgccagcagtaccaggacgccgggtgcgccctccccgcggggctctgggccgagatcgtcgacggcctgcagtgggtggaggagtacatgggcgccaccctgggcgatccgcagcgcccgctcctgctctccgtccgctccggcgccgccgtgtccatgcccggcatgatggacacggtgctcaacctggggctcaacgacgaagtggccgccgggctggcggccaagagcggggagcgcttcgcctacgactccttccgccgcttcctcgacatgttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctggcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcaccaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactataaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgagatgcccgtacacctaccaggtcctggaccagaggggagtgggcgagctggtgaagcttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaggtgcttgtctgaggctgcctcctcgttggcaaccggattgcctgctgctggtggatgtggtgatcaacagtattattacagagccatgctatgtgaacattactagtagcagtgctcataaaagctacaatcccatctccctttttttttccagtcatgtaaaacttccaaactgctccatggttcaaaactctgttcttcaatacatcatcaattatcgataaaaaaaaaaaaaaaaaaaaaaaaaaaaaaacctggggggggggcccggcccccaattccccctataggggtcgtttttcacaannnnnnnnggggggggnntggnnccnnnatnnnntggaaagaggattttcttaaaatgatttttatttggcttaaacccccttatactcctcaaccctttcccaattgtcgcaatcctccaatcctcctgtaccccccctcttgtcctcctccccgatgttgcgattgaacctctttcccccacttctctcacatttccgtcctatgtctcccctttggaaaccccattgtccttttcgtctattgtcatcattttcagaaatcaggcgagggntttgtcagcaggccctgtccttgttcagtatgtattggagggtgtccgcgtgtgagcggtccctcgtgtcgctcggctggcttcatgcgggccccccatatgcgtatcccattcatcgccaccaggtagattctgcgcgatggcatcaccgagtagttgacgctctgctgtgttgagtctgcgttttgcgatgttanaatcgaccgggcacangtacgcactcaccggtcttatccgcgcacgcgtagatcaacaa

SEQ ID NO: 1242 - DNA, 3003 bp, Zea mays
  Clone ID: PAT_MRT4577_152101C.1
ccggccgggataccagccacggctgcatttatttgtcactgatcgttgatcagcctagctagctagcgctgttttcctgtgtgctaatggcgcccgttcaatgtgcgcgttcgcagagggtgttccacttcggcaagggcaagagcgagggcaacaagaccatgaaggaactgctgggcggcaagggcgcgaacctggcggagatggcgagcatcgggctgtcggtgccgccggggttcacggtgtcgacggaggcgtgccagcagtaccaggacgccgggtgcgccctccccgcggggctctgggccgagatcgtcgacggcctgcagtgggtggaggagtacatgggcgccaccctgggcgatccgcagcgcccgctcctgctctccgtccgctccggcgccgccgtgtccatgcccggcatgatggacacggtgctcaacctggggctcaacgacgaagtggccgccgggctggcggccaagagcggggagcgcttcgcctacgactccttccgccgcttcctcgacatgttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcactaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactataaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgcagctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatcagactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgattatataaaaaaaaaaaaaaagggcggccgtcgcgatctagaactagttctagatcgcga

SEQ ID NO: 1243 - DNA, 407 bp, Zea mays
  Clone ID: PAT_MRT4577_152170C.1
gctgcctcctccttatcctcccatcgtgagaagtgattgcggtccatggcaaggctatcggcggtgtccccgcaaagaaggcaacgtccacgatctccaatgccgtactccagttccacgtcggcaggattgccagcttcctcatggcggtcaagtacgccaagcgcgtcagctccggctcccccgtttacctcaccaccgtcctcgagtacctagcggctgaggttctcgaacttgccgggaacgcctcgaggtacaacaagaagacccgcattgtgccgcgccacatccagcttgctgtgcgcaacgacgaggagctgaccaaactgtttgctgtgtccaccatcgcgagcggatgtgttatgcctaacatccatcagcatctgcttcccaataaagctgccttc

SEQ ID NO: 1244 - DNA, 238 bp, Zea mays
  Clone ID: PAT_MRT4577_152177C.1
gggtcgcatcgacaaacttaaacaaaaatgcatgttgaactactacaggtggcgacaaatgccataacacaaatactgatcgccggataagatagcactacttcgatggaaccaaactttactcgccatcctcatcgttgacatctgctccggccgaggagttgagctggctgagcctttaaatgagactggcctttctctgcttgtatgtcacttttgttgatgttgtacccatggt

SEQ ID NO: 1245 - DNA, 882 bp, Zea mays
  Clone ID: PAT_MRT4577_152258C.1
cctcgaggccggccggggtcgccttgtcggcgtccgccactccgccccctccagccagatccctcctattcccccacttcacgcttacccgcgacgtcaacacctgcagcctcgtcgtcgacaccgtgggtgaataccactcgggtgtgggtgccaagcgcaatggacggcgcaaggggaagaaagggaagaagggaaagcaggatgcacctgtgactgacttcgtgccggttaagacacagattaggctggacgagaacaccgccaacaatgaggctgctggggctgcagcggagccggtgtttgttgttggtgaggctgtcaatgacagcttgccagtggttgcttctgagtctgatttcagccgtggtaagtaccttatttacattggtggtggcgagaggtgcaagagcatgaaccatttcatttgggggttcttgtgtgcccttggtgaggcacaattcttgaaccggactcttgtcatggacttgaatgtctgcctcaatgcacggtatacttcgagtggcaaggatgaagaaagagatttcaggctctactttgattttgagcatttgaagcaatctgcgtccgtgattgaccagagccagttctggcaagattggggacagtggcacaagaaagataggctcaagaacttctacactgaagacatcaggatgaccccaatgaaacttcgtgacatcaaggacacattgatcatgaggaagtttgggaatgttgagcctgataactattggtcacgtgtgtgcgagggtgagactgagggaataatcaagcgcccatggcatttcctgtggaaactccctcgcttgatggagattgtatctgccattgcctcacggatgaactgggactttgact

SEQ ID NO: 1246 - DNA, 314 bp, Zea mays
  Clone ID: PAT_MRT4577_152259C.1
agcaccattgttagttcaatgggcagcagagtcctcggtccacaggctataagcttggatcagggccggtaaccgatcgacacatgaacacacattattgggcgcaagacacttacggcacacattatgacatatcatcacagctgagataaatccgtctggtttatgagtccatcacggtaagttacatagacagtccacacgggaatctgtggtattccgcacaggcaatttgcaaggagacgacgttcagaacacaaaggggttgccgtagacctcgaacatcttcgagcaagaccagttacgttccggca

SEQ ID NO: 1247 - DNA, 585 bp, Zea mays
  Clone ID: PAT_MRT4577_152260C.1
gaacgctaacttgtttcgacgattcctgttgactccggatgaattttaaggtgattccagttgggttggaaagcgtatctccttaggtttccatccatataaagcataacctaatcggagttcggatgcatcttgggcgtctgttttagtgtagactagtcctagacttcgaggtggagacgaagttgagtcagacttggatttctcttgttgtgaatatcctagcttctcgtccttgacatcttggcctttcccaagtccttactagtcctctccaaggttccttagcccaccaaatgttcaggaagaagctgagcatgtattcacgccatccttgcaatcacgtgtaagctcgttgaatgtctccacatgcctcttccccctcaagaatacctcagtgtcaactgcaatcctcatatagccatcaaattctactggctgaccattgctcagctccttagtttcagtgaaccactcactattctcatcccacaggtagcaatgtacaaataccggccagcaccaaccttatcattaagtgccataaggagactgtctggtgaggtatctctgtcaaggtttggc

SEQ ID NO: 1248 - DNA, 578 bp, Zea mays
  Clone ID: PAT_MRT4577_152261C.1
ctgcgacacggaggcgcccgtggactgcacaggagacagggaactcttccgcgtccgcatgcgcgcggccatcgagcggttccccgacctccacttctaccgctttggccgtcccgtggcggtgccggggagtcccatggagtgtgacctcgcgtggcgcttccgccccgctgccgacgccatcggcaccggccggaccacatactacaaggactaccgccggttcacgcttacccgcgacgtcaacacctgcagcctcgtcgtcgacaccgtgggtgaataccactcgggtgtgggtgccaagcgcaatggacggcgcaaggggaagaaagggaagaagggaaagcaggatgcacctgtgactgacttcgtgccggttaagacacagattaggctggacgagaacactgccaacaatgaggctgctggggctgcagcggagccggtgtttgttgttggtgaggctgtcaatgacagcttgccagtggttgcttctgagtctgatttcagtcgtggtaagtaccttatttgcattggtggtggcgagaggtgcaagagcatgaaccatttatttgggg

SEQ ID NO: 1249 - DNA, 374 bp, Zea mays
  UNSURE (1)..(374): unsure at all n locations
  Clone ID: PAT_MRT4577_152369C.1
  unsure (1)..(374): unsure at all n locations
tcccgttaaccaggcccagtcccgtggcggtggcggtggcggcggtggctacggcggcggtcgcggcggcggcggctttggtggcgggcgccgtgacggcggttttggcggcggtggcggcttccgcggtcggcgcgagggtggtggcggcggcttcggnggcggtggcggctactgcggtcggcgcgtgggtggtggtggcggcttccgcggcggcggcggcggctggtgggactgttgtgtgggcccttcctggcttcggccgggttgtcttatctgtctttcgtgtcgtggttccgttcgcttctgtccccgggttagtgtccgttctccctttggattaggtgttggttcccctggtggtccctttgttt

SEQ ID NO: 1250 - DNA, 371 bp, Zea mays
  Clone ID: PAT_MRT4577_152373C.1
aacaccctatagtgagtcgtatattcacctctctgctcaccatctcatcaactctccaagcatgacgcaactcccacgccccccttcgggcttctcatgccgatgcgttaggcgcggcattgatgaaaactacgatggtgtcatttaccagtacgcctcaagctcctatgttaaagaaggatatatcgaacccagagccgtgatctatcctaccgatgacgaggacgtcttcaaggccatcgagtacgcgagaaccaacgatgtctgaatcgcgatccgtaccggcggccacagctactgcggctcttcctcgaccaatggtgccaacatccagctggacctgtcgccgacctacacagactttcactggg

SEQ ID NO: 1251 - DNA, 325 bp, Zea mays
  Clone ID: PAT_MRT4577_152422C.1
cctggatattgctcgagctgaattggagcgatgagaccaactagcaacatagaaagcacaatagtgtaccaacaatggcagctaagatattgtgcctccttatgctccttggtctttctgcaagcgctgctacggcgaccattttcccacgatgctcacaagctcctatagctacccttcttcccccgtacctgtcaccaacggtgtcttcggtaatgtgacaacccaattcttcaaccctacagagatacaacagacaatcaccagctggcatcttaccttaatcaccccttgctcctccaacaatgatcagccctattacaga

SEQ ID NO: 1252 - DNA, 2599 bp, Zea mays
  Clone ID: PAT_MRT4577_152459C.1
gctcaggaggcggcggagagaagggagaaaatccccggtagggaggggggaaggaagccaaaggcccaaaggtctcggcgctgccgtagtaccggctgaggcaagatggtgaaggcacgaatgacgccgcctcatcggcatgcgcctagccaacgtctacgacatcacccccaagacataccttttcaagctgatgaacagcagtgggattactgaatcaggggaaagcgagaaggtcttgttgctcatggagagtggtgtcaggttccacaccacccaatacgttcgtgacaagagtaccaccccttcaggtttcactctgaaactacgaaagcacattcgtaacaagagacttgaagatgtccgtatgctcggatatgacaggattatccttttccaatttgggcttggtagtaatgcacatttcataattttagagctatatgcacaaggaaacattcttctcacggattcagaatacacagtattgacactactccgttctcacagagatgacaacaaaggattggccatcatgtcacgtcatcgctatccagtagaagcttgccgtgtttttggcaggactgactttgcaaagttaaaggacatgttgacaaagcctgataaggctgatgataaagaggaaattacgtctggatcaaccgatgctcaggaaacttctcaatccaccaatgatgaagtgttggtaactgaaatatctgaaaaatcactgagtaaaaaaaaaaaaaaagggctgactggcgaggcaaaagcgcaaacgcgaccacagacagagcgcgcttcaaggccttttttttttttgagataacaaggaggagaggaggagatggcggtcacgatcacctgggtgaaggcgaggcagatcttcgacagccgcggcaaccccaccgtcgaggtggacgtgggccttagcgacggcagctacgcgaggggggccgtacccagcggcgcatccactggaatatatgaggccttggagttgagggatggaggatctgattatcttggcaagggtgttcttaaggctgtcagcaatgtaaacaacattattggaccagcgattgttggaaaggaccccactgagcaggttgagattgacaacttcatggtccaacagcttgacggaacctccaatgagtggggctggtgcaaacagaagcttggagcaaatgccatccttgcggtttcacttgctgtgtgcaaagctggagctatggtgaagaagattcctctttaccagcacatcgcaaatcttgctggaaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggagaagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaggagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactccggtgattttgtcgtgggggcccccaaagcagaaaagaaccctttttttttcaatctctctagattctgacgagtggtggtctgcactcgtcgtaatgtcgtttgcctaaactgattttgatggaacaggaaatcttgctggtcttgccatatgcgtgcgagtgactttcttgttccttatggtgtgtgaggccattttcgtattcagcatggaaaattacgggttcgttttgtagcgacaggcagcttgggcgtaggagccacgacccgcaaaaataaaatcttgttggttgc

SEQ ID NO: 1253 - DNA, 2506 bp, Zea mays
  Clone ID: PAT_MRT4577_152461C.1
ttgccccacggaacaaggaaaagggtatatgctcccgcagccctcgtggaaaccaagggcggaccttcccctcctccaagcaaatccgaggcccacccacgggccgctcgaacatctgtcaccgccaagtggccccaccccacccctcccctccgctgccccttcttctacaaataccccggccggccgcggccgttcccgaatcgagcggtgactggcgaggcaaaagcattgcgaccacagacagcgcgcgcttcaaggcctttttttttttgagataacaaggaggagaggaggagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgttttttttcttctcaaaaaaaaaaaaaaaccctggggggggggcccggcccccaatcccccctttggggggtcttttaccccccccccccgggccgtttttttacaccggggggaggggaaaaccccgggcgtcccccaatttaatcgcctggaaaaacatccccttttccccggggggggaaaaaccaaaaaggccccccccgttcccccttccaaaaatttgcccaccttgaagggcaaaggggcccccccctgtaccggccctttaagccgggggggggggggggttccccccagggggccccttacctttgccagccccttagcgcccgctcttttcgttttttcccctccctttccccccaggttggggggttttccccgaaaagctttaaatggggggctccttttggggttccaatttagggttttccggccccctcaccccaaaaaattggattgggggagggtccccttggggccccccccccggaagacaggtttttccccttggccgtggaggcccccgtttttataaaggggctctttggccaaaggggaaccccactcaccccttttgggggctttttttttggattaaaaggggattttgccccttttccgcctttggggataaaaaaagggctctgttttaacaaaaattttccccccaatttttaaccaaatttttccccgctcgccagtt

SEQ ID NO: 1254 - DNA, 1217 bp, Zea mays
  Clone ID: PAT_MRT4577_152504C.1
cattgggtacctcgaggccggcgcgtgcttttccggccgcagcggctaacgcgtggccacgccatccctccgcgtgcctaattaattggaagcacccagcgcacatcatcagtcgaagtgagcgtcagcgagcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggtgatgcagatgtttctttggatctatttctctagatatccctacc

SEQ ID NO: 1255 - DNA, 1171 bp, Zea mays
  Clone ID: PAT_MRT4577_152506C.1
ggaaacctttgcgttttttaagcgagccacgccaataacggagaggcatgcaccgacgatcggcatttccttccagtggtcgggaaagggaggacagcagagcagaggtcgagcatcgcatcgcgcgctttgcctgccgcagcggctaacgaacgcgtggatcatcccttctattattaattaattgggaggagtgggagtgatagctgcagcacccagcgcccatccggaaccctagcctcctcgtcgttgaatccaccacaccacaccatgagcgggagcgcctccaggaagctcttccaggccgccaggtccatcgtcctctccgcttctcaacgctcctccttctccgtcctcgccgccgagggccgcaccgccgcgctcgccaactttggcaggaagatcctccccagcgcctgctcctaccacaggcagggatcccacgccgcgtcgggatggggagccatcgctgccgcagtccccgccgcagtttacatgctccaggaccaggaggctcatgctgcagagatggagcgcactttcatcgccatcaagcccgacggcgtccaaagaggcctgatttctgagattgtgaaccgattcgagagaaaaggctacaagcttgttgccatcaagctgattgtcccatccaaaggattcgctgagaagcactaccatgatctcaaggaaaggcctttcttcaacgggttgtgtgacttcctcagctctggccctgtacttgcaatggtttgggaaggagagggtgtcatcaagtatgggagaaaactaattggtgccacagacccacagaaatctgaaccaggaaccatcaggggcgatcttggcgttgttgtgggaagaaacatcattcatggaagtgatggcccggagacagcaaaggatgagatcgccttgtggtttgaacccaaggagctggtctcttataccagcaatgcggagaagtgggtctatggggtgaattaaccagcgactaaatctcttgaggtttgcttttttcttttcagttttcacataattgccgacagaccaaggcaggatgtaataaagtagctaccgtcacctattacttttgagttggattgattgtggtgcagtaaggcacaaggaaaggaaggaatacaccgtgaaatttgttaaaaaaaacaaaacg

SEQ ID NO: 1256 - DNA, 1349 bp, Zea mays
  Clone ID: PAT_MRT4577_152508C.1
cgattaggtgcacttttaacagctttacggccgcttttttttttttttgaataaaaacagacggcgggccatcatcatggtagggatatctagagaaatagatccaaagaaacatctgcatcgccatcttggattacatgactccagtgacggtgatatatagtttgatttgaacatcgcgactactcagtgcacgctctatatttcacggtatattcctttcctttccatccttccttgtgccttactacacctgaaggtcacaatccaactcagaagtgacggtagcgactttattacatccttgtgcctaggtctgtcggcaattatgtgaaaaccgagatcaaaagaaggaaaaaaaacagattgactctctcgttaattcaccccatagatccacttctccgcattgctggtgtaagagaccagctccttgggttcaaaccataaagcgatctcatccttcgctgtctctgggccatcacttccatgaatgatgtttcttccaacaacaatggcaagatcacccctgatggttcctggttcagatttctgtgggtctgtggcaccaattagttttctcccatacttgatgacaccctctccttcccaaaccattgcaagcacagggccagagctgagaaaatcacacaacccactgaagaaaggcctttccttgagatcatggtagtgcttctcagcaaattctttggatggaacaatcagcttgatggcaacaagcttatagccttttctctcaaatcggctcataatctcagaaatcaggcctctttggacgccatcaggcttgatggcaatgaaggtgcgctccatctctgcagcatgagcctcctggtcctggagcatgtaaactgcagctgggactgcggcggcgatggctccccaccccgacgcggcgtgggatccctgcttgtggtaggagtaggcggtggggagggtcttcctgccaaagttggcgagcgcggcggtgcggccctcggcggcgaggacggagcgttgagaagcggagaggacgagggacctggcggcctggaagagcttcctggaggcgctcccgctcatggtgtggtgtggtggattcaacgacgaggaggctagggttccggatgggctcagtgatgggcgctgggtgctgcagctatcactcccactcctcccaattaattaataatagaagggatgatccacgcgttcgttagccgctgcggcaggcaaagcgcatgcgatgcgatgctcgacctctgctctgctgtcctccctttcccttctcaccgccacgtgcaggaaatgccgatcgtcggtcccggccggcctcgaggtacccaatg

SEQ ID NO: 1257 - DNA, 649 bp, Zea mays
  Clone ID: PAT_MRT4577_152531C.1
ttatcatctgcgcctctacattgcttctcgctctgctcctccgcctccgcctgatccatccaagacaggaatcgccatgacggactcgggggatgaccacttcgaatcgaaggccgacgctgtagcgtccaagacctacccgaagtagggtggcaccggccgtaagaacggcttcttcgtcatcaataaccgtccctgcaaggttgtggaggttctctacctccaagactgccaataatgagcacgactaatgccactttgtggccatagacatattcaatgggaaatggcttgaacatattgttccttcatcacacaactgtgacattccgcatgcgaaccgcactgagtatcatatgattgatatttctgacgatggatctgtgagacttcttacttcacatggtgacactaggatgatcttagactcccaactgatgagactcttgtggcccatattagggaaggcatctaaagcgttaaggatcttgttgagactgtccagactgctatgtgggaggagcagatctgcgcgatgaaggatggtggtccccagtaacttccttggatttggagacggaaccctactgtatctcaacttaaatcggaaaagaactgtatctccagaggattgctaccgagacattca

SEQ ID NO: 1258 - DNA, 272 bp, Zea mays
  Clone ID: PAT_MRT4577_152593C.1
attattctcgatttcaggttctgagtttgtggagatgtttgtaggtgttggtgcttccagagtacgtgaacttttcaagacagccaaggagaacgctccttacatagtgtatgtcgatgaaattgatgctgttgtacggcatagaggtacaggtattggtggtggaaatgaatgatagggagcagactctaaatcaataactaactgggatggatggttttgagggcaacaccggaattacggtattgctgccactatccatctgacatctt

SEQ ID NO: 1259 - DNA, 188 bp, Zea mays
  Clone ID: PAT_MRT4577_152730C.1
gttagaataccttgaggagcgggagcctcaaggatttggtcaagaagcactctgagttggtgaggtaccccatctgcctgtggaccgaaaagacaacggagaaggagatttctgatgatgaacatgaggaagagaagaaagacgctgaggagggaaaggttgaggatgttgacgaggagaacgaagag

SEQ ID NO: 1260 - DNA, 871 bp, Zea mays
  UNSURE (1)..(871): unsure at all n locations
  Clone ID: PAT_MRT4577_153066C.1
  unsure (1)..(871): unsure at all n locations
cctcgaggccggccggggcctcacatctcattcctctcctctctcctccccccctctcgctcgagctctgttggaggcaggagggcaggccagggcgccaggccaggcgaggtggttcggttgacgagttcttcctcttcctcgacatcgccgatcccgccacgcgctgcccgcagcggaggtgagacacaataatcttagatggagaggttaagcaccaaccagctctacagttctggtgttcctgtaaccgtaccaacatctctgccttgtataccagtctctctggatgagagcttcccgaggcttcccgatgcacagagtgttttgatggagagagaattgaggagcactccactaccacctcaccagacaactgttgctcctatccgtggtctgtttcactccaatactggatctgttggtcctttgtgctcacctccgtctgtaaggttctcttcgcattcaaatcctgagcaataccccaaccacaattcatacaattctcaagtaccaagcactgcaagttcctcaacgctgaattatgggtcacaatatggaggctttgaaccatccataaccgatttcccaagagacattgaaccaacttggtgccccgatccagttgagagcattcttggatactctggtgatgtccctgctgggaataatttgactgggaccacttctattggagcttcagatgatcttactaagcaaactgaatggtggacagagtttatgaatgaggattggaaggacatggttgataacccgacttcacagaaactcaaccggttgggcaaccctgtgcatcatccaactcagntcaccatcagctacccaacaacagtttcatctcaaatctgtg

SEQ ID NO: 1261 - DNA, 424 bp, Zea mays
  Clone ID: PAT_MRT4577_153096C.1
gcctcagatctgaagcacctgctccgacacttgcatcttgtcgaagggacaagagatgaaattgcggtcgatcgagggcgtactcctgtggatgggcaacaccccttctggacatctccgcctgcgccgatgacgccttcctgacatagtctgacatcaagctgaaccatgctattctcggtggggagaagcacttgcctatgtgtgacgagttgggtagcacgagcattgttgaatatatggccggacgagccacccaaaactctatcatggttgcccaatggatgcttcaaactcctggtgcatcaagttacatgtgatgcattggaaaggacaagtttggtgaggaaatgaagaaaaacgctcaagctgcaggagttactgctcattactaccaggatgagactgctcctactggcacatg

SEQ ID NO: 1262 - DNA, 575 bp, Zea mays
  UNSURE (1)..(575): unsure at all n locations
  Clone ID: PAT_MRT4577_153097C.1
  unsure (1)..(575): unsure at all n locations
gcgtccggnaaaggcggcgactgnaggcgtgctcttggggatgggcaaccccctcctcgactctccgccgtcgtcgatgacgccttcctgacaaagtatgacatcaagctgaacaatgctattctcgctgaggagaagcacttgcctatgtatgacgagttggctagcaagagcaatgttgaatatagggccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatntaaagagaccagagaactgggcactagttgaaaaggcaaaatacatntacattgctggatttttccttacagtggtcggctgattttatccaggtagtttggtggagcatgcttgcagaaaataaca

SEQ ID NO: 1263 - DNA, 554 bp, Zea mays
  UNSURE (1)..(554): unsure at all n locations
  Clone ID: PAT_MRT4577_153098C.1
  unsure (1)..(554): unsure at all n locations
ttttggggagagncggnaatggcggggagggagggcgtgctcttggggatgggcaaccccctcctcgacatctccgccgtcgtcgatgacgccttcctgacaaagtgtgacatcaagctgaacaatgctattctcgctgaggagaagcacttgcctatgtatgacgagttggctggcgggggcggggttgaatatcttgccggaggagccacccagaactctatcagggttgcccaatggatgcttcaaactcctggtgcnncaagttacatgggatgcattggaaaggacaagtttggtgaggaaatgaagaaaaacgctcaagctgcaggagttactgctcattactacgaggatgagactgctcctactggcacatgtgctgtntgtgttgttggtggtgaaaggtcattgcttgcaaatctgtcngcggctccctgtttcaaatctgagcatctttagagaccagagaactgggcactagttgaaaaggcaaaatacatcttccttgctggatttttcctttccgtgtcgcctgattctatccagctagt

SEQ ID NO: 1264 - DNA, 252 bp, Zea mays
  Clone ID: PAT_MRT4577_153226C.1
acacacaccccgcacaccgcaccagctcagctcagctcagctgaccaagacaatcaatcatggctctgccgcgccagggtcgctgccgctgcccccctcctcctgctgctgctcgtcgccgccgcagcgcagctcgtgtcctccgtgtcgccggcagacagcgacattcgtcacaagtcctgccgcacgacccattacccgcccgcttgcgagcagagcctggcctcgtacaggagctcgtcttccacgcgg

SEQ ID NO: 1265 - DNA, 376 bp, Zea mays
  UNSURE (1)..(376): unsure at all n locations
  Clone ID: PAT_MRT4577_153353C.1
  unsure (1)..(376): unsure at all n locations
gtcaaaagagggcggncgggtgctttcttttccgaggagtggcttctcctccccctccggttcgggatcgggttcgtgaggctctccggcctacgggctcgtgggtgagcggatcgagatgagggcgtcggatgctgagtaccgctgcttcgtcggggacctcgcctggaccacgcacgaccactccctccacaacgggttcagcacctacggcgaagtcctcgagaccaggatcatcctccatcgggagacgcaccggtcccacgaatatgacttgtacaccttctcgacttaggaggcgatgaggaacgctatccagggcctgaacggtaagaagctggactgccgatacatcaccatctgcgagggacagcac

SEQ ID NO: 1266 - DNA, 350 bp, Zea mays
  Clone ID: PAT_MRT4577_153561C.1
atttagaccaactagcaacatataaagcacaattgtgttccaactatggcagccaacatgttgtgcctgcttatgctccttggtatttatgcaagtgctgctaccgataccattttcccgcactgctcacaagctcctatagcttaccttcttacaacatacctgtcaccagccgtgtattccgtgtgcgaaaacacaattcttcatccctacaggatccaacaggcaatcgctgctggcatcttacctttatgacccttgtttcttcaacaatcatcagccctattacattcattacctttggtgcattcatcggcacaaaacatcttggctcaacaactacaacaact

SEQ ID NO: 1267 - DNA, 721 bp, Zea mays
  UNSURE (1)..(721): unsure at all n locations
  Clone ID: PAT_MRT4577_153600C.1
  unsure (1)..(721): unsure at all n locations
gcacggcaccggaaaccgcggggcggcatgggccagctgggtgagcacggaggcgcntggcatgggtggcgggcagttccagcctgcgagggaggagcacaagacncggcgggcatcctgcatcgctccggcagctccagctccagctcgtcggaaggacgacggcnatgggcggaaggaggaagaagggaatcaaggagaagatcaaggagaagctgcccggaggccacaaggacgaccagcacgccacggcgacgaccggcggcgcctacgggcagcagggacacaccggcagcgcctacgggcagcagggacacaccggcggctcctacgccaccggcaccgagggcaccggcgagaagaaaggcattatggacaagatcaaggagaagctgcccggacagcactgagcggcgcctatacgtggctgtgctgtgctgtgctgtgctggcgcgtcaaagccgtaatgttcagtgttccatagataataagataaacccatgaataagtgtccctacccttgatcatgtgacagggacagggacagtttcctgtacttgtggggtgaatttgtacgtgtgatacggtaactgggtccgtgtactgttcatgctacgttttcctacgtatatagtacagcacttgcgagtggctttacttgtgtgcagacttcctaaaagtgtcgatattacctccatcagtaaatatgacccttgtgatg

SEQ ID NO: 1268 - DNA, 603 bp, Zea mays
  Clone ID: PAT_MRT4577_153667C.1
tttttgttttttttttttttttagaagctagaaaggactttcttatttctgggacgccacaaacatcatccaaaaaacttcattattgagctataactcataagcaatctaaaagggggaccaccaatgagggggttttgggggaacactggggggttttggaaagcaaggtgggtgaatgggagcaattgtggcaggtgtaagagggggccagcgttaggcgtagcgtgcaggtaaaacgggaacaactgtggtggtgtcaagaaggcggcaggggtcacatcagctagctgggtgaatgggagtagttgttgctgctgtaaataagcagcagaggtcaatgctgctaggtgggtgaatggaaaaaattgctggggggaggcagcaactagctggctgaatgggaattgtgtgggcaaataagcagcagagttcaatgcggccagttgggtgaatggaagaaactgaggtggctgagagtatgcagcaagggttgctagcacaaggtgttgtagttgttgtgccctgatgtgttgtgcgcccaaagggccaaagggactgctgtaatagggctgacgggtgttgggaggaacaagggggata

SEQ ID NO: 1269 - DNA, 1554 bp, Zea mays
  Clone ID: PAT_MRT4577_153677C.1
gcttactgggacctcgagccggccgggaacccccggcacctgtccgaattccagccgcccacctcacgcaagcggcaagcccacgggcgctctctctccccctgcgcctcgtcgcctctccaatccctctcgtcctctcgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctggagaggtcgtcgccgtctacttccaggggcgtcgtgtccaaggagagggagcgcctcgctgccgggaagctgccgtcatcgcttggcaaggcggaggtgtctgatggtgaggaatttgaaactgacagtgaagattctgatgtgagtggttccgagggagaggacacgtcctggatttcatggttctgtacattgcgaggcaatgaattcttttgtgagatcgatgatgactatatacaggatgattttaacctgtgtggtctgagtaatcaggtgccatattatgattatgcacttgatctcatcttagacattgagtcttctaatgatgacgggtttaccgaggagcaaaatgaattaatcgagtcatctgcagagatgctgtacggtttaattcatgcacgatacattttaaccagcaagggtctagctgcaatgttggagaagttcaagaactattatgactttggtagatgccccagggtgtactgctgtggccagccctgccttccagcagggcaatcagatgttcctagatcgagcactgtgaagatatattgtccgaaatgcgaagaacttaactatccaagatccaagtaccaaggcagtatccttttgatataatctccatacttccatttacatgtactggccgttttatgctatatccttcttaagcgatttatattttgaccaccctttggaactattgatttttttttgcaacatcgttttatgtgttctctggtctccatgccaacaccctggtgaaccacattgaacattccgtcagtcctgcttttctgtcgttgaactcttcctcggtaaataatggatatttgcaagctgccattacatgcccttaactttacccagacatcgatggatcatactttgggacgacattccctcatcttttcctgatgacttactcgcacttgaagccgcagaagccgtcacagcaatacactccaagggttttcggcttcaaacttcacaagccgtcatgacagagttgtagcttccgccagaagcacccctgtcacctaggttttagggagagcatcgtggccttcaaatactgttgtattattgatgtacgaattcgcgagcctgggcctcgctgtaaactattgtgaaattgtatctgttttccgatattattactgttgtgtaaccttggttctctct

SEQ ID NO: 1270 - DNA, 347 bp, Zea mays
  Clone ID: PAT_MRT4577_153694C.1
aagcttcctatagtcttcaccttcttcaccccgtatcctctcatccagcggtgtacttcggtatgtgaaaatcccatattcttcaactcctacaggtatccaacatggcatatcgcatgctggcatacttatcctttatcatcccttgttcctccaacatatcatcgagccctattacaatcagttactcttttggtgcatttaattggcacataaacatcatgggcacatacaactacatacaacttgtgctagcaaacgcttgctgcctactctcatcaacagcagtttcttccattcaaccaactaggttcattgaactctgcttcttatttgcaacaacaaca

SEQ ID NO: 1271 - DNA, 302 bp, Zea mays
  Clone ID: PAT_MRT4577_153777C.1
cctttctacagaatttcctgcttttgctgctggggctttgcagtcttacaaggtgggtgccgaggcaatatctaagattgaatcgctaccaggtgtgaagcatgcaggccttatgcaataccgcggtttaggaagtcttcgaccttacaggttatgactgggttgtggcttacattttccatgaagatgagcatggggggggggggggtgtgatcaccaaacgtggtattgagccctgtctagggctgcactatgcggccactgatatccctcaagctgccaagtttctcttgatgaagaac

SEQ ID NO: 1272 - DNA, 1804 bp, Zea mays
  Clone ID: PAT_MRT4577_153882C.1
caaggtggcggccagagagtagagatagagagagagtgggactatagagacgttaccgttgctgcttgttattattaacgccgccgccgcctcctgcattcgtatggtccgcgtcgtcacggggctcctccgtccgtaaggcaccgccgcagcgtctcggctggatcaacaggccggccgatccgtcttcttcccctcctcctgcgggtcggcgtttggggatcatggcggcgcgggcggctgacgagaacaggagaccggcggcagggaagcccgcgccaggcgtccgagacatggcgagccggcgcgcgctcacggacatcaagaacctcgtcggggctgccccgtacccctacgccgtcgccaagaagcccatgctgcagaagagcaaaagggacgaaaagcagccagcgttggcaagcagccggcccatgacaaggaaattcgccgcctccttggcgagcaagggccaacctgaatgtcagccgatcgtagctgatccagaacccgaagtttgtcaacagaaggaatcagtaggcgatggcaccgttgatattgacgtggaactctacgagctggtcgacggtagtgatagtgacatcgacatgggtgcgacagagaacaaggacattatgaacgaagatgaattgctcatggatattgacagtgcagactcggggaacccgcttgctgcaacagaatatgttaaagagctttacaccttttacagagaaaatgaggctaagagttgtgtaaggcctgattacatgtccagccaacaagacataaactcaaagatgagagcaattctgattgactggctgattgaggttcactacaagtttgaactgatggatgagacgctctttcttacggtaaacgtaatagatagattcttggaaaaggaagtggttccaaggaagaagctacaactggttggagtcacagctctgctgctcgcttgcaaatatgaggaggtatctgttccagttgttgaggaccttgtgctgatatctgaccgtgcctacacaaaagggcaaattttagaaatggaaaagttgattctgaacacgctgcagttcaacatgtctgttccaacaccttatgtcttcatgaagaggtttctgaaagctgcagatgcagataaacagcttgagctagcgtcatttttcatgctggagctctgcttggtagaataccaaatgctgaattatcggccttcgcatctggctgctgctgcggtttatactgcacagtgtgctatcaatcgttgccagcactggacaaaggtctgcgagtctcatagcagatacactagcgaccaactcctggagtgctcgaggatgatggtagattttcaccagaaggctggaaccagtaagctcactggcgtgcacaggaagtacagtacctacaagttcggttgcgtggccaagattttgcctgcgcagttcctgctggagtcgggagggacaccgcctccttcaggtgcaaactagttgaatcgacctattcaactgggtggattttttaaagtttttagaatactccatgaacaagatgcagaaaacatcgtgttgatgttgcccaaaagtgcatcgaatttctttggagagttatgattaacaactttttttttatctatgttgaatgacgagtgacggtcggtcacgttgtgcttgtgcagttatactgcggctaataacaaactgtccagttattctaaaaaacaacgaacgatgttcaggaaaacggtggaacctgcaaagaaaacaagttcttaatcaaaaaaaaaaaaaaaaaa

SEQ ID NO: 1273 - DNA, 683 bp, Zea mays
  Clone ID: PAT_MRT4577_153884C.1
gcagcttcggctcgttgcaagtgctggcgcctgcaggctgcagttccagtgatatacaggactggcatcgtcatttgcagctgcagctcacgtcttggcgagtgtcaaaacccaggagagagagcccaagcaagcgatggcgcgtatcggcgcgagtcatgtactcctcgtcgtcttgctgctctctgcggtcctgagctccggctcggctcgggttcccagagaacgaccggacgcgatgctgccggccggtcagacggcggcaatggccgagatgaccgtgcccggcgaagggcagagcagtgggccggcgtttggagtggcggcgcacgagtccaagcgcctgagccccggaggccccgaccctcaacaccattaggtgatggtagtaaccgtgatgagttattagctcgtcgtctggaagacggtttcttatgtatcgtacgtcgcctcgtcggatgagatagagagttgctgtggagatcatcatcaacaagcatgacatctccctaagcgttctttcagatactatatatccctagctgttcatgtttgttcggttgtaagcgcttcctttgtttttgttgtgcttgtgtgcgttttttcactagacgttgggatcataatttttgtatctattcgatatactgattatgatttaataaaatcttttctttattcag

SEQ ID NO: 1274 - DNA, 456 bp, Zea mays
  Clone ID: PAT_MRT4577_153932C.1
ccaaccgccccaaacaaatttatggataattaatactaaacagggggggcttaaaagcataaaaaatccggggtccagaatgtacccacagatatggcagacccggggcaacacccagggatccctgcatttgggttggacataacaaaagccagttaaggccaaagggatgtctttgtaccaatcctggatccactttttttttcgattaaggttttgagatacggttttccagggcggggaagttacttggggccaacatctttaagggcgcagatttgttcctcccccatagaagactggacagtaacaacaggatcctggccattttaaaacctttctttgatctgggccacaggagtttaatcagtggggagtctaagatcatccttagggttgccatttgaagtaagaaggctcacaaatccatcctttgatatataaatcagctgatac

SEQ ID NO: 1275 - DNA, 202 bp, Zea mays
  Clone ID: PAT_MRT4577_153979C.1
cggagacagcctggaggagttcctgaccaaggcgacgccggacaagaacctcatcaggctgctcatctgcatgggggacgccagggggacgatcgcagtcaaagtccgcgcagcgtcctgcggcgagagcgcctgtgtcaagtccttcggcgacgagcagctggccgtcgacaggcgcgctaacaggctgctctttgaggct

SEQ ID NO: 1276 - DNA, 2104 bp, Zea mays
  Clone ID: PAT_MRT4577_154033C.1
ctttgccgggggaaaagaaaacaaccgccccgcccccgcccccgcccctacgagcacgacggcctccggatgagggtcctgccgcgtcttttaccgtcagctggatgtcaaatcacaacgcgccctgtgacatccccaagccggcctccgtcgacgagttcctcgccaagaatggcaagaagaagaagtccttcatgtcgggcctcttccgcaagaaagggaggggcgcggacaagaagctgctctcgcggcgggacatcgtcttcgatttggaaggcagaagcggcgacaggatggacctcttggagacgtccgccgctgtccgcaagagcttctcagatcggcactgcacgacgcggatcgagaacctgacgctgagctgcctggattctcccaggagacccaatgtcgacacccgggagtaccgggtgtttgtaggcacatggaacgtgggagggaagcctcctgacagcagcgttaacctccaagagtttctgcagatcgaaggcttgcccgatatatatgtcttggggtttcaggagatcgtgcctctgaacgcgggcaacgtgctggtcgtggaggacaacgagccggcgggcaagtggatggacctcatctaccaggccctgaacaggccgccgccccaccaggacggccagtcctccggcgacgagctctcgccgccgccgtccacctcctcctcccactaccccagccggccgcaaggtgccgcccgcgaccccagcaacgccgccgccatccccaagacctccagcggcggcatgctctgcgcgcagaagccgccgccgccgctcaagatggtcagcaagtgctaccgcgtcgacaacgcgctggtgaagacgtgcacctgcatgtccgacccgtccaccatgcagctccgggcgcgtgagatgcgcgagttcctctgccgcgtcgaggccgccgccgcctcgccgggccgcggcgccgacgacgacgcgctggcctccatcgaaggcggcgaccagaggggcggcggcggcggcatgaactactgcctcgtcgcgaggaagcagatggtcgggatcttcctgtcagtgtgggtgcgccgggagctagtgcagtacgtcggccacctccgggtcgactgcatcggccggggcatcatgggccgcctcgggaacaagggatgcatcgccatgagcatgacgctgcaccacacgagcatctgcttcgtgtgctgccacctggcgtccggcgagaaggaaggcgacgaggtgcggaggaactccgacgtcgccgagatcctcaagaacgcgcagttcccgcgcatctgcaaggtgcccggccagcgcgtccccgagaagatcattgaccacgaccggatcatctggcttggggatttgaattaccgagtctcgttgagctacgaggaaactaagacgctcctggaggataatgagtgggacatcttattggagaaagatcagctcgcgatggagagacaagccgggagagtgttcaaagggtggaaggagggcaagatctacttcgcccctacatacaagtacaagcagaactccgactcgtatctatgggagaccgccaaatcgaagaagaaacgacgaacgcccgcatggtgtgaccggatactgtggcacggccaaggcatcgagcagctgcagtacatcaggggcgagttcaggctctccgaccacaggccggtctgcagcgtgttcgtgatcgaagccgatgtagatagcgggagcaagatcaggaagggctactcaacgctggacgctaggatccactgcgagtcccccgagatacccaagagacacagcttctacgatgacttctgaaattttggcccgtgatgctagttttgtctataacatagcagcttacaaagatcaggcacgtttgtagcgaaaaggctcaggtttctcaagcctaacacctgtcttaatttgtaccaagcggtatactaactgaaagtcaatggtggttactgcacagaacacaagtgaacgatggtattatttagggcacccccctacagtaatttcatgtcaaaaaaaaaacaatggtacgatttgacccaaaaaaaaaaaaaaaaaaaaag

SEQ ID NO: 1277 - DNA, 472 bp, Zea mays
  Clone ID: PAT_MRT4577_154109C.1
gagcgatgtcgagaacgcggccctagcttatttctgggcagccacccacatcatccaaaaaacttcattattgtaactataactcatagcaatctataagagggctcctccaatgatgggttgttgctagaacgctgctgtgttatgtcaaagcatgttggctgaatggctgtaatcgatgcagttgtaagagggtgccagcgctaggctcaaagcgcacgtggaacggcaacaactgttgctgtgtcaagaacgctatagggctcacatcagttcactggctgaatggtggtagctgttgctgctgtaaataagcatcagagttcaatgctgtcagttggttgaatggaagaaattgttgggggtaggcaccagctagctgactgaatggtagttgttgttgtacattagcaccacaggtcaatgcagccagttggttgtatggtagaaactgctcttgcttagagtaagc

SEQ ID NO: 1278 - DNA, 430 bp, Zea mays
  Clone ID: PAT_MRT4577_154174C.1
gcacatatatttagaccactagcacatagaaagcacaatagtgtaccaacaatggcagccaaaatattttgcctccttatgctccttggtatttctgcaagcgctgctacggcgaccattttcccgcaatgctcacaagctcctatagctttccttcttcccccgtacctctcaccagcgctgccttcggtatgagaaaacccaagggggggaccctacaggatccaacaggcaaaccaaggtggcatagttacctgtatcacccttggaccttcaacaatcatcagacctattacagcagctaccttcgttgcatttattggaacacaacatgaagggcaaacacctacaacaactagagctatcaaacctgggtaactactctcagaaacaggagtttattagattcaaccaacagaggtgagatgaa

SEQ ID NO: 1279 - DNA, 798 bp, Zea mays
  Clone ID: PAT_MRT4577_154234C.1
cccacgcgtccgcccacgcgtccgcccacgcgtccgtacgtagtagaggcaagcaaaagggcagggatagagcgccgccgagatatctagctagaagagcctagaagccggtgtagaggatcaggaggatgtctgggtcgtccggctccggcgtgtgggtgttcaagaacggcgtgatgcagctggagcagccggccgcggcggcgagccggaaggcgctggtgtacgtgccgacgaacgaggtggtgcggtcggtggaggcgctggagcggcggctgggcacgctgggctgggagcgctactacgagaaccgcagcatcgtgcagctccacaagcgcgacggcggcgccgacctcatcaccatcccgcgcgacttcgccagcctccgctccacccacatgtacgacgtcgtcgtcaagaaccgcgaccacttcaaggtcgtcgacgcttagccgccgcatcccgcataagctacgaccagaccaagcagctagctactagctagctccatcgtcgtcgaccaccgtcgtcgatctcgacatgcatgcgtgtgcactgcacaacggactgctagctgatgccagaaattatagtaagtctagcttatgtacgtatgcattgtgtgtgtgttcgtgcgtgggtacatgcatattgctcggctttggcttggcttaaattagttgcacgtctaattaagacgatcgagtttgtgtgtatgtgtgtgtgagagagaaagtgtgcgtaaaatattgtactcatgctctgctgttttctccattggcttttgggttttcctct

SEQ ID NO: 1280 - DNA, 620 bp, Zea mays
  Clone ID: PAT_MRT4577_154241C.1
cccctctcgagtttttttttttttttttttttttttttttttttttttttttttttttttttttttttttttttgggttttttttttttttggtttttttttgcagcaccaaaaaacacccttttttccttaggattaacttaaaacaaatcctgacgggggtaacagcatccatcgatccacagtccatgctggttgatgcatgggtctgctggaccccaggatgaacccagcactaacaactgacccagagggaccttgcaatcaaaaacccagaggggcaacaccaaacgagacgaacgaaaataaaccctttggactaggggaaacatcacgggagcgaacaggataacttggccgggcgggccccaccggtaaattcctccagttcccggcggagttgccgaaaccccccccacggttgccaccgccgtagccgccaccaccaccaccggagccaccggcgccaccggagccgccggcgccaccgccgaaaccgccgccgccattacggggcccgccaccgccgaaaccgccgcctccacgggcaccaccgtagccgccggcggcggttccaagggcggggggggactgggcctctttgacggggatgttgcggc

SEQ ID NO: 1281 - DNA, 436 bp, Zea mays
  Clone ID: PAT_MRT4577_154243C.1
gggagcaccaaaaagcaccattttttccttaggggtaacttaaaacaaatcctgacagggggaacagcatccatcgatccacaatccatgctgggtgaagcatgggtctgctggagcccaggatgaacacagcactaacaactgacacagagggaccttgcaatcaaaaacacagaggggcaacaacaaacgggacgaacgaagataaaccctttggactaggggaaacatcacgggagcgaacaggataacttgggcgggcgggccccaccggtaaattcctccaattcccggcggagttgccgtaaccccccccacgggtgccacccccgtagcccccaccaccaccaccggagccaccggcggcaccgtagccggcggcgccaccggcgtaaccgccgccgccataacggggcccgccaccgccgaaaccggc

SEQ ID NO: 1282 - DNA, 437 bp, Zea mays
  Clone ID: PAT_MRT4577_154376C.1
cccttaggattaaccttaaaataaagcctgaggggggtaacaacccccattgatccccagtccttgctggttgatccatggttttgctggacccgaggttaaacacagtcttaacaattgacccagagggacttttaataaaaaacacaattggtcaacaccaaacccgaaacgaacgaagataacccctttggactaggttaaacaacacggtagcaaacaggataatttggccgctcggccccaaccgtttatttcctccaattcccgtcggatttgccgtacccccccccacggttgccaccgccgtagccgccgccaccaccaccgtagccgccgccgccaccaccgtaaccggcgccaccgctgtagccgccgccgccataacggggcccgccaccgccgtatcctccttttccacggccaccaccgtaccc

SEQ ID NO: 1283 - DNA, 1472 bp, Zea mays
  Clone ID: PAT_MRT4577_154389C.1
tacctcgaggccggccgggacggcagcccgtttccgtccaccggaagtgccggcctttccccactcgctctcgctcccaacctcctcttcttcttcgtcttcggcgtgctccaggactgagtcccacgcgtcccacggtccgtcgcattccacccgcccccttttcgcgtgaacgcgccggcgccgcggatcctgccgtcacgaatggaggcgtggccggacgatttccgctgccccatcacgctggaggtcatgacggacccggtcatcctcccctccggccacaccttcgagcgccgcagcatccagagctggctcgacggggggcacctcacctgccccgtcaccaacctcccgctgccgccctccccgccgctcatccccaaccacgcgctgcgccgcctcatagccgccgtctcgccttccgcggcggcgtctctcgtccctgcggagggaggggcgcacgcgaggcaagaagcggtgtcggcggcggcggcggcggcggtgccagcccggcccgcgtcgcccgtgccggcgctgctgaggctggccaagtccggcgccgcagggcggaaggaggtgctggagtccggcagcgcggcggtgctgctgcggcacgcggaggccggggacgaggcggcggccagggcgctgctgcacctcagcctggacggcgacgacacgcgcgtgggcctcgtggcggacggcgccgtggacgcgctgtccgccgcggtgtcccgcggcggcgcggcggcggcgtccgcggccacggcgctgaccagcctcgccaccgtggacgtgaacaagtgcaccatcggggcgcacccctcggccatcccggcgctggcggggctcctccgccgcggcgggccgcgggagcgccgcgaggccgccacggcgctctacgagctctgcaagctgccggagaaccggcgccgcgcggtgcgcgagggcgcggcgcccgcgctcgccgacttcgccgccgccggctccgcgcgcgccgtcgaggtgctcggcctccttgcccggtgccgggaggggcggcaggagctgtgcagggtccccggcgtcgtgtccgtgctcacgggcgccgccgggagcggcaacgcgcgcgcaatcgagcaggccctgctcgtcctcaactggatttgctccgagagcaacgagttggcggtggaagcaatcaagctgcaggctttcgacctctgcgaggctctggtgaacgacgacaactgcaagatcgccaagaacgcggtcgacttggcccggacgctcgagaaagcgtagaattggattgggctgtctcccccaaaacatgagatgagattcgccatgggttttgattcaacacctgctcgattggtcgggtgttggcctcattgtacagaggtagcaacagcaaaggtgaaccttttatctttcttctcttactccgtttcatttccaagttgtagctgcgccgaaaggaggac

SEQ ID NO: 1284 - DNA, 253 bp, Zea mays
  UNSURE (1)..(253): unsure at all n locations
  Clone ID: PAT_MRT4577_15444C.1
  unsure (1)..(253): unsure at all n locations
tcgccccgcgtccgcgcctctcctgctcctagcggaggtgtccctcagaattagtgttcgcaatggcggccttcaacaagcttggtggccttctaaggcacagtgctctggtgagcggtattactggtggctcttntcctgcagtgtttaatgctgnacggcttatgtttaccaaggtggggagggggggtnttgactggggtgttgatgacttgaaactaaaagaagcttttagtaggtttggagaggttac

SEQ ID NO: 1285 - DNA, 194 bp, Zea mays
  Clone ID: PAT_MRT4577_154488C.1
tcggtcccctagccgccgccgccgctcgtcttcctgagaggtgccgggaccgaggatttggccgagttctaggtagagaatcgggtttacttgtcttagcccggggtctgctgcgtctggtggtggggaaggggagaaaatcgtgagatctttttcttatcatgcgtgcgaacttgggaatcaggggttttaca

SEQ ID NO: 1286 - DNA, 370 bp, Zea mays
  Clone ID: PAT_MRT4577_154566C.1
gggcccaacaagaaccaaaaaacataaaaattcaaaaccaataataatcctcgaagtacatgttcctcaatttcacaaatccaaacatccgggcacactaattgactacaaagtttgcgaaaagcgaaaagttaaacaacgggcgaaatcctttggcagaaaaaaacggggtttttaaaccctttggttaaccacaacattctccaccccaaaagctactttgtcattttggcgaacatgttgctgtaaaaattggcggcctttttggtggaccccttgaacttttccttcaggaacttatattccaacttgacatccctgttggcaggaacgatttccaaggcctttttgatatcggcccctgctaact

SEQ ID NO: 1287 - DNA, 661 bp, Zea mays
  Clone ID: PAT_MRT4577_154720C.1
cgtttctgctcctcgggttcgtcacccacggcaagggggtcctttcgcacgccgtcgccgcgggcatcagcgagctggagggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcaacttcgccggaaactgggtctactgggtcggcccgctcgtcggcggcggcctcgctggcctcgtctacggcgacgtcttcattggcggctcctaccagcaggtcgcggaccaggactacgcctaatttattcaccacaccatcgtctccgctctggatgaatggattcaaacccgtatcatcgtcgtttgcttttgctcctcgcgccacgttcaattaatggttgtgtatgcatgtatgtgccaatatgatgtgccgttgccctggtccattcatttccctttcttttttcggggtgaaatagatgtaaagatctcgtcttgcctgccgtactcgcgctgtgttggaaaaaatttggttttcgtttcaagtttgtt

SEQ ID NO: 1288 - DNA, 944 bp, Zea mays
  Clone ID: PAT_MRT4577_154721C.1
gcttcagccaatcccctcgagctcagatcgagcgcgcgccaagcaagtcttccggccggccgcgaagagcgcaataaagctaagatggtgaagctcgccttcggaagcgtcggcgactccttcagcgccacctccatcaaggcctacgtggccgagttcatcgccaccctcctcttcgtcttcgccggcgtcggttccgccattgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgtcgccgcgggcgacttcgccggaaactgggtctactgggtcggcccgctcgtcggcggcggcctcgctggcctcgtctacggcgacgtcttcattggcggctcctaccagcaggtcgcggaccaggattacgcctaatttattcaccactccatctccgctctggatgaatggattcaaaaccgtcgtcgtttgcttttgctcctcgccacgttcaattaatggttgtgtatgcatgtatgtgccaatatgatgtgcctttgccctggtcaaaaaaaccaaaaaaaaaaaaaaaaaggacg

SEQ ID NO: 1289 - DNA, 2296 bp, Zea mays
  Clone ID: PAT_MRT4577_154722C.1
ccatgcataaacgaagtcgaaacgaaaatcacctgttttttttccactccaaggcgatcgaaaacggcagatcggatgagatctttacatcgattttaccccgaaaaaagaagggaaatgaatacaaggacgacggaacagaccaggacgacacacatcattggcacgttacataacgtgatgaaatgaagagcaaagcaaatgacgacgccgatcgaaacgcgcggctgcgttggatgagctcaatccagacgaacggagcacactacttaggcgtagtcctggtcggcgacctgctggtaggagccgccgatgaagacgtcgccgtagacgaggccagcgaggccgccgccgatgagcgggccgacccagtagacccagttgccggcgaagtcggccgcggcgacggcggggccgaaggagcgggcggggttcatggagccgccgctgaagggccccgcggcgaggatgttggcgccgacgatgaagccgatggcgatgggcgcgatggtgccgagggagcccttcttggggtcggcggcggtggcgtagacggtgtagacgagcgcgaaggtgatgacgatctcgaacaccacgccctccagctcggtggtgccgccggagacgccgtgcgtcgggatggccttgccgtgggtcacgaacctgaggagcaggcacgccacggacgcgcccagcagctgggccacccagtagaagaggccggtgaggacggtgatgtggccgcccacggccaggccgaacgtcacggcggggttcaggtggccgccggaggtgttcgcggccacggagacgcccacgaagagggccagcgcgtgcgccaccgcgatcgccaccagtcccgcagggtccagcgcgccgccattcgtcagttgcccgaaggcgatggcggaacccacgccggcgaagacgaagaggagggtggcgatgaactccgccacgtaggccttgatggaggtgacgctgaaggagtcgccgacgcttccgaatgcgagcttcaccatcttgttgcgttgctcttcgcgaccgcaagacttggctggcgctctgaggctctgagcttgcccacgcgtccgcccacgcgtccgcccacgcgtccgcccacgcgtccgcccacgcgtccgcccacgcgtccggcagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaagcccatcccgacgcacgccgtcgccgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcaacttcgccggaaactgggtctactgggtcggcccgctcgtcggcggcggcctcgctggcctcgtctacggcgacgtcttcattggcggctcctaccagcaggtcgcggaccaggactacgcctaatttattcaccacaccatcgtctccgctctggatgaatggattcaaacccgtcgtcgtttgcttttgctcctcgcgccacgttcaattaatgcttgtgtatgcatgtatgtgccaatatgatgtgccgttgccctggtccattcatttccctttcttttttcggggtgaaatagatgtaaagatctcgtcttgcctgccgtactcgcgctgtgttgggaaaaattggttttcgttccaagtttgtttacgcaaagaaaaaaaaaaaaaaaaaaaaaaaaaactcgaggaagggcgccggtac

SEQ ID NO: 1290 - DNA, 414 bp, Zea mays
  Clone ID: PAT_MRT4577_154723C.1
cttcctccttcgaggagggaatttagggatatctatgtgatctttgagttgatggagtcggatctccatcaagtaataaaagcaaacgatgatctcacagcagagcatcaccagttcttcttgtaccagctgctccgtgggatgaagtacatccatgcagcaagcgtcttccatcgggatcttaagcccaagaatattctagccaatgctgactgcaagctgaagatttgtgattttggccttgcccgcgtttcattcaatgacactccatcagccatattctggacggattacgtggccactagatggtatcgagctccagaattatgtggctcctttttttcaaagggaagaatgttgtgcatcagttggatcttatgactgatctacttggtacaccttcagcagagtcta

SEQ ID NO: 1291 - DNA, 1047 bp, Zea mays
  Clone ID: PAT_MRT4577_154726C.1
cgaagagcgcaatcatgcaagacatgatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggtgggcctggtggcgatcgcgatcgcgcacgcgctggcgctgttcgtgggcgtgtccgtcgcggcgaacatctcgggcggccacctgaacccggccgtgacgttcgggctggccgtgggcgggcacatcaccatcctgacgggcgtcttctactgggtggcccagctgctgggcgccaccgtggcgtgcctgctcctcgggtgtcggacccacggcaaggccatcccgacgcacgccgtcgcgggcatcaacgagctggaaggcgtcgtgatcgaggtcgtcatcaccttcgcgctcgtgtacaccgtgtacgccaccgccgccgaccccaagaagggctcgctcggcaccatcgcgcccagcgccatcggcttcatcgtcggcgccaacatcctcgccgcggggcccttcagcggcggctccatgaaccccgcccgctccttcggccccgccgtcgccgcgggcaacttcgccggaaactgggtctactgggtcggcccgctcgtcggcggcggcctcgctggcctcgtctacggcgacgtcttcatcggcggctcctaccagcaggtcgcggaccaggactacgcctaatttattcaccacaccatcgtctccgctttggatgaatggattcaaacccatcgtcgtttgcttttgctcctcgccacgttcaattaatgcttgtgtatgcatgtatgtgccaatatgatgtgccgttgccctggtccattcatttcccttttttttgggggtgaaatagatgtaaagatctcgtcttgcctgccgtactcgcgctgtgttgggaaaaatttggttttcgttccaagtttgttaagtttatgcatggatttcttggctcctt

SEQ ID NO: 1292 - DNA, 2332 bp, Zea mays
  Clone ID: PAT_MRT4577_154729C.1
ggccgctttttttttttttttttttggaacgaaaaccaatttttcccaacacagcgcgagtacggcaggcaagacgagatctttacatctatttcaccccgaaaaaagaaagggaaatgaatggaccagggcaaaggcacatcatattggcacatacatgcatacacaaccattaattgaacgtggcgaggagcaaaagcaaacgacgacggttttgaatccattcatccagagcggagatggagtggtgaataaattaggcgtagtcctggtccgcgacctgctggtaggagccgccaatgaagacgtcgccgtagatgaagccagcgaggccgccgccgacgagcgggccgacccagtagacccagtttccggcgaagttgcccgcggcgacggcggggccgaaggagcgggcggggttcatggagccgccgctgaagggccccgcggcgaggatgttggcgccgacgatgaagccgatggcgatgggcgcgatggtgccgagcgagcccttcttggggtcggcggcggtggcgtacacggtgtagacgagcgcgaaggtgatgacgacctcgaacacgacgccctccagctcgctgatgcccgcggcgacggcgtgcgtggggatggccttgccgtgggtgacgaacccgaggagcaggcacgccacggtggcgcccagcagctgggccacccagtagaagacgcccgtcaggatggtgatgtggccgcccacggccagcccgaacgtcacggccgggttcaggtggccgcccgagatgttcgccgcgacggacacgcccacgaacagcgccagcgcgtgcgcgatcgcgatcgccaccaggcccgccgggtccagcgcgccgccattcgtcagttgcccgtaggcgatggcggaaccgacgccggcgaagacgaagaggagggtggcgatgaactcggccacgtaggccttgatggaggtgacgctgaaggagtcgccgacgcttccgaaggcgagcttcaccatcttgtcttgcttgattgctctcttcgcggccggccggaagacttgcttggcgcgcgctcgatctgaactcgagcgaattggctgctgccggacgcgtgggcggacgcgtgggcggacgcgtgggcggacgcgtggggcagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaagggcctagcgctgttcgtgggcgtgtccgtacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatccccacgcacgccgtcgccgcgggcatcagcgagctggagggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcaacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggttgtgtatgcatgtatgtgccaatatgatgtgcctttgccctggtccattcatttccctttcttttttcggggtgaaatagatgtaaagatctcgtcttgcctgccgtactcgcgctgtgttgggaaaaattggttttcgttccaagtttgtttacgcatggatttcttggctcctttatggttttgattcacgtctgccccgtaagtctatttctcaacgggaatttcatgcc

SEQ ID NO: 1293 - DNA, 381 bp, Zea mays
  Clone ID: PAT_MRT4577_154853C.1
attcggctcgagctcgagtccattattttcctcgatcgggagacgcaaaggtcccgcggcttcggcttggtcaccttctccacggaggaggcgatgcggaacgccatccagggcatgaacggcaaggagctggacggccaaaacatcaccgttaacgaggcccaatcccgcggtggccgtcgaggcagcggcggcggctacagtggtggccgtggaggcagcggctacagccgtggcgggcgccatgatggctgcagcggctactgcggtggccgacgcagctacggtggctgcggttgctacggtggtggtggtggcggatacagctgtggcaaccggggcggatgctacggatactaccacgggaactggaggaactga

SEQ ID NO: 1294 - DNA, 132 bp, Zea mays
  Clone ID: PAT_MRT4577_154868C.1
gggggaaagcaagtttttcataaacgacaaataacttgggcaaatcgcttcaaatgataatcagatagtgaggcaacaagaaaaactgttttggaacgccattgcctaccccagccgactacaccatttttt

SEQ ID NO: 1295 - DNA, 307 bp, Zea mays
  Clone ID: PAT_MRT4577_154932C.1
ctaccaaagcaggaagaggcttgctgagcagcggcctcgggtccgtggacagtttgtgcgacaatctgggcaagaagatcaagcagcacaaggttcagaaagatgacacggaccttctaatacgtacaacatggcatcttcatcgacagatctgacaattaggtggttcttcccattgcgcatcttcattgacagatctgagaattaagtggttcttcccatcactgatagtaacccattgattcccaacgttggagtactcattaaataagactagttgtcaatttctgtggtcgactcctgatta

SEQ ID NO: 1296 - DNA, 306 bp, Zea mays
  Clone ID: PAT_MRT4577_155037C.1
accacgcgttcgttcacgcgtacgtccacgcgtacggtcgtcgggggctccttgcctgggttacgcgatgggcagctcggtgtcgtcctccgcggcgtgctacagctgtgtgcgctcgctcaacagccgcgcgtcttctactgcggaccgtcatgccacctgcaactgcctcaatagcatgactggccggctcggcggcagcgttagcatggccaactccgccaacatacccggcaagtgctgcgactccgtcggcgtgcccatcagccttaccgtcgactgcaccaagatcaactgatcgttgga

SEQ ID NO: 1297 - DNA, 689 bp, Zea mays
  Clone ID: PAT_MRT4577_155113C.1
ttgggtacctcgaggccggccgggaagctcggtggaggccctcaagtccgacgcgctacgttcccctttccctttccgaagcttctcgaccccccatcccctccctgacatggccgacaacgcgaaggccgcggcggcgcatgcgaggccggagtcgtcgcaggaggaggaggaggactggaaggaggccgagggggacgtcgccgaagtcgaccgcgccgccaccaatggcgccggcgaggggggcgtgcccacagacaggccgatccgggtctacgccgacggcatctacgacctcttccacttcggccatgccaagtcgctggagcaggccaagaagtcgtgagaacaccgcccccaccctcctcctccgcctattgggcctgccgtctccggccgaattgaactgccccacgatctgcccctcgcgctggcgtggggggccgggcgctgttgcgtgctagcgtgcaatggtcgctttagcagcgtttgcggtggcgtctggatcgcgctccatcagacggttcggtgcgagattggcgctgagttgtttctccccacgtcttccctttgtggcatttttgtgatgagttgtcccacgcgtctagcagttcgggaatgtttttctatgagtaaattaccccgtgtgatgatttttgtgcaaaaaaaaaaaaaaaaaatttgcggcc

SEQ ID NO: 1298 - DNA, 857 bp, Zea mays
  Clone ID: PAT_MRT4577_155451C.1
tgcttgcaaatatgaggaggtctcagttccagttgttgaggaccttgtgctcatttccgaccgtgcctacacaaaagggcaaattctagaaatggaaaagttgattctgaacacgctgcaattcaacatgtctgttccaacaccttatgtcttcgtgaagaggtttctgaaagcagcagatgcagataaacagcttgagctagtgtcatttttcatgctggagctctgcttggtagagtaccaaatgctgaattataggccttcacatctggctgccgctgcggtttatactgcacaatgtgctattaaccgttgccagcaatggacaaaggtttgcgagtcacacagcagatacactggcgaccaactcctggagtgctcgaggatgatggtagactttcaccagaaggctggaaccggcaagctcactggcgtgcacaggaagtacagtacctacaagttcgggtgcgcggccaagattttgcctgcgcagttcatgctggagtcaggagggacagcaccgcctccttcaggtgcaatctaattgaatcgccctgttttaacggggtgggttttttttaaaaggttttagcatactctccgtgaacaagatgcagaaaacatcgtgttgatgttgctcaaaagtgcatcgaattttcttggagaattatgattaactgttttttttttctatctgtgtcctgaatgacgagtgacggactgttttgttaaaaaaaaaaaaaaaaagcggcctccctgttcatgaatgttgttggccccttgtaaagaaaaacaagtccctgaatcaaatggtcaaatggcccctttgtccaaaaaaaaaaaaaaaaaaccccagc

SEQ ID NO: 1299 - DNA, 148 bp, Zea mays
  Clone ID: PAT_MRT4577_155761C.1
catcaacacgatgttatctgcatcaagtgcacggagaatccaaaaaacctgaaaaaagccacccagacgaataggacgatacaactagtttggaccggaaggaggcggagtccatcccgactccagcaggaactgagcaggcaaaaac

SEQ ID NO: 1300 - DNA, 237 bp, Zea mays
  Clone ID: PAT_MRT4577_15580C.1
cctatagtgagtcgtattaatggacactactggcgcctctcctatcgtcgatgctgctcgtcgggctcgccgcgggctctgacgacgatgaggacggcggtcgtataaggaagccccatttcaactatggtaagtttaatgcggatccgtggaccgaagggcaggctacttcacaatgcgggcgtcactcgttaacacaacctactgagcgaggctcatggtgtgatgccgaccatc

SEQ ID NO: 1301 - DNA, 949 bp, Zea mays
  Clone ID: PAT_MRT4577_155911C.1
aaaaaatccgggatcattttctttcccttgctgggaggccttagtctcccttctctttctctcccagccgccagccgccgccgcactctcccagccgccagccgccgccgcactctcccagacgccagccgccgccgcaaaaaaccctaacccccaatccactaatggcgtcgagcagccccgaccttgccgacgacggcttcgcggcgccgcgcctcttctcgcagggtgtctcctacacatatgacgacgtcatctttctcccgggctacatcggcttccccgccgacgccgtcgacctctccacccgcctctcccgccgcgtcccgctatccatcccctgcgtcgcgtccccgatggacactgtctccgaggccgctatggccgcggccatggcatcactcggcgccgccgccgtcgtgcactgcaacaccgagccccactcccaggccgccatcgtacgcgctgccaagtcccgccgcctccccttcgtttcctccgtgcccttcttctccccgtcctcctccccgacgctcaacgatttcgctggcagcgagtacgccctcgtcaccgagcgcggagattcgctctccaggctcgtcggcatcgctgtcgcggccgatgctgcctcccgtgaggttcccatctctgtctcggagtacatgcgaccgacgccgcgctcagcctcctctgccttcgacttcgaggaagcagcaaccttccttgccgatgagggtctggattacgctcctctcgtatccgatgatggtgaggttgtcgatctcatcaccgccaaggacgtggagcgcatccggagttatcccaagctgggcaagccgtctctcggagccacgggaagtttgtagttgcggcttccattgggactcgtgagggatgacagggaagactggagcaactagttaaggcgggggcaatgctatcgtgattg

SEQ ID NO: 1302 - DNA, 2156 bp, Zea mays
  Clone ID: PAT_MRT4577_155915C.1
gctggccggggtaacagaccgagagaacccggggctggcgcgattgattctgggagctggccgtgaatctcggaaatccggtcaaaatccatcgctatccgcccacagaactacctccgatgtgcgcgcggatgaatctctagcgcgcgacctgctcctccgtctcccccgcgccgcgtgccctagagccgccgccgcagccaaaaaaaaaacccctaaacccccaatccatggcgtcgagcagcactgaccttgccgacgacggcttcgcggcgccgcgacttttctcgcagggtgtatcctacacatacgacgacgttatcttcctcccgggctacatcggcttccccgccgacgccgtcgacctctccacccgcctctcccgccgcataccgctatccatcccctgcgtcgcgtctccgatggacactgtctccgaggccgctatggccgcggccatggcatcactcggcgccgccgccgtcgtgcactgcaacaccgatccccacgcccaggccgccatcgtccgcgctgccaagtcccgccgccttcccttcgtttcctccgtgccctttttctccccgtcctccgccccgacgctcaacgatttcgctggcagcgagtacgccctcgtcaccgagcgcggagattcgctctccaggctcgtcggggtcgctgtcgcggccgatgctgcctcccgcgaggttcccgtctctgtctcggagtacatgcgaccgacgccgcgctcagcctccgccgcctttcgactttgaggaagcagcaaccttccttggccgatgaagggtctggattacgcccctctcgtatcagatgatggtgaggttgttgatctaatcaccgccaaggacgtggagcgcatccggagctatcccaagctgggcaagccgtctcttggagccaacgggaagtttgtagttgcggcttccattgggactcgtgaagatgacaagggaagactggagcaactagttaaggcgggggcaaatgctatcgtgattgatagttcacaggggaactccatataccagctcgatatgataaagtttgcgaagaagatgtatccggaggtggatttgatcggtggtaatgtggtgacaattgcacaggcccagaatttgattcaagctggtgtggatggattgcgtgttggaatgggatcgggctcaatttgtaccacccaagaggtttgtgctgttggaagaggacaggcaacagcagtgtataaggtttcatcttatgccaaggatcacaatgtaccggttattgctgatggtggaatttcaaactctgggcatattgtgaaagctctgtcgctgggggcatccactgttatgatgggcagctttttagctggtagtcatgaagctcctggtacttatgagtataaggacggccgccgagtcaaaaaatacagaggcatgggctctcttgaagccatgacaaaagggagtgatgcaaggtaccttggtgatacactcaagctcaaagtcgcgcagggcgttgttggagcagtagctgacaaaggttctgtactgaggtttattccttacacaatgcaagcagttaagcaaggattacaagatcttggtgcagattctctccagtcagctcatgatcttttgcggtcagagacactcagattagaggtgagaaccggtgctgcccaggctgaaggaggtatccatggactggtttcatacgagaagaaggcattctaggtccataactaaacaaagaagtattggaacgatagtggttagctgcatgatatggaagggggcgatgctcatttatcctacctggcaaaagctcagcagcttgtcagcaaagcttgtcgagttgggcagcaagtgtaccatctgcttggcgtcatataataataaacctctggcatcggaactgttgtataagctcacagcttgtcatctaaacatttttcccaattttgttaaaagagtaaaacatcaatggttgattgatctaaaaaaaaaaaaaaactttgccccgccatgttttaacctaccccaatgccgtaccttgtattattatgtgttcgaagaatggttgatgatagtggtttgtctctaaagttgacatcctggatagtgcgttactcccaattgaaaggctttcgt

SEQ ID NO: 1303 - DNA, 313 bp, Zea mays
  Clone ID: PAT_MRT4577_155953C.1
aaaaataaaacgacatttattcggggggcatcatatcacagggcattgcccggcaggaacacacagttacagtattattccaagcacactggacaaaaacccaaacagagaccacgggccggggtatcagttggccatggcaaccccaggcagctggaaagggcccccgccccggaagagccgctgctagaacatccacttcttgaagggggggaaaaggacccccctggagcaggggaacgggtgcggcccggggcaaccgaagaacgggccctcccccgccgggcagaagtaaaactggaacatcatgtac

SEQ ID NO: 1304 - DNA, 1784 bp, Zea mays
  Clone ID: PAT_MRT4577_155978C.1
cgtccgcccgacgtccgcgtctctctcctccgctcctcctccatcatagctcctggctcgcggctcagcttgccactaccagcaagcgctcgtcacccgtcggttctccccgagtagctcgtcgcgtcggcaatggagaatctgagatctcaaaactgccaccaaggtgttgccatggagggagtcaagtttgcgccggagaaggccaacaccaaccggagagccctcagcgacatcaagaacataataggaggcccacaccagcacttggcggtcagcaagagggctctgtcagaaaaaccagctgctgctgctgctgcaaatgctaaagatcaagctggctttgttggacaccgtccagtcaccaggaaattcgctgcaacattggcaacccaacctacagttgcccttctggacccaattggaagtgaaagactgaaaagaaacgctgatacggcatttcacacacctgcagatatggaaagcacaaaaatgacagatgacagtcccttgcctatggtgtcggagatggatgaaatgatgagtcctgaactgaaagagatcgagatggaagatattgaggaggcagcacctgatattgacagtggtgatgcaggaaattctctggctgtggctgactatgtagatgaaatttacagattttacaggaaaactgagggtgcaagctgcgtccctacaaattatatgtcaagccaaactgatataaatgagaagatgcgtggcattctaattgactggctcatagaggtacactacaaactagagctgttggaggagacccttttcctaaccgtgaacatcatagacagattcttggcacgtgaaaatgtggtgcggaagaagcttcagttagctggtgtaactgctatgttgctcgcgtgcaagtatgaagaagtgagcgtacctgtggtcgaggatctgatcttgatctgtgatcgtgcatacacaagggctgacattcttgagatggagaggaggatagtgaacacacttaatttcaatatgtcggtgccgactccatactgtttcatgagaaggtttctaaaggcagcacaatcagagaagaagctcgaactcctgtctttcttcatgatcgagttgagtcttgtcgaatatgagatgctccagttctgcccgtctatgctagcagccgctgccatctacaccgctcaatgcaccataaatgggttcaagtcctggaacaaatgctgtgaactgcacacaagatattcagaagaacatctaatggtttgctctaggatgatggttgaactgcaccaaagagcagctcatgggaaacttacaggggtccatagaaagtacaacacttctagatatagctatgctgcgaaatcggaacccgcaactttcttgctggatgcctgaacctaagcttgaactatacacactcttaactacttccatggaaagagtggaagggaggctgcttcgactaaactacagaagtgggatctatctgaatatatgcaacggctgttgcagcaaatatttggtggggctgggttggtgtgttgtttgttagttcaataacttaacattaatgaaacagtgtttgtgttgtttaggttttttttccaattatatcgattggaatttcatttgttgtatcctggccatcattctttactcatgtcatgtgacacctctgcgttttgaaaaataaacattgattatgtggatctgctgaaaaaaaaaaaaaaaaaaaaaaaaaaaaaaaaaaaaaaaaaaactcgaaagagggg

SEQ ID NO: 1305 - DNA, 857 bp, Zea mays
  Clone ID: PAT_MRT4577_156281C.1
ggttgacccacccgtccgcggacgcgtgggcgcgacgactcgtaccagaagtggcggtggcagccggcgggctgcgacctgccgcggttcgacgcgcggctgctgctggagcggctgcggaacaagcggctgatgttcgtgggggactcgctgaaccggaaccagtgggagtcgatggtgtgcctggtgcagtcggtgatccccgacagggggcagaagacgctgaccaagttcgtcaacggcgggtccagcaacgtgttctacgcgcacgagtacaacgcgacggtggagttctactgggcgcccttcctggtggagtccaactccgacaaccccaaggtgcacagcgtccccgaccgggtcatccagtggcacgccatcgccaagcacgcgcgcaactggatcggcgtcgactacctcgtcttcaacacgtacatctggtggctcaacacgctcgacatgaaagtcctgaagcaggggtcgtccttcgacgaccagggcggctccaccgagtacgtggaggtggaccggcccgtggcgtacaaggaggtgctcacgacgtgggcgaaatgggtggaccgcaacatcgaccccaacaggacgaccgtcttcttcatgggcatgtctcccaaccacatcacgcctgaggcttggggcaacaagggcgggatcaagtgcgccatggagacgctgccgatcgcgagcaaccgcagcgcggcgctggacgtgggcacggactggcgcctctacgcgggggcgcgggaggtgctgcccacgctgcgccgggtgcccgtccacttcgtcgacatcaccgcgctgtcggagctgcgcaaggacgcgcacaccctcgtgcacac

SEQ ID NO: 1306 - DNA, 2375 bp, Zea mays
  UNSURE (1)..(2375): unsure at all n locations
  Clone ID: PAT_MRT4577_156283C.1
  unsure (1)..(2375): unsure at all n locations
atgcagcagcggcgcaagtcggtgttcgcgtccgcgccgttcgcgatgaagcaggcggcgctgggagccggcgtggcggcgcgcaagaacggcgcgccgctgtcgctggccgcggtggtgttcgcgctcttcgtcttcgcgacgttcctctacaacgaggacatcaagtccatcaccgacttccagttcagctccggcgccatccgcgccaagtcccccgacctgcacctcctgcaggaggccgaggccgcggcgcacgccgccgtgaacaccctggccaagcgcggggaggaggtgatcgtgcgcgtcctcgaggtcgaggcgccgcccgtcgtcaacgctagcagcgtgttggcggccgccgcgaaggccaacgccaaggccaaggccaacgcggtggacgtggggcaggagaaggagcgggacgtgacgctcccgacggtgacggggggccgaggcggggccgacgaggcccggcggcgcgctgacgaggaggtcgctgagaaggccgcgtcggcgaaggcggcggcggccaccgccgctctgcgcggcgtggtgagcgtgccgcagacgtgcgacctgtaccggggcagctgggtgtacgacgaggtgagcgcgcctgtgtacaaggagggcgagtgcgagttcctgacggagcaggtgacctgcatgcgcaacgggcggcgcgacgactcgtaccagaagtggcggtggcagccggcgggctgcgacctgccgcggttcgacgcgcggctgctgctggagcggctgcggaacaagcggctgatgttcgtgggggactcgctgaaccggaaccagtgggagtcgatggtgtgcctggtgcagtcggtgatccccgacagggggcagaagacgctgacaaagttcgtcaacggcgggtccagcaacgtgttctacgcgcacgagtacaacgcgacggtggagttctactgggcgcccttcctggtggagtccaactccgacaaccccaaggtgcacagcgtccccgaccggatcatccagtggcacgccatcgccaagcacgcgcgcaactggatcggcgtcgactacctcgtcttcaacacgtacatctggtggctcaacacgctcgacatcaaagtcctgaagcaggggtcgtccttcgacgaccagggaggctccaccgagtacgtggaggtggaccggcccgtggcgtacaaggaggtgctcacgacgtgggcgaaatgggtggaccgcaacatcgaccccaacaggacgaccgtcttcttcatgggcatgtctcccaaccacatcaccagcatggcatctgcgaaaaagactgctgggcgtagggggaaaaagaaaaaacgggtacccgaattccgggtacccgtatccgacccgggattttcgggtactgaccgggtattagtgattccgtatcctacccgtatccgaggttcaatatccgggcctgaggcttggggcaacaagggcgggatcaagtgcgccatggagacgctgccgatcgcgagcaaccgcagcgcggcgctggacgtgggcacggactggcgcctctacgcgggggcgcgggaggtgctgcccacgctgcgccgggtgcccgtccacttcgtcgacatcaccgcgctgtcggagctgcgcaaggacgcgcacacctcggtgcacacgctgcgccaggggaagctgctcaccccggagcagcaggccgaccccaagacctacgccgactgcatccactggtgcctcccgggcctgcccgacacctggaaccagttcctctacgcccgcatcgcatccagcccatggcccaacgacgcccaggcccagcagtagggaccctgcacctgctcctccttctatcttcctcattcgccgcgggccggcgcctcacgacacaaaagggaggcctgggctgcaacggcccgcccatcgacgagagctctggcgtttctgcttcaagctagctgatcagccaaaagggggcgaaagacggcgtttctgctcgccgtctttgttttctttccttttttttaaacgatttttctttctcttttcgttgcataaaaggaaactggtccgtgttgttaaccttcgattctttggtccaaacaaaaatggatggtctggggtaaatgagggtgtgacgagcttagttgctcgctcatttggtttcttctcctaccaacgatgcctagggggaaagcaagagttgagcatgaagatgtgatgggggagaagcaaagctggggggagtacatgtaaagaagaatttttgcgttgtatttttatatgctgctgcagtgcacccaaggttaagagaggtataaagagcatttgttcttcaatcaaaaaaanaaaaaaaaccccnnnnnaaa

SEQ ID NO: 1307 - DNA, 1102 bp, Zea mays
  Clone ID: PAT_MRT4577_156356C.1
gggggaacacccgtccgataggataaagcttccaggaaatgcaatgctaggtgaaggaaaaccagagaaccagaaccatgccataattttcacacgaggaacattatatggaggagactttgaaaatgaggaatttgttgcaagagtttctgaagaaacatgatggtgtgagatatccatcaatacttggtgtaagagaacacatcttcaccggaagcgtgtcttctcttgcatggttcatgtcaaaccaagaaacaagttttgtgaccattggacaacgtgtacttgccaatcctttgagagttcgatttcattatgggcatcctgatatctttgatcgacttttccacctcacacgtggaggtgtaagcaaagcttctaagattatcaatcttagtgaagacatatttgctggatttaattcaacactgcgtgaaggaaatgttacacatcatgaatacatgcaagttggcaagggcagagatgttggtctcaaccagatctcactatttgaagcaaaaatagcaaatggtaatggtgaacagacgctgagccgtgacgtgtaccgtcttggacatcgttttgactttttcagaatgttgtcctgctactatactactattggtttttacttcagcacaatgataacagtttggaccgtttatgtattcctctacgggcgcctgtatcttgtcctaagtggccttgatgaagcattagccactggaaagaggtttatacacaacgagcctctccaggttgctctagcttcacagtcttttgtgcagcttgggttcttgatggcgctgcctatgatgatggaaattggtctagagagaggattcagaactgcattgagtgactttgtacttatgcagctccagttagcatctgtgttcttcacattctctcttgggaccaaaactcactactacggaaccacactgctacatggaggagctgaatatagagctacagggcgtggatttgtggtgttccatgccaagtttgctgagaattatcgattgtattcgcgaagccattttgtgaagggcattgaactgatgattttgcttattgtgtatgaaatatttgggcagtc

SEQ ID NO: 1308 - DNA, 2424 bp, Zea mays
  Clone ID: PAT_MRT4577_156358C.1
cattggtacctcgagccggccgggaaagcttcctggtgatccacatccagaggatattcagccacggatccccacttatccttcacttagggttgcgtacatcgatgaagtcgaagagcctagcaaagacaaaaataagaaaatagagaaggtttactactccgcattggtgaaggcagcagtaacgaagcctgatgatcctggtccagaaacttgatcagggatatatataggataaagcttccaggaaatgcaatgctaggtgaaggaaaaccagagaaccagaaccatgccataattttcacacgaggtgaaggtctccaaaccatcgacatgaatcaggaacattatatggaggagactttgaaaatgaggaatttgttgcaagagtttctgaagaaacatgatggtgtgagatatccatcaatacttggtgtaagagaacacatcttcaccggaagcgtgtcttctcttgcatggttcatgtcaaaccaagaaacaagttttgtgaccattggacaacgtgtacttgccaatcctttgagagttcgatttcattatgggcatcctgatatctttgatcgacttttccacctcacacgtggaggtgtaagcaaagcttctaagattatcaatcttagtgaagacatatttgctggatttaattcaacactgcgtgaaggaaatgttacacatcatgaatacatgcaagttggcaagggcagagatgttggtctcaaccagatctcactatttgaagcaaaaatagcaaatggtaatggtgaacagacgctgagccgtgacgtgtaccgtcttggacatcgttttgactttttcagaatgttgtcctgctactatactactattggtttttacttcagcacaatgataacagtttggaccgtttatgtattcctctacgggcgcctgtatcttgtcctaagtggccttgatgaagcattagccactggaaagaggtttatacacaacgagcctctccaggttgctctagcttcacagtcttttgtgcagcttgggttcttgatggcgctgcctatgatgatggaaattggtctagagagaggattcagaactgcattgagtgactttgtacttatgcagctccagttagcatctgtgttcttcacattctctcttgggaccaaaactcactactacggaaccacactgctacatggaggagctgaatatagagctacagggcgtggatttgtggtgttccatgccaagtttgctgagaattatcgattgtattcgcgaagccattttgtgaagggcattgaactgatgattttgcttattgtgtatgaaatatttgggcagtcataccgaggagctattgcgtacattttcatcacattttccatgtggtttatggttgtcacctggctctttgccccattcctgtttaatccttctgggttcgagtggcagaaaattgtggatgactggactgactggaataagtggatcagtaaccgtggaggtattggggtgccgccagagaaaagttgggagtcatggtgggaaaaagagcaggagcctcttaggcattctggaaagcgtggcactgttcttgaaatagtgctttcgttgcgcttctttatttaccagtatggtcttgtttatcatttgaacatcaccactcacacgaagagcgttctggtttattgcatctcgtgggtcataatctttgtcattttgctcgtgatgaagactgtatcagttggcaggaggaaattcagtgcagagttccagcttgtgttccggctgatcaaggggctgatattcataacgtttatctctattatcataatcttgatagcaatcccacacatgacagttcaggacatctttgtttgcatccttgcgttcatgccaactggatggggtttgcttctgatagcacaaactatgaggtcagctatttcacatatggggctatggggatcggtcaaggcgcttgcccgaggctatgagatcatcatgggcttgctgttgttcaccccgatcgcattcctcgcttggttcccgtttgtttcggagttccagacaaggatgctgttcaaccaggccttcagtagaggtctgcagatttctcgtatcctaggcggacacaagaaagaccgggctgcacggaacaaggagtgagtagccgagcagcgtgagcctggtagtgctgacctacatacaattcaaccatgccccacgtggcattatactttgtactggctattatgccaggttgtatattgcaaggaaaggaattcatctctgctaacgtgccagattgtatgtgtggcagcaggtactcgatcggtgagcactcctataccttttttattattatttatgggtaaagtcaaagaaactaaaaaaaaaaaaaaaaaagcccctagggcc

SEQ ID NO: 1309 - DNA, 2481 bp, Zea mays
  Clone ID: PAT_MRT4577_15635C.1
cattggtcacctcgaggccggcggggctgcttgccgggcgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccgcagtcccagcgcccggggacgacgcgtcgcccaagttcctgggcgtggagacgaagacaatcaagaagatcgtgcccctggggctcatgttcttctgcatcctcttcaactacaccatcctgcgggataccaaggacgtgctcgtcgtcaccgccaagggcagcagcgccgagatcatcccgttcctcaagacctgggtcaacctgcccatggcagtcggcttcatgctcctctacaccaagctcgccgatgtcctctccaaggaggcgctcttctacgccgtcatcttcccgttcatcgccttcttcggcgccttcgcctacgtgctctaccccatgcgcgacgccatccaccccactgcgctcgctgatcgcctcctcgcctcgctcgggcccagcttcctcggacccgttgccatcctccgcgtctggagcttctgcctcttctacgtcatggccgagctctggggcagtgtcgtcatatccgtccttttctgggggtttgcaaatcagattactacagttgaagaggccaaagagttctacccgctgtttggccttggtgccaatgtggccctcatcttctctgggcgcacggtgaaatatttctcaaacatgaggaagaatttgggtcctggagtggatggttgggcaatttcgttgaaggccatgatgagcatagtggttgtactgggtcttgtcatcaccggtatctattggggagtgaacaagtttgttattgataactcatctgtgcccgtggttgagcggaaaaagaaggacaagccaaagctcagcatgggtgagagcatgaaggttctgttgtcatctcggtatgtgagggatcttgctacattggttgttgcttatggaataagcattaaccttgtcgaggtgacatggaaatcaaaactgaaagcacagttcccaagcccgaatgaatattcttcattcatgggcgatttctcaactgccaccggcatagctacatttacaatgatgttgttaggaagagtgatcctcagaaagtttgggtggggagttgcagctacgatcacgcctgcagtgttactcctcacaggagttgggttcttctcactgattttgtttggtgagccattgactcctcttatgaccaagtttgggatgacacctttgcttgcggcagtctatgttggagcaatgcagaacattttcagtaagagtgcaaaatacagtctgtttgatccttgcaaagagatggcatacattcctttggatgaggatatgaaggtgaaaggtaaagcggctattgatgttgtgtgcaaccccttggggaaatctggaggtgctctgatccagcagttcatgatcctgtcattcggttctctcgcgaactcgacaccctaccttggcggaatactcctggtgattgtccttgcatggctgggtgctgtaaggtccctcgacctgcagttctcttccctggcgaagcaagagctcggcagagagaagctgctgaaaacgcaggccgtcgaaacggtcgccgaagtagtcggcactggaaacggttctctccaagaaactctagctagtgagccgtctgcaaatggcgcggccaccaaacagtcgcaagaacctgagagcacagcccctgagaaatcaggccagcagtctcaataagttctccccccaagaaatttagctagcacgagcctttggaggaaccggaagtttcttatctggagctactgaagaaggcaggaatcatgccagaaataagaaggcctgttcttcttctgttgttgtagtgtttttgtttttaaacttcgccgtatctgtagctgtttgtttcattccataggtatgaactgtttatgttcgttattaaaattttgggaggtctgcttcatcgtaatcttcattagcagctggtccttgttgtgaaaaaaaaatattttgcatggttttgatagtcatgggtaccatatatccaatttattcatattcctactaaaaaaaaaaaaaaaaaaacccgccccccccccctttttgttttttaattttgcagaaaaagaaactgtttgttttattccataggtatgaactgtttatgttcgttattaaaattttgggagtcccgcctcaaaaaaaaaaaaaaaaaaaaaaattttttt

SEQ ID NO: 1310 - DNA, 830 bp, Zea mays
  Clone ID: PAT_MRT4577_156363C.1
ggtccaaccctttgttaccaaccgcactgccgccgtccccgtctgcctccggccagcagccatggcgaggggttccatggccgcggtgctcgccgtcctggccgtggcggcgctccggtgcgcgccggccgccgcggagctcccgctggtggagcacccggccaagaacgacgggtcgctcagcctgctcgtcgtcggggactggggccgcaacggcacctacaaccaatccagggtcgcggagcagatggggaaggtcggggagaggctggacatcgacttcgtggtctccaccggcgacaacttttacgagaatggcctcaccggcgtccatgaccagcagtttgaagaatccttcaccaatatctacaccgcccagagcttgcagaagccgtggtacctcgttctcggaaaccatgactaccggggcgatgcgctcgcacagcttgacccggtcatgcgcaagctcgatgagcgattcgtttgcatgagatcatttgttgtcaatgcagagatggtggagttcttcttcatcgacaccactccattccaactcaagtactggactcaccctaaagacagtcactacgactggagaggagtggcgcctcgagaaaactacatagctaatctgctgaaggatttggacgaggcaatgaagaaatcaactgcaaagtggaagattgctgttgggcatcataccatgaggagtgtcagtgaccatggggacaccgaggagctcctgcaattgcttcttccagtcctcgaggttaatggcatcgacttctacatcaatgggcatgaccactgcttcgaacacattaccagca

SEQ ID NO: 1311 - DNA, 1271 bp, Zea mays
  Clone ID: PAT_MRT4577_15637C.1
caccggtatctattggggagtgaacaagtttgttattgataactcatctgtgcccgtggttgagcggaaaaagaaggttggacctggcagattttctattgttcttcttcttgtgtttatggatctctccttaacggttctgcgaacataacctttcaggacaagccaaagctcagcatgggtgagagcatgaaggttctgttgtcatctcggtatgtgagggatcttgctacattggttgttgcttatggaataagcattaaccttgtcgaggtgacatggaaatcaaaactgaaagcacagttcccaagcccgaatgaatattcttcattcatgggcgatttctcaactgccaccggcatagctacatttacaatgatgttgttaggaagagtgatcctcagaaagtttgggtggggagttgcagctacaatcacgcctgcagtgttactcctcacaggagttgggttcttctcactgattttgtttggtgagccattgactcctcttatgaccaagtttgggatgacacctttgcttgcggcagtctatgttggagcaatgcagaacattttcagtaagagtgcaaaatacagtctgtttgatccttgcaaagagatggcatacattcctttggatgaggatatgaaggtgaaaggtaaagcggctattgatgttgtgtgcaaccccttggggaaatctggaggtgctctgatccagcagttcatgatcctgtcattcggatctctcgcgaactcgacaccctaccttggcggaatactcctggtgatcgtccttgcatggctgggtgctgtaaggtccctcgacctgcagttctcttccctggcgaagcaagagctcggcagagagaagctgctgaaaacgcaggccgtcgaaacggtcgccgaagtagtcggcactggaaacggttctctccaagaaactctagctagtgagccgtctgcaaatggcgcggccaccaaacagtcgcaagaacctgagagcacagcccctgagaaatcaggccagcagtctcaataagttctccccccaagaaatttagctagcacgagccttttggaggaaccggaagtttcttatctggagctactgaagaaggcaggaatcatgccagaaataagaagggcctgttcttcttgtgttgttgtagcgtttttgtttttaaacttcgccgtatctgtagctgtttgtttcattccataggtatgaactgtttatgttcgttattaaaattttgggaggtctgcttc

SEQ ID NO: 1312 - DNA, 799 bp, Zea mays
  Clone ID: PAT_MRT4577_156652C.1
aatctcccttctcactctctccctctccatctccctccagatctcgctcgccatggacctcctcgacgcgggccaccgccactcgtcggaacttcccgccgccggcgccgacatggaaggcgcttcagtgcttccgctctccggagctgcctaccagccctacgtctccgagctcctttccttctccatcgagcgcctccacaaggagccggagctgctgcgggtggacggagagcgggtgcggcggcagatgcaggaagtggcggtggagaactacgccgcctttatagccgcctccgaggcgctctccttcgtgcgggcacagctcgaggggttcgacaagcacctcgaggcactggtagaggagatacccaatttaacatctggttgcaccgagtttgttgagtcagcacatcaaattttggaagagaggaagctcaatcagacattactagccaaccacagtaccttgcttgacctgcttgaaatcccgcaacttatggacacatgcatacggaatgggaactatgatgaggcactcgatctagaagcttttgtgagtaaaatttcgaagttgcaccctgatttacctgtcatccaaggattagctgctgaagtcaagaagacgatacaatcactaatttctcagcttctccaaaagcttcgatcaaatattcagttacccgaatgcctccgtattgtcgcacatttgcgccggattggagtgttcagtgaatcagaattatgcctacagttcctgcagggaagcttggctttctgggattcttgatgatctgga

SEQ ID NO: 1313 - DNA, 562 bp, Zea mays
  Clone ID: PAT_MRT4577_15666C.1
tctcggagcatctcaagccaccatcgaccttcaagtctcgctacataacagtgtaataaaaaaaacatgcgcaatggcgagcagcaccatgtgccctgctcctccacggctcttcgccggctaggccgtgaacgtgccgtgcgtcgtccgccttccgctaggcccgcgtgacgatgcgcaagacggcttcgaatgccaaaccagcggaggctttcggtagaccgtggtacggcccctaccgcgtgctgtacctgggcccactgtccggcgagccacctagttacctgactggcgagttcccgggcgactactgatgacacaccgcgcggctgtctgtggacccggagacgttcgccaagaatctggagctggaggtgatccactcccgctgtgacatgctgggcgcgctcggctgcatcttccccgatctgctcgcccgcaacggcgtcaagtttcgcgaggccgtgtgtcctcatgacggctcccagatcttcagcgagggcggactggactacctcgagaacccgagtctcatccacgcgcagagcatccttgctatctg

SEQ ID NO: 1314 - DNA, 193 bp, Zea mays
  Clone ID: PAT_MRT4577_156727C.1
aacacaaatgcttatatctagaaagcagcaccagcggagggcttttaaaaaagacatgggccagatcgccacggctgtggggcatgaacatgaaaggttatagatgttgatgtataaagcgcgagatggaatcagtgtaacattgtggcactgtcataatgttaaggcattaacattgacgacaccatgctcg

SEQ ID NO: 1315 - DNA, 2219 bp, Zea mays
  Clone ID: PAT_MRT4577_156728C.1
ggggattccacatcgtaaccactgaagacgaggcggcggacgagacggagagcagaaccgcgcagcgaagcagcagcggcgacaagccctcgcgtcggtagaggcgccgtccgccgtccgccccctcaactccggtagccgctggccgctgcaggtcgagtcccgtcgagccgactcgcgcttcccgatctgggtggccgcggcgccggcatggcgcggttcgaggtgaacggcaagtcggtgcaaggcgtggacttgctgcggcggcgccactggccgtcgcgcctcgacttctggcccttccttgcactctatgcgctctggctgctgcttgctgtcccggcgctcgacttcactgacgctctcatcatccttgccgcgctctccgctgctcacattctcaccttcctcttcaccgcctggttcgtcgatttccgtgccttcgtcgggtactctaaggtcaaggatatccatgccgctaacacgtgtaaggtgactcctgctaagttctcggggtcaaaggagattgtacctctgcacaaacagaaaaatgtggcctcaacttcagctgcaggtgagacagaggagatttactttgattttcggaagcagaggttcatctactcggctgagaaagataactttttaaaactccggtacccaacgaaggaattgatcggtcattatggcaagggcactggttatggaactgaggccaagattagcaccgcagtggacaagtggggcagaaatgtattcgaatatccacagcccacatttcagaaattaatgaaggagcaaatcatggaaccattttttgttttccaggttttttgtgttgttctttggtgcctggatgcgtattggtactacagtttgtttacacttttcatgcttttcctgtttgagtctactatggcaaagaataggctgaagacattgactgagctaagacgtgtgaaagttgatagccagattgtgttgacctatagatgtggaaaatgggttaaaattcctgggactgaactactaccaggagatattgtgtcaataggccgctcaactagtggtgaagatagatctgtaccagcagatatgctattgttagctgggtctgcaatagtaaatgaagctattcttacaggagaatctactccacagtggaaggtctcaattgctggacgtagtcctgatgatatgctatctataaagcgggataagaaccatatcctttttggtggcactaaagtattgcaacacactgcagataagtctgtaaatcttcgagcacctgatggtggctgtctagcttttgtattgaggactggatttgagactagccaagggaaattgatgaggactatcttattttcaactgagagggttactgcaaataacaaggaaagtggcctgtttatactctttttgctcttctttgcaattattgcgtctggttatgtgcttgtgaagggactagaggacccaacaaggagtagatataaacttttattgagttgttcattgattattacttctgtgatacccccggaattgccaatggaactttccatagcagtcaacacatctttaattgcattggctcggcgtggtattttctgcacagagccattcagaataccgttcgctgggaaggttgacatatgctgctttgataagacagggactctgacatcagatgatatggaattccaaggtattgttacattggaaggtgacactgacttaatatctgatgcaaataagctgcccctccgaactcaagaagtgctttccagttgtcatgcactggtatttgttgacaacaagctggttggcgatcccctagaaaaggctgctataaagggcatagactggatctacacatctgatgagaaggccatgtccaaaaagcctggtggtcaacctgttcaaattgtgcacagataccattttgcttctcacttgaagagaatgtctgttatcgtccgtattcagcagaaattttacgctttcattaagggtgcaccagagaccatccaagagaaattagttgatttacctgctgcatatgtggagacatataagaaatacacacggcaaggttctcgggtcttggctcttgcatataaattgcttcctgagatgcctgtaagtttctgttgatattaatcatgtttgcctatagcctttcttatctagtattctgttattcttttgtc

SEQ ID NO: 1316 - DNA, 327 bp, Zea mays
  Clone ID: PAT_MRT4577_156763C.1
ctggcttctcctccccctcttaccaagtcctcttcgggttagggttacttagggctttgtggaggggcgattgcagccgctgatgtggagtaccgttgcttcgtcggcggacttgcctgggacaccatcaacaagtcgctggagaatgccttcgcctgctaccgcgagatcctcgactccaaggtcatcaccgaccgggatgacggtgaggtctcgcggattcggcttcgctaccttctgctacgagaactccatgctcgactctatcaagaacatgaacggcaaagagctcgacggtcgtaacatcaccgttaaccatgcccagtc

SEQ ID NO: 1317 - DNA, 514 bp, Zea mays
  Clone ID: PAT_MRT4577_156772C.1
gggggggggggggggggtttttttttttttttttgttttttttttttttttgcgaacaaaaaccctgctcattcttctctcggctcgtttcatagcgggggccaacaaaggggaacaacaggggttcccacccccaatccaaaggttgaacgggcactaacacggggaccgaagcgaacgggaaccccatactttagatagataagataacccggccgaagccaggatgggcccacacattagtccctccagccgccgccgccgccgccgtagccgccaccaccaccctcgggccgaccggcgtagccgccaccgcctccgtagccggcgccaccacccttgggccgaccggcgtagccgccaccgccgccataaccgccgtcacggggcccgccaccatagccgccgccgccgggaccgccgccgtagccaccggcggcaccggcaccggcacgggactgggcctggttaacggggatgttacggccgtcgagctccttgccggtcatgttct

SEQ ID NO: 1318 - DNA, 830 bp, Zea mays
  Clone ID: PAT_MRT4577_156775C.1
cagaggtgggctggcttctcctccccctcttatcaagtcctcctcgggttagggttccttagggttttgtggaggggcgatggcggcggctgatgtggagtaccgttgcttcgtcggcggacttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggcggcggcggcggcggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtggccccatcctggcttcggccgagttatcttatctatctatagtatcgtgttaccgttcgcttctgtcaccgtgttagtgtccgttctacctttggattaggtgttggtaccccttttgttcgctttggttgctcccgctatgaaacgagacgagagaagaatgagcaaggtttttgttcgcatctattgttgtccaatgatattgatatattgttcccctgtcaaaaaaacacacaaaaaaaaaaaaaaaaaaaaaaaaacaacc

SEQ ID NO: 1319 - DNA, 658 bp, Zea mays
  Clone ID: PAT_MRT4577_156792C.1
gaccctcgagttctggccggggtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggacgtagacatcaccgataaccaggcccagtcccgtggcggcggcggtggcggcggtggctacggcggcggtcgcggcggcggcggctatggtggccgtgcgccgagactcatgttatggcggcggtggcggctgcggcggtcggcgcgagggtgggggcggcggctaccgaggcggtggcgggttcggtggtcgacgcgaggcgtggtggaggcggctactgagggggcggaggcggctggagggactgaggtgtggtcccatcctggcttcggccgaggaatcttatgtatctatagcatcgaggtaccgtgcgcttatgt

SEQ ID NO: 1320 - DNA, 1172 bp, Zea mays
  UNSURE (1)..(1172): unsure at all n locations
  Clone ID: PAT_MRT4577_156793C.1
  unsure (1)..(1172): unsure at all n locations
gggtagggcttcctcactccctcgtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggcggctggagggacaagcggtcgttgccccgtggacgcgctgaagctgggcgtgtgcgccaacttgctgaacgggctgatcaacgcgaccctggggacgccgcccagnacgccgtgctgcacgctgatccaggggctggcggactggaagggcgcggtgtgcctctgcaccgtcctcagggccaacgtcctgggcatcaacctcaacctgcccatcaacctcagcctcctcgtcaactactgcggcaggcgcgtcccctcgggcttccagtgcttctgatcacgcccatccactcgatcgatccatctgcaggctaaataatttctccaagctgctagtatacgtacgtacgttgatatatatgatgtagtattatatatatgtccatgcatgcaatgcatctcgtcgtccatcgcatgttgtatcgcagcatgttgttgttgatgttgtttttcgatgatcctgtctctgttataaatatcattattattacagtacgtgtgtgacctgaatgtttgtatttggcctgatgcatgcacattcatggttcagatttttagcgacatctcgctgaattaaaaaaaaaaaaaaaaaataaaat

SEQ ID NO: 1321 - DNA, 784 bp, Zea mays
  Clone ID: PAT_MRT4577_156873C.1
ggccgagaagcacgtaaataaatttcatttttccccctgtcgtcctcctctgcttaactcccttcacctccacctccgcctcggcgtcgtcgtgcgcttcgatctctccccccatttccacgcggagaggaggcgtcggcgcaataaaaggcggcgcttttgcatcgcccctccccggcatgcgtagctagcctcgcggctggcccccacgccatgcagaccaccgggcccgcatcgccggataagccgccagttgttgacccggaggccgatgacaaggtggaggaaggggcgcgggcgaaggaggacgatgcggcgaaagtgagcggcgaggatgaggatgaggaagagcaggaggggaggagaggcaggcggcagcggcgccggcgaggcggtgcggcgggggacagctccgtggccatggtgaagcgggagctgctcgcgcgctgcttgacgtgcccgctctgcgaccgcctgctccggaaggccaccaccatctccgagtgcctccatacattttgtagaaattgtatctataataagatcaatgatgaggatctggaccactgtccagtatgtaaaattgatctgggctgcactccagtcgataagcttagagctgatcacaatatacaggatgtgagatcaaaagtttttcccttcaaaaggaagaaggttaatgctgaagaggcagaatctcccattatgctacctgttaaagttaaagagaggtctatctcatcgttggtggtcaatacacctagagtaacccagcagcttcaca

SEQ ID NO: 1322 - DNA, 602 bp, Zea mays
  Clone ID: PAT_MRT4577_156911C.1
ccggccgggatcacttatagtccccattcgcacctctctccatctccctgctcctccgacttattgttgatccagccaagccagggatcgacatgaacgactcggaggagcaccacttcaaattgaaggccgacgccggagcgttcaagacctacccgcagcaggctggcaccgtgcgtaagaacggatctatcgtcatcaagaaccgcccctgcgaggttgaggaggtttctacctcacagactggccagcatggacatgccaaatgccactttgttgccatagatatattgaacgggaaaaagctggaagatattggtgcttcgtcacacaactgggatattccgcatgcgaaccgtactgatgctgatctgatcgatatatcacatgatggattggtgagccttcttacttcagatggcaacactaaggatgatcttatactcccaactgatgagactcttgtggcccagatcaaggaagggtttgaaagtggcgaggctcttgctgcgactgtccagtctgctatggaggaggagcagatctgcgcgctgaaggatgttggtacccagtaactgcgctgccttggaatactgtatctc

SEQ ID NO: 1323 - DNA, 617 bp, Zea mays
  Clone ID: PAT_MRT4577_156944C.1
acctttcttatcttctggggagccacagacattatacaaaaaactttattattgaactatacctcataaaaaatctaaaatagggcaccaacaatgatcaattgtaagaaaaatgctggaggctttgtaaaagcaagctgcttgaaaggaagcaaatgttgcagttgtaagagggatccagcgttaggcgcagcatgctgtctgaacggcaacaactgtgactgaatcaagaaagtagcatgtattacaacagctagctgtctgaatgaaattacttgctgctgctgtaaataaacataatagatcaatgctgccagactgtataatgtaagaaatagctgatgctaggcatcaggtagctggctgaatggtagttgttgttgttgcaaataagaagcagagttcaatgcagctagttggttgaatggaagaaactgctgttgctgagagtaggcagaaaggttcgctagcacaagttagttgtagttgttgtgccctgatgttttgagccaataaatgcaccaaaggtagactgatgtaataaggctgatgatctgttggaggaacaagggtgataaaggtaagatgccagctgtgattgcctgtttggatcctgt

SEQ ID NO: 1324 - DNA, 136 bp, Zea mays
  Clone ID: PAT_MRT4577_157023C.1
cccaaacatctcaatttacatctttacaacattacagggtttcatatgggcaacagaaatgcttacgacatcaaacaaaatcatccagtcaggaaaatcacatacgcatcatcaggcattgactggtttgccctaa

SEQ ID NO: 1325 - DNA, 304 bp, Zea mays
  Clone ID: PAT_MRT4577_157113C.1
cggcttgagtgttgctacctcaaagactggggagcatggtcatgccaaatgccagggggttgccatagacatatacaacgggaaaaagctcgaagatattggtccttcgtcacacaactgggatataccgcatgtgaaccgtactgagtaccaactgattgatatatcagaggatggatttgcgagccttcttacttcagatggcaacactaaggatgatcttagactcccaactgatgagactcttggggcccagatcaagggagggtatgaaagcggcaaggatctatgtgtgactgtccaa

SEQ ID NO: 1326 - DNA, 579 bp, Zea mays
  Clone ID: PAT_MRT4577_157123C.1
cgatccaattgaacttgctctccctccaacaagctaattaaggccggtcatgcctcttctagctcgtttcattatccatggcggaggagaagcaccaccaccaccacctgtgccaccacaagaaggacgaggagcagatcgccgtcggcgggtacggcgagtccgccgtgtacacggaggccacggtgaccgcggtggtgttcacgggcgagaactagttcgactagtacaagaaggaggagaaggagcacaagcacaagcagcacctacgttaggccggcgccatcgacgcctgcaccttaaaactctaccagaagcacgaggcgaagaatgaccctgagcacgctcaccttcacatgatcgaggaagacgtcgctgttgaagatgacgtcggctccggcggcttctccttccacgagcaccacaatgaagaagaaggaccacaaggaggccatagaggtctgctgccagaataagcaccacttattcgtctgattgatcctcccctatcgacatccctccacgtgtgctactcttgcgtgtgagagtgatattaaacgcccaccgtgttgtgcgcgc

SEQ ID NO: 1327 - DNA, 1661 bp, Zea mays
  Clone ID: PAT_MRT4577_157125C.1
tgacggccttcactgcacactacaatcaatcagccggcttttcctctcttcccctcgacagaagcccccaaatccgataccttcccctatccacctcgagtcccttccttccttagcggcggcgcgaaggcggcggagccatgggcggagtcggcgaaggtgacgcgtgggcggatcaggagcagggcaacggcgggggcagccgtggtgttggcggtggcggcggcgaggcgaagcggtcggagatctacacgtacgaggccgcctggcacatctacgcgatgaactggagcgtgcggcgcgataagaaataccgccttgccatcgccagccttctcgagcaggtcaccaaccgcgtcgaggtcgtccagctcgatgaggcctcgggtgacatcgcccccgtcctcaccttcgaccatcagtacccgcccaccaagaccatgttcatgccggacccgcacgcgctccgccccgacctgctcgccacctccgccgaccacctgcgcatctggcgcatcccgtcctccgacgacgccgaggacggcgccgcctccgccaacaacaacaacggctccgtccgctgcaacggcacccagcagccgggcatcgagctacgctccgagctcaacggcaaccgcaacagcgactactgcgggccgctcacctccttcgactggaacgacgccgatccgcgccgcatcggtacctcctccatcgacaccacctgcacaatctgggacgtcgagcgcgaggccgttgacacccagctcatcgcccacgacaaggaggtctacgacatcgcctggggcggcgcgggggtctttgcctccgtctccgccgacggctctgttcgcgtctttgatttacgggacaaggagcactccacaatcatttatgagtctggttcaggtggcagcagcggcggcggttccaactctggcgccggagatggtgggactgcgtccccgacaccactcgtgaggttgggctggaacaagcaggacccaaggtacatggccaccatcatcatggacagccccaaggtggttgtgcttgatatccgctacccaacactgccagtggtagagctacaccgtcaccatgcccctgtcaatgccattgcgtgggcacctcactcttcttgccacatctgcacagctggggatgacatgcaggcactgatatgggatttgtcgtctatgggaactggtagcaatggcagtggcaatgggaatggtaacacagccgctggagcagcagcagagggcggtcttgatcccattttggcatatacagcaggggcagagattgagcagttgcagtggtcggcgacccagcctgactgggttgcaatcgcattcgccaataagcttcagattctcagggtctgatttcctagttccaccctgtttcagtgaggagtaaaaaatgctaaacttggataatgagctgatgcccggaggataatcttgcaattgctttactgttgcttatttatgttgtggacaactgatattcatggcgggttagttctagaaatagaacagaagactttctagttagaagctgaattgtcaatgaatttggtttgtagagtaaggaactgctctggtgttagcgatggtgataatgggaactgaatttagtttgttctaaaaata

SEQ ID NO: 1328 - DNA, 428 bp, Zea mays
  Clone ID: PAT_MRT4577_157295C.1
attcggctcgagctcaacagccacagtattttctgtccgacatgacagcaccatgggtgaggaggtggccaagaaggtggaggcggatgccaccaaggagcccgaggcgtgagcgaaggacgacgtagccagttacaaggccgtcattcacgtgaccgacccgacgccggcctcgccgacggccgacgactccaaggccctggtcatagctgagcaagttgcagcttaacctgctcctgagaagcctgcacctccgacgcaagggggctccactgacagggatctcgctatagcaaggggggaaacagataagaggaactttatgatcaaagcttgggaagagaatgggatgacaaaagctgacaccaaggctgatgacaaagtatccgctattggtttatgtgaaaactcaaacaaagcacccatag

SEQ ID NO: 1329 - DNA, 2516 bp, Zea mays
  Clone ID: PAT_MRT4577_157312C.1
aaactggcatacgatgagcagcccaccagctccggtttcttccgactgcgagcttccaagtggcgactgcccgagtgcgagaagagggagagaagcggttgtcggaatccactccggccaggggtgcggaggtcggaatggggggaggagcggatgaggtggtgaaggtggtggatttggaggacggtgaaggggaggaggaggcagaggccgccgcggcggagggatcgagcatggagatggggatgctgccaaggatgccggtgcgtgtgctgctcgccgaaggcgacgactccacgcgccacgtcatctccgcgctgctccgcaagtgcggctaccgagttgctgcagcctcagatggtgtgaaggcgtgggacctattaaaggaaaaatctttcaaggtagaccttgttttaactgaagttgaactgcctttgatgtctgggttcctcctgttatccacgatcatggaacatgatgcgtccaagaacatccccgttataatgatgtcttcgcatgactcagtaagcatggttttcaaatgcatgctaaagggtgcagcagatttccttgttaagccgataagaaagaatgaattaaggaacttgtggcagcacgtttggagaaaacaactggcaaacggtgggcctaatgttcagcacatacaacgagaagagaatcttgcagaaagaatccaacagaagactggtgtgacaaaagctgataatttggacagagatgtgccctgtaaaaatagagaatgcagtgaacaagaaagtgatgctcaaagttcttgcacaaggtcagagctggaggctgaaagtaagcaaacagacaacattttggagtataagcaatcaactcaaaggcacttgtctattcctagccacaagaatgttgagctaaatggacagaccaaaatacaaagagctaagggtaataacttgatcccagcaagcgaagacgatttatcgccaaagaaaagaacgtgtttgaatgagaataattctgagagagcttcaagagatatggagctagtccacattatggaaaatcagcagaagtataacacacagtgggaggtggatactatgagaacaacatctaggggaaatgatgagaagggctccatcccagcacatcagttggagctttctcttagaagaactgactacggaaaattagagaaccacgagaaaaatgatagaagaacactgaaccattcaacttcctctgcgttttccttgtataattgcagggctgtgccaaccttaggaaatgctggtgatggtcaattatgcagcacctcagaaacactagtggatgttgaaaataaaaatggagattcagcagatccctctcaagacatgactgaaacaaatcgtcctcctattagagttgttcctgtccctgtccaaggtctcacatttgatgggcagccattctggaatggtacaccagtggcatccctattctactcacagtcaactcctcccatttggaatagcaaaacatcaatgtggcaagaatcaaccccacaagcaacttcactgccacaaaaatctccacagaatgaaccaaatgaaatgggggctaaaccagttataaatgcaggggaacaatttgccatgggtcctcccagtgccagtgggaagcagctgcatgttgaaattcttaatgatgatccacggcatatttctcctatgactggtgaaagtggaatcagtaccgtgctagacagcaccagaaatactctgagcagtagtggctgtgatagcatttccaaccagatcactgcccctactgaatcatccaatgtatataaggatgttcctgaaaccccaagcgccgaagggtcacggcatctgagccagcgtgaggctgcactgaacaagttccggctaaagaggaaggataggtgctttgagaagaaggttcgataccagagccggaaattactcgcagagcagcgtccacgggtcaagggccagtttgttcgtcaagatcatagcatccaaggaagctagggtccagttactgagctggaactctattctattatctaaaaaaagtcactgcaagtgactccactgcggtctgcgggtatcctgatgtcagattttgccgaagagttggaagcagtcacactgagttacagtttgctctgtatatttgctgaagtttgtaatatatgtatgtataggctaacgctgttctttcctaggttaggcacaggacctggcacgtttgaaggtttgtcagtaggcgttagaaaatacaggcatactttgtttcaggtcaagatgagatgtgaccttcagtagcgcatgtgtgctttaagtcttgtattacgtaattaagttgtttgatgtttcgggttagatgtacgctccgtggatgaaatgtaaaggatgtccaccaaaacatgcttgtttccgtgcagcttgttgcaatgaacatcgttggcctggtttctgttgatgctctccaaaaaacacccccaaaagaatagatac

SEQ ID NO: 1330 - DNA, 2436 bp, Zea mays
  Clone ID: PAT_MRT4577_157315C.1
cgagaatagggagagatcagacaagctgttgtcggaatccactccggcgaggaggagtgctgaggtcgaaatggggggaggagcggatgaggtggtgaaggtcgtggattcggaggacggcgagggggaggaggaagaggcagaggccgcggcggcggaggggtcgagcaaggagacgccgatgctgccaaggatgccggtgcgcgtgctgctcgccgagggcgacgactccacgcgccacgtcatctccgcgctgctccgcaagtgcggctaccgagttgctgcagcctctgatggtgtgaaggcgtgggacatattaaaggaaaaatctttcaacatagaccttgttttaactgaagttgaactgcctttgatgtctgggttcctcttgttatccacgatcatggagcatgatgcatccaagaacatccctgttataatgatgtcttcacacgactctgtaagcatggttttcaaatgcatgctaaagggtgcagcagatttccttgttaagccgctaagaaagaacgaattaaggaacttgtggcagcacgtttggagaaaacaactggcaaacggcgggcccgatgtgcagcacatacaagaagagaatctcgcagaaagaatggaacagaagactggcgtgacaaaagctgataatttgaacagtgatggtccccataaaaatagagaatgcagtgaacaagaaagtgatgctcaaagttcttgcacaaggtcagagttggaggctgaaagtaagcaaactaacaacattttggagtatatgcaatcaactgaaaggcatttgtttattcgtagccacaaggatttagagctaaatggagagaccaaaacacgaactaagggtaataacttgattccaacaagagaagacgatttattgccaaagaaaagaacatgtttgaatgacaatgattctgagagaacttccagagatatggagctagtccacattatggacaatcagcagaagcatgacacacagagggatgtggatactatgagaacaacatccaggggaaatgatgagaagaactccatcccagcacaccagttggaactttctcttagaagaactgactatggaaaattagagaaccacgagaaaaatgatagaagaacactgaaccattcaacttcatctgcattttacttgtataattgcaggactgcgtccagcttaggaaatgctggtgatggtcaattatgcagcacctcagaaacactagtggatgttgaaaatagaaatggagatttggcagctctgtctgaagacacgactgaaacaaatcgtcctcctatcagagttgtaccatttcctgtccctgttcaatgcttcacatttgatgggcagccgttctggaatggtacaccggtggcatctccattctacccacagtcagctccccccatttggaatagcaaaacaccaacgtggcaagaatcaaccccacaggcaacttcactgccgcaaaaatcgcaacagaatgaaccagttgaaatggatgctaaaccagttgaaaatgcagaggaacaatttgtcgtaggtcctcccagtgccagtgggaagcagctgcatgttgaaattcctaaagatggtctacggcacatttctcctgtgaccggtgaaagtggaatcagtacggtgctagacagcaccagaaatactctgagcagcagtggctgtgatagcacttccaaccggatcaccgcctctactgaaccatcatccaatgtatacaggggcgttcctgaaaccgcaagagccgaaggtttacgacacctgagccagcgtgaggctgcactgaacaagttccggctaaagaggaaggacaggtgctttgagaagaaggttcggtaccagagccggaaattactcgcagagcagcgtccacgggtcaagggccagtttgtccgtcaagatcatagcatccaaggaagctagggtccagttactgagctggaactcttccccattatctacaaaaaaaagtcactgtaagtgactccactgcggggtaccctgatgtcaggtttttttcgaagagttggaagcaatcacaccgagttacggtttgctgtgtatgtttgctaaagcttgtaatataagtatgtataggctgactcttttctttccttaggttaggcacaggacctggcacgttctagacggtttgtcggtagacgttaaaaaatacaggcatacttgtgtcctccagtagcacgtgtgctttaagccttgtattatgtaactagccaagttgtttttgatgtttcggattagatgtacactgtggatgtatggcgtgaaggatgtccaccaaagtatgctcgtttttgtgtagcttgttgcaatgaacattgttggcctggtttttgttaaacaacaaaaaaaaaaaaaaaaaggacgaacgc

SEQ ID NO: 1331 - DNA, 120 bp, Zea mays
  UNSURE (1)..(120): unsure at all n locations
  Clone ID: PAT_MRT4577_157603C.1
  unsure (1)..(120): unsure at all n locations
cccacgcgtccgattgaccaaagacccggtagttccctggatggacgccggctagcctgcaagagaaaaaantgttgaaggacccaatggccagagttcagcaggtgcttagcactagtt

SEQ ID NO: 1332 - DNA, 1713 bp, Zea mays
  Clone ID: PAT_MRT4577_157626C.1
attgggtacctcgaggccggccggggaaaaaaaaaaaaaaaaaaaaaaaaaaggagtcttccaaaacgaagcaaaagcaaccgtcgagcttgcaacgccttacgcctccacactcaacagtcatggtcgtcatgggcaaggagcagcaacacgaggaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgcggaggcgctgctggaggcgcactactccgacctgctggcctccttcgacaacccgctggagcacctgtcgctcttcccctacatcaacaactacatcctgctgagccagctggagcacggcctgctggcgcggcacgtgccgggcccagcgccggcgcgcgtggccttcgtcggctccggcccgctcccgctgagctccctggtgctcgcggcgcgccaccttccgggcgcctccttcgacaactacgacatctgcggggaggccaacgaccgggcgcggcggctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccggggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgcgcacgcgcacggcgccgtgctcaaccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatctatctcatctaatatggatccatccatccatccatctatagcagtattatgtatgcatccacatggtaataatctggctgaccgcatccgcatatggtcgtctcatcgtccatctataccttgaaagctactaattaattactgagttattattactactgtttttactactactacgtactattaatattactacaactacctcatctagctggtgtattaattgattttgtctgttactgctgtactactgttgttgtggagatgaaccatgcatggagtggttagtcactctttagtactttcatgacgttgttttcaacggtcatatcatcatcattgttgtttctgctgctgctagctcatctagctgctgtattgtctatatactgatgcatgtgtggagatgaatcatggagcggttattgtcc

SEQ ID NO: 1333 - DNA, 389 bp, Zea mays
  Clone ID: PAT_MRT4577_157778C.1
aaaacgaaggctttaaaaaaaaattaacccaaacaggtttgccaatgggggaaaacccagctgaccacctaaagctagggggatacagatggaccaaacagggggcaacgaaggaacacatgttaaaagacaacattcttcgaacaaaaagccgggctggggggctaaccaaacgacacccacgagatcgcaacgatttaaaaagaaaaaaactcaaaagcaaatggaccccaaaaacccgtttaactaaaaaagcactccatccttttcctggatagcatccaacttcctccaagcaaacaaaataagccagcttgcagtccttcgaaaaaggggctgaattctccccataaaagcagcaaaaaacggattggggcaagctaaaaacg

SEQ ID NO: 1334 - DNA, 2383 bp, Zea mays
  Clone ID: PAT_MRT4577_15782C.1
accaagcgtgcaaccccgcgaccgggagctagctagccagcaacgcgtagcaagcagcgcaagcaaagctccgagcgcccggccggctcgcttcgccatgaacatgggtggaaggtccccggcggcgacgacgatccggtgcaagtactgcagcgcgagcctgaccgtgtgcgccggcgagcgcgccatccagtgcgggcaatgctgcggcgtgactggcatccggcggtcgctgtcctcgcggctcccgctgccggcgctgacgaggcccggctcgcgtcgcgcgcttcccgccgtgcggcggccgcggcaagaagcgcgccgtcctgatcggcatcacgtacggcggcgcgcgccggggctgcggcgagctgcggggccccatcaacgacgtcaagtgcatgaggcagctcctctgccagcgcttcgccttccccagcgacggcatcatcatgctcactgacgaccagaaggacccgttccgggtgcccaccaaggacaacatccggatggcgatgcagtggctggtgcaggggtgcagcagcggcgactccctggtgttccacttctctgggctgggcgcgcaggtcgccgacgcggactgcgacgagcaggacgggtacgacgaggccatctgcccggtggactcgttccagaagggccccatcctggacgacgagatcaacgagaccatcgtccggccgctggtgcccggcgccaagctccacgccgtcgtcgacgcgtgccacagcgattccgtcctcgacctccccttcctctgcaacatgtccaggaccgggaactggcagtgggaggatcaccgtccaccgtcgggcgtctgcaagggcacgagcggcggccaggcggtgcttatcagcggctacagcgacggcaaaagcaagttcagcatgacgccggaggcctgcgcggcggtgggggccatgacccacagcttcatcaaggcggtggaatgcgagccccagggggtcacctacggccgcctgctcacctccatgaaagccatcatgaccaacgccggcggctgcaaccagcagctgcagggcgcctgcgcacccgcccgcaaggtcgtcaacttcagcggcgtgcaggaacctaacctgtcttgctcggagatgttcgacgtctaccgcaagccctttgcgctgtgaacctcctctgcattgccattgcctttgcagactaccacagattcccgtctggactctatatataaattaccgtgacggaataataaaccagacggatttatattatatatgatgatatgaggcctgcttgctcataatgtgtgccttaattgtcttggtgccaataatgtgtgttcatgtgtcgatcggttaccggccctgagccaagcttatagcctgtggaccgacgactttgatgaccatttataaatacaatgttgataatgtttataccttgaaagtttataaagagggggaagaaataaaataaaaaaaaaaaaaaaaaacccacgggttggcccggtcctcctctggtttggcatctcggtacccctcgtctttgttgggagttatcttgggttcaagaaacctgccatggaacctccagtcaagacaagcaagattccacggcagatccccgagcaggcttggtacatgaatccgcttttcactattctgattggtggcgtccttccatttggagcagttttcattgagcttttcttcatcctcacctccatctggctgcaccagttctactacatcttcggcttcctcttcctcgtgtttgtgatccttgtcatcacctgcgccgagatcgcagtggtgctctgctatttccagctctgcagcgaggactacatgtggtggtggaggtcctaccttacctcaggatcctccgcgctgtacctcttcctgtacgctgctttctacttcttcacgaaactgcagatcactaagctggtgtctggcatcttgtacttcggctacatgtttctcgcctcctatgccttctttgtgctgactggcacaacgcctcatatgccttcttcgtgctgaatggaaaaattggtttctgcgcctgattttggttcactaggttgatttactcttcagtgaagatcgattaggtgccaagatgacagaacaacacatgtttcaatgatggagtcaagataattgtatgattaatgtggattggggaattacccccctcctttttttgaaggttttaaggaaaaatttactgtttaggatttagtttacggatggtttatgttttgttattgtcaggttatacactttagtgatctggaactgaaaaaatataagggtaaacatattatgatgaggctgtaccttgtgacaatttttttttgtggggctctatataa

SEQ ID NO: 1335 - DNA, 187 bp, Zea mays
  Clone ID: PAT_MRT4577_1578C.1
tgcaaataacaacattggtgttgtcattgcgctttgggctcctattattcttgtctatttcatggatactcaaatttggtatgcaattttctcaacgctaattggtggtgtctatggggcttgtcgccgtcttggtgagataaggacattggggatgttgagatctcggttcgaatccctgcctaag

SEQ ID NO: 1336 - DNA, 330 bp, Zea mays
  Clone ID: PAT_MRT4577_157903C.1
acgcgtccggcaacgtgtgtacagttgacgtcttatggtattgagttgctgaaacttgtaaggttcatcacttgtgtgtcggactctacttgtatatatatgcgaagaactcttgagatacacattgactacaatgtcttttgatgaataagaccagacagtgccataccgaacttgtccttcacacggttgatttgccatcttgggggatttggggaggtggtggtggtcgtgctctctattggtgtgaggctgatggcgtggctgtcattaatacaatccttaattcgtgttttgatgagcttttacaaaataatttaataaataaag

SEQ ID NO: 1337 - DNA, 355 bp, Zea mays
  Clone ID: PAT_MRT4577_157931C.1
attcggctcgaggtgagttcgacctatttttcccggacgtcgacgcagaccgtactggcgacccttttgaaggaccccatcgagctctcggcgtacagggaccgccggttcaaggggacacaagaagagaatgaggcggggctgcttgcgtggacaacactgtacatcggtaatatgtccttctacaccacagaggaacaggcctacgaactcttatacctcgccggcaagatcaagaagatcatgatagggctcgagcagaactccaagatcccatgctgattctgatttgtactgtactactctagggaggatgctgaaaatgctgtcaaatacatgagtggaaccatgcttg

SEQ ID NO: 1338 - DNA, 196 bp, Zea mays
  Clone ID: PAT_MRT4577_157970C.1
ctcttttacctcgattggtaattacgaatatatagatggcaacatgggggttacgtaattcatggaagggcttacattttggaactgttgaggtcagatatgaatgaatgctacaccccctaacgagcatgttgccggacccccttctatcttcttcctcttccctgtcacgctccatgctgctctcatacacatg

SEQ ID NO: 1339 - DNA, 2916 bp, Zea mays
  Clone ID: PAT_MRT4577_158122C.1
gaggcggtatgctttttgctttggaatcggtatgggatagtgaattgtgaacagggatcaactattgcccaggtaagaggcaatgtgtgctgattgcgcctagatgtacattttattaaagttttatatttattgtattttttatgtttttttttttttttttttttttttttttagattgcaaggtaactgcaaaccactaattaattagactgaatcactgaactaaagcttgtagagtaggtacaaagacaggcaaaaatcccgtatcacgttgcatgggaaaaaaatgggcgtctctcaagaaccatcacgtgacttgaaccaggcagtcaccgatatcatttcacattcctagtaaagcgggagctagctagacttgaaaacaaatccgaaagcctaaagctcgtccttgtcgtaggacgacggctccggctccggctccttctcctccacctccggctgctcctcggcctcgtcctcctccacggtcgcgtcggggctcaggtccaggcccttctgcaccgacttgtagatgctggacgcgaactccttggggtcggggaggttgaacccgctctccatcagggccgtctggtacaccagcctcgccgtgtgcttcagctcctcgctctcgttgtcctgggcgaccttgtcgcggagctccttgatgatggggtgcctggggttgatctcgagcaccctcttgccgcgcatgtacgcctgcttgctcgagtccgacagggtctgcgcctgcatgatcttctccatgttggcgctccacccgtacttggaggtgaccacgacgcagggggtgtcgtgcagccggttgctgatcttcaccgagtccacgttctcgctctccagggccttcttccaccagtcagtcagctccttgaacgactccttgagctccttgagcttcgagtccttgcccagcttcagtccctccttggacacgttctggaacttcttgtcctcgtagtccatcaggtactgcatcaggtactcgtccacggggtcggtgaagaagatgacctcgtagttcttcttggttagcctctcgaggaatggagacttctccagctgctctttgctgcttcccgtgatgtagaagatgtctttctgccctgacttcatccgtgagatgtactcgtcaagggaggcaagtttgccatccgacttggtactctcaaatctaagaagcttcgcaaggcggtttctgttagtcgcgtcttcgatgatacccagcttgattgatttgccaaactcattccagaacttggcgtactggcccttcttctcctccatctcgcttttctcttcatctgtcttatccttgttgctgtactcatcagggtcttcttcagcaagtttcctgatcatgtcaagggctttgcggatcagcttcttcttgatggtcttgagactgctatgttgttgaagcatttctcgtgacacgttcaggggcagcgtgtccgagtcaacaatacccttcaaaaagctcaggtacttgggaagaagatcatcaaattcgtcagagatgaaaactctcctaacatacaacttgaggtttgacttgttactgttgtagtaactctcatagagatcatgtggagccttcgggggaataaagagcaaagctttgaactcaacatctccttcggcagtgaagtggctccaacccataggcttgtcatcaccgaagtccttggctagtgagtggtaaaacttcgagtattcttcatcggtaacctcctttgggctgcgaagccatacagccttcacatcattcagaagttcccactcagaagtagtctcctttattgtcttggtcttgggctttttctctttctcttcgtcttcgtcttcttctgtctcttcctctgtagtttctggagttgaatcctcttcttcacttgtctcatcctcatcagttggcacttcaacatcaacctccttggtcgaccacaaatagatagggaagttgatgaactcagagtacttcttcaccaaatcctttagcttatcctcttccaagtactccttggcctcatctcgcagatgcaatcttatctcagttccacggccaaggggctcattccatgtatcctcagagatggcaaatgatccatcagcttttgattcccacacatactgtttatcatcattgtgcttgctgaccacttcaacatagtcagcaaccaagtacacagagtagaagccaacaccaaactgtccaataagattgaggtcacctccagactgcatcttttccacaaaagctgaagtgccagatttagcaatcgttccaaggttcttaataagatcttccttggtcataccaatacccctatcccgaatggagaggattttcttctctttgtccaacttaatctgaatctcaagctttgcagtgtccccttcacccagaacttccttatcagtaagggaaaggaacctaatcttatccaacgcatcagaggcattagatatgagctccctcaggaagatatccttgttgctgtagagtgagttgatgatgatgtccatgagtctggaaacctcagcttggaactcaaacttctcggctgagctcctgagagtcttcctagagatagactcggcttccctctgggcaacctcagagtcggtggacaggccatgagggacagcaccaagcttctcctctaccttgggtgggttagccaagtcatagctgctctcctcggcattcacttgtagcttcttagctgggtcggggagtgtggtgaggagaaagaggaggaggagcgcggaggagagcgcccacttgcgcatcgtcgcctctcctggctatcgcttcactctgtggagcaccacggacaccaccagtgcagtgatgagttcgtcgccccggccggcctcgaggtaccc

SEQ ID NO: 1340 - DNA, 555 bp, Zea mays
  Clone ID: PAT_MRT4577_158138C.1
gaccgattgacgcaggccaaaccttacctgagcgacggcgtggtgcaagggctcgtggacccgcggctcggcgacggctacgactgcgggcagctgaggcggctcatgttcgtcgcgtccctctgcgtcagggccgccgccgtgtggcgcccgaccatgacacaggtggtggagctactggagtccggcgagatttctcaagagcagtggcagatgcccgagaaggaggagcaggacgagctgtgggacttcgacgatctcgacgacttcgacgaggacgactacgacgacgagtccgattccccctcgatctcctcgtcggcatgcagcatccaccccgatgattagccccaaaatacttgcgcgtgtcagtagattattatcgttgttattattcaacctgctgatacggtccttgattgtatcggtgtgtacatacaccatccatccctagtagagaatagtaatatgaaaatccgggagaaaatcgagagaagaggatagaggcccgtggctttctccaggcccgtgcccttcagttttggtgtcgccaaa

SEQ ID NO: 1341 - DNA, 208 bp, Zea mays
  Clone ID: PAT_MRT4577_158232C.1
gcccgaacagtaggccaccgagggatgcgaataaggtggcaaatataagggactccaccgtcatgagcttgatctggatgttgagggacgggcccaaggtgttcttcagggggtcaccaatggcgctacctattacattacccttgtgacagccagattccttggggccgaaggtcctaggtctgctcgctggcaccagcactcatgt

SEQ ID NO: 1342 - DNA, 419 bp, Zea mays
  UNSURE (1)..(419): unsure at all n locations
  Clone ID: PAT_MRT4577_158338C.1
  unsure (1)..(419): unsure at all n locations
tcggtaagagacgggtgctgtgaagtagtgtgaacctgaaccttgtctgaggtcactgagtgagctagctagctagctaagctccgatcgatcctagctagcatacaataccactagtcttcttnacaagtgtaagagacgacagcaacacgagatggtcgntgctagccttctcaagtcctgcttgcttcccaagaagtccgaatggggcgccacccggtaagccgtcgncttcccccggccggccaccgtgtccgtggtcgtccgtgcctgcgnctacgccgatgagctggtgaagaccgncaaaacgatcggctgggtcggtgcggcgncgtgtnacaggacaatgggctggtgccgatggtggagttggagatgctgctggacggtgaggtcgggatcgagcggtcgttcggggt

SEQ ID NO: 1343 - DNA, 379 bp, Zea mays
  Clone ID: PAT_MRT4577_158355C.1
cccactctttcggccgccgccgccatcgggcgcaactcggccgtcgtgttcgcctggaagggggagacccttgaggagcactggtggtgcaccgagcgctggctcaactggcgcgagggggtcgggcaccacctaattgttgacgacggcggtgtccccactctgttcatccacaagggtgtcaaggcctgtggatgcgtacgagatgaccggtaacattcaggaaccgggctccaccgacagcgctgagatcaagaacgtgctcaccatcatacgcgaccggctcaaggttgaccccatgaagtaccgcaagatgaacgagtggcttgtcggcctctctgaggagaccaccaccggtgtcaagaggctctaccagatg

SEQ ID NO: 1344 - DNA, 304 bp, Zea mays
  Clone ID: PAT_MRT4577_158398C.1
accaattaaattctcggtatcattgagctacttacccgagccacttaaaaataatatttggtattgaacaaaggatgtctctgtatttgtggaaagcaaatgcgagcgtattgctcatccctcttttgcattagatgcctgtgtggacagtgtggtggactggtggtactgcatcggtagcattctagtttttgcttaattgaatggtagttattttggtttacaaggtatagcttaagaaagtctggttcactatttttcattttggttggtatattcacacatcacactattcagctagtcc

SEQ ID NO: 1345 - DNA, 817 bp, Zea mays
  UNSURE (1)..(817): unsure at all n locations
  Clone ID: PAT_MRT4577_15848C.1
  unsure (1)..(817): unsure at all n locations
gatcccgacagcccatgccctgcagcgccgtcgctgttccaccccgctccctagcgccggtcgccccggtgaggatcacgagcccccgacgactccctgcccgtagattttgctccaattccaaatcccagcccgcagaaggccctccagatgtctgattcctcggagccctcgaaagaaggttcttcagccaatggttccagtgctctccaaaaaactggagcctggagtagcatattgagcactcttgtccagcaagcttcagtgtatggcttggctgctggctattgcctgtcagcatctttgctctccattatcaacaaatgggcaatcatgaaatttccgtaccctggggcactgacagctctacagtacttgaccagtgttgttggagttctcctatgtggacaagcaaagcttattgagcatgatggccttaatttcgcaaccatgtggaagttcttacctgctgctgtgatgttctacatctccatcttcacaaacagcgaactcttgctgcatgccaatgtggacactttcattgtgtttcgctctgctgtgccaatatttgtggccatcggagagacgttgtaccttcaccaaccatggccgtcattcaagacatggctttcactatccaccatacttggtggaagtgtgatctacgttttcacagacaaccagttcactgtgactgcttatagctgggcagtggcctacctagcgagtatgtccattgatttcgtatacatcaagcacgttgtcatgaccattggnctgaatacatggggccttgtgctttacaaaatcttgaggc

SEQ ID NO: 1346 - DNA, 1852 bp, Zea mays
  Clone ID: PAT_MRT4577_158569C.1
aattcggcacgagggctagctagggttctgtaaccaatctcacccatcttttctttccttcgtcggagaaggggagaaaagcgtacctgaaacgattccctgcattccattccgctgcatacttgcattgcatctcatccctcctgctcctgcgtcctcctcctctatttctctcctgctgcttgctactacctcatcgatccattccatccatcgccgaggggggagggccgccgcccgcccgggtcgcatcgcatcgcccggtcggccggggactcggggcaggcgagcgacactagctataaaagacctcccgccgcctgcgactgggccgtgtgcaagcaaagcgcaaggccgatctgagggttggagggccggccatggtgatgatgatgcggtcgtgcctcggcggcggcctgctaccggtggcggtcatgctctgcctcaacgtggtggcggcggtcatggtgtcgctcgtcaaggtggccatggacggcggcatgaaaccgctcgtgatcgtcaccctgcagcagctcaccgccgccgtcttcctcgcgccaatcgcattcttcaaggagaggaagtcgaggccaaagctgacgctggagatcttcgcctacatcttcgtcagtgcggcgctcggggcagctcttcgtcagtacatgatcttcgtggccctgcgctacaccacggccaccttcgtgaccgccttctccaacatcgcccccgtgctcaccttcctcctggccgtcgctacgcggtccgaagcgctggacctcaagagcaggacggggttggcgaagctgctgggcacgctggtgtcgctggccggcgccatggtgctcaccctctacaagggcgtggcgctcacccacgcggcggcagcctcgcaggaccaccagcagcactcccacggccggttgccgccgagcgccgccgacagccgcggcaagtggacgctgggcaccgtggccatcctgggcaactgcgtctgcctctcctgctggttcctgctccacggccgcctcgccaagaagtacccgcacgtctactcctgcaacgcgctcatgtccttgctcagcttcctccaggtcgccgtcgtcggcctctgcacccagcgcagcatctccccctggatcgtcaccagcaagttcaacatcctcaccgtcctatacgccggcatcgtcggctgcggcgtctcgttcgtgctggtgacatggtgcatcgagaagagaggagccgtgttcgtggccgccttcataccggtggtgcagatcatcgtctccgtcatcgacttctccatcctgcacgagcagctctacctcggaagcgtgctgggatcagtgctagtgataggtggcctttaccttctgctgtggggcaagaggcaggaggccctgcactgtcctcctcctcctccaaaggttgccgaagaagaccctgctgacaaagagcagcagcaagtgcagcacaactgaagacggacagcatcctctgactgtttggtcgtttggttgtaacagtgccagcaataagatctctctgcctccttttcttttcttttggtgtctcaggggggtgggcaatgttccttccttctcagatcgatcaccaacaaagtgtttagattctaatccaaaacagtagaatggtcttaaatacagtactcctgcttactgatgatagcaacaccactaccaactaggcctctggagaaatacagagtagagtgtgtgtgcgcgcaatactggagagcagaatattcctgcaaatatagtacgcagttgctgtccgcctttttcttatgaggacatatctggtgctagagaaaaaaaagaaaaaaaaagcgtac

SEQ ID NO: 1347 - DNA, 384 bp, Zea mays
  Clone ID: PAT_MRT4577_158709C.1
ctatagtgagtcgtattaaatcgctagcagcagctgcatgctggcaatgtgcagtggtcaacctaagatgtcacagagcgttctaatcgccttcaggaatgtaggagacgacgctacgggagccgcattggccatcgacgcgttctttccctttgcctgtactgatgccatctaggaggcgtgctacaacagtatcggtatcatcgcccagccagtacgcagtaacaacgacgaagacgccgtcgcgtgctgcatcaagtatggtgtgtctctcgtcctcaccgatgtcaggcacttcaagctttacccgtcatgctccatggcaggtcatcttagcgtacggagttacggactttacaccaaccttcgacagctgctccttgt

SEQ ID NO: 1348 - DNA, 259 bp, Zea mays
  Clone ID: PAT_MRT4577_15871C.1
tacagcacgaatctcgtttaggagaagcggagcgcccaatcggtgcaagcatcatggagtacggtcagcaggggcagcgcggccacggcgccactggccatgtcgaccagtacggcaacccagtcggcggcgtcaagcacggcaccggcggaatgaggcacggcacgggaaccggcggcggcatgggccaaatgggtgagcacggcggagctggcatgggtggaaggcagatacagcctgcgagggaggagtacaagac

SEQ ID NO: 1349 - DNA, 614 bp, Zea mays
  UNSURE (1)..(614): unsure at all n locations
  Clone ID: PAT_MRT4577_158906C.1
  unsure (1)..(614): unsure at all n locations
cccgggcgatccaattgtcacttgctgctcccttccaacaagctgaattagagggcgggtggtgggggtgggtnctanactcgttgtcattagtgcatggcgggagggagaagcaccaccaccaccacctgttccaccacaagagggacgaggagcagctcgccgccggcgggtacggggagtccgccgagtacacggaggccaccgtgacggggggggggggcactnnctagaactagtaccacgagtacaagaaggaggagaaggagcacaagcacaagcagcacctcggcgagggcggggccatcgccgncggggccttcgcactctacgagaagcacgaggcgaagaaggacccggagcacgcgcaccggcacaagagcgaggaggaggtctcggcggcggggggcgtgtggtccggcgggttcgccttccacgagccccacgagaagaagaaggaccacaaggaggcctaggaggccggcggcgagaagaagcaccacttnttcgggtgagtgagcctcccgtatggggggccctccccgtgtgctacgcgtgcgtgtgagagggatatttagcgccccccgtgttgtggcgcgcgtacctatgtatgc

SEQ ID NO: 1350 - DNA, 304 bp, Zea mays
  Clone ID: PAT_MRT4577_158952C.1
gctggcttctcctccacctcatatcaagtcctcctcgggttagggttccttagggatttgtggaggggcgatggcggcggctgatgtggagtaccggtgcttcgtcggcagacttgcctgggccagcagcaacgagtagctggagaatgccatcgacacctacgtcgaggtcctcgattccaaggtcatcaccgaccggtagactgggatgtcacgcggcgtcggcaacggtaccttcacatccgagaactgcatgctcgacgctatcgaccacatgaaccgcaaggagatccacggacgtaac

SEQ ID NO: 1351 - DNA, 372 bp, Zea mays
  Clone ID: PAT_MRT4577_159050C.1
cagctagcatcatataaagcacaatcttgtaccaacaatggctgccaaaatattttgcctccttatgctccttggtatttctgcaagtgctgctacggcgaccattttcccgcaatgctcacaagctcctatagcttctcttcttaccccgtacctatcaccagcagtgtgttcagcatgctaaaacccaattcgttaaccatacaggatccaacatgcaatcgcacctggcatactacctttatcaccctagttcctgcaacaatcatcagcccttatacagcagttcacctatggtgcatttattgtcacaatacatcatggcacaacaactacaacaacttgtgctagcaaacctagctgtctactctc

SEQ ID NO: 1352 - DNA, 2197 bp, Zea mays
  Clone ID: PAT_MRT4577_159255C.1
tttccaactggtgtccaagttatatgaagtggtccctccgatcctccttgagttaggaaaggccgggcgcccctcctctcgccgccccacccactccactcctttcctttatgccctacgttataaaattggcaaactcgaggccggccgggggaggacgacgaccggtcccattccccccgccccaacttgtcaggactcaagaggctcccctcctccctcgccgcggaacacgcgcgccgtcgtcgccagcccgggttcatttctccgttccttggtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcccagttgcaggaattgattccggaacaacaggatcgcttaaagaagctcaagtcagagcatggaaagacccagcttggaaacataactgtggatatggtccttggtggaatgagagggatgactggaatgctttgggaaacatccctacttgatccagaggagggtattcgttttaggggcctctcaattccagaatgccaaaaagtgctgccaacagcagttaagggcggtgaacctttgcctgagggtctcctttggcttcttttgacggggaaggtcccaaccaaagagcaagttgatgcactatcaaaggaattgcttgcgcgctcaactgttccagctcatgtctataagacaatagatgctctcccagtagatgcacatcctatgacacagtttaccacgggagtaatggctcttcaggttgagagtgaatttcaaaaggcttatgacaatggattgccaaagtcaaagttttgggagcctacttatgaagactgcttaaatttgattgctcggcttccaccagtggcttcttatgtttaccggagaattttcaagagtgggaaatcaatagaagccgataattctttggactatgcggcaaatttctcacacatgcttggttttgacgacccaaaaatgctggagctgatgcggctctatgtaacaattcacactgatcatgaaggcgggaatgtcagtgctcatactggtcatctggttgggagtgctctgtcagatccttatctttctttcgcagcggctctaaatgggctagctgggccactgcatggccttgcaaatcaggaagtgcttttatggatcaaatctgtaattgaggaaactgggagtggtgttaccacagatcaactcaaagactatgtctggaagacactaaagagtggaaaggttgttcctgggtttggtcatggagttctgcgtaagaccgacccacggtattcatgtcaaagggagtttgccctgaagcatttgcccaaggatccacttttccaattggtgtccaagttgtatgaagttgtacctcctatcctcactgagctgggcaaggtcaagaacccatggccaaatgttgatgctcacagtggagttttgctgaaccactttggactatctgaagcacggtattacactgtcttgttcggtgtttcaagaagcatggggataggatctcagctcatctgggaccgtgcccttggcctgccacttgagaggccgaagagtgttaccatggagtggctggagaactactgcaagaacaaggctgcttgaagcttttcacaaatgctgctttttcccaaccttggctgttaataatttaaacgcgagttatagaaatagtcattttccctttggccgttgaataacgcaagagcaatatgctcaggcggaagaattttgtatcttccgtaacttggtgaacatccagatacttgatctgcggcaacaatgggcagaagagattaggacatgctgattgatctttatacgccaacacttgtttttctttaacattacttgttcgctgcagctttaagccagctgtttgtaactgcaatttatagcaatttatagagatttgggctatgacatgtaaaatcatgtatgccagttaaaaaaaaaaaaaaaaaaaaaaaaaaaaaaaaaaaaaaaaaaaaaaaaaactcggggattatttttgcagagttaattggtaattccaaaaaaaaaaaaaaaaaaaaaaaaaaaaaaaaaaacccccaaacc

SEQ ID NO: 1353 - DNA, 887 bp, Zea mays
  Clone ID: PAT_MRT4577_159256C.1
atctggacccgtatatattcatgtcccgacaagttgggccgggctcttcctccctcgccgcggaacacgcgccccgtcctcgcccgcccgtgttcatctctccattccataccctgaagtgcaggtgcggtggtagccgagtgctccggccatggcgttcttccggggcctcaccgcggtctcgaggctgcgatcccgcatggcgcaggaggccaccacgctgggtggtgtgagatggctgcagatgcagagcgcgtccgatctcgatcttaagtcccagttgcaggaattgattccggaacagcaggatcgcctaaagaagcttaaatcagagcatgggaaggttcagcttggaaacataactgtggatatggtccttggtggaatgagagggatgattggaatgctttgggaaacatccctacttgacccagaggagggtattcgttttaggggtctctcgattccagagtgccaaaaagtgctgccaacagcagttaagggtggtgaacctttgcctgagggtctcctttggcttcttttgacggggaaggtcccaaccaaagagcaagttgatgctctatcaaaggaattgcttgagcgctcaactgtcccagctcatgtctataaggcaatagatgctctcccagtaactgcacatcctatgacacagtttaccacgggagtaatggctcttcaggttgagagcgaatttcaaaaagcttatgacaatggattaccaaaatcaaagttttgggagcctacttatgaagactgcttaaacttgattgctcggcttccaccagtggcttcttatgtttaccggagaattttcaagggtgggaaatcaatagaaactgacaattctctggattatgcggcaattt

SEQ ID NO: 1354 - DNA, 305 bp, Zea mays
  Clone ID: PAT_MRT4577_15928C.1
actagttaacgaaagccttttatccaagctcattgaacggaagctcacattttgggtggggccaatctttgatggggggggagctatgtcttttcttcagcatcattctactagttaccactccggcgagaccaatgcccgtgcctaggataacacgggtcaagtgatgggggcgacgcatgagaaagggagggaggccaagcacaaggcgtccgacgcctccgaccgcgccatgggaatgggccacgactccatggaggcgaccatggataaggctcgcgcctgctcggaccaaaccatggtga

SEQ ID NO: 1355 - DNA, 1447 bp, Zea mays
  Clone ID: PAT_MRT4577_15942C.1
ttgggtacctcgaggccggccgggaaacccggtccatgcaaatttattcccggtcagcatctctgtctttttcttacctccaggttccagcgtgcgcgctctcttcccctctccgtcggcgacgactacgccgggtcttcttcggacccaggtcgttgccgcctacgccaggtgcccaaatcttcttagggcccttcgccggcgacgagcacacaagcttggttgacccccaacaaattgcaaaatgtcagccaatgtcggtgaatcaaccagcggtggcagcagcaacgatgcagctggggggagctttgaatgtaacatatgctttgagctgcctcaagagccaatagtgactctttgtggccacctcttctgctggccatgcctttaccggtggctgcacatccatgcacattcgccagagtgcccagtgtgcaaggctcttgtggaggaagacaagcttgttcccctttatggacgcggcaaggatcgtgttgacccaaggtcaaagaacatgcccgagggtgagattcctcaccgcccaactggtcagaggcctgccccagccccccaggccgatgctaacaacaactttgccaatgccaatccaaatgcgaatccatggttcatgggcacaggagtccctttggctaatgcgcgctgggggaactacgcattctcagctgctttcgggggactattccctatgcttagcttccaagttcatgggtttccagatgctgctgcttatgcgcagcctgctgggttccactatgggtatggccatgggcatggattccatggcggccatatgggacacgcccatggcgtccaccgacaagcaccattggggcaacagcagcaggcagatatctacttgaaggccctgctcttcatgattggaattctagtgattgcaagcctcattgcgttttaaaatttgttggcaacgtctaccaggaggcctgctcgtcacggctgggacgtggaattctgggaatgcaatcctcctgacatgtcagagtccgttgatagcttgacatttgtgatggcatattggcccatgaaccgccagaatttcagtgtgtttgtactatagcttggcgctgaatgttgcataagttattattctgtttgcatgaagtgttcatagaatatgtattaatgtctagataagtacctacgtttcgtaacaccttatatagagtactaggaggaacatggtgaaattattactgtctagtcttgatttttttaaaaacattttggagatgaatgtgatgtgcacttaaaaaggtaagagtgacaaatgatcgtgccgtagagctttgcaataaaaaaaaaaaaaaaagcggcctttgtcagtgcctagctttgcacaaacaatggttctagtgttgtgatgggttttcgattttcatattaatatttaagattttcatatatt

SEQ ID NO: 1356 - DNA, 457 bp, Zea mays
  UNSURE (1)..(457): unsure at all n locations
  Clone ID: PAT_MRT4577_159546C.1
  unsure (1)..(457): unsure at all n locations
gaccaactagcagcataggaagcacacgtagcgtcccaacaatcggcagccaaaatatataagcctgcttatggctacttggtgtttctgaaagtgctgctactggaaccatttgaccacaaggctcacaagctgctataggttcccttcttcccccatacctctcaccagcagcgtgttcagtatgtgaaaacccaatgcttgcaccctataggatccaacaggctatctcagctggcatacttacctttatacacccttgctgctccaacaatcatcagtcctattacagcagatacactttggtgcattgattggcacaaaacatcagggcacaacaactacaanaacttgtgctagcaaaccttgctgcctactctcagcaacaacagtgtcttacatgcaaccaactagctgcattagactctgcttcttatttgctacaacaacaactacc

SEQ ID NO: 1357 - DNA, 276 bp, Zea mays
  Clone ID: PAT_MRT4577_159559C.1
tgaagctatatctaagatgcacaatatgagcgctgctgacttcacatcagcgcgtacattgattgacgagtatgacctgtatggtctagtggcatactccaagcatcatatacactcagaagttcctgacatttatcgtttagctgcaagacactcaaggggcgtttgtacatgtagctcacttcgaacaatttggagttactctgacagaggctgctatgaatggttagcatataatcgcgacaataaatggaacccctgctgaaattaatcagg

SEQ ID NO: 1358 - DNA, 180 bp, Zea mays
  Clone ID: PAT_MRT4577_159638C.1
ttgatagttcatgatcctcccaactggtgcctcgtcgttcaaggaggccatgagcgtgggaatttaggtttaccacaacctgaagagcataatcaagataaattactgtcaggatgctacaaatgttgtggatgaatgtgtgcttgctctctaacattaaggaaaacaaataaggtcttt

SEQ ID NO: 1359 - DNA, 1342 bp, Zea mays
  Clone ID: PAT_MRT4577_159688C.1
cgcagccgcagcacaatcgcctcgccttccctttcccaccagcccccgtctctctctctcttctctctgactctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcccccggcggcgcgcccgccaacgtcgcctgcgccatcgccaagctcggcggagctggacctgggcctggtgcggccgccagggtgttccactacggctccatctcgctcatctccgagccgtgccgctcggcgcacatggccgccatgcgcgcagccaaggccgcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgatgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgggggggcatctgcaccaccaagaagggcgccatcccggcgctgcccacggtcgccaccgcccaggacctcatcgccgttccaccacgtcactgtcccccgccgccccgcccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaataaaatgttggcatgcgtggtgggatgctatcctttttttttattttattttattttatttttagcttggatcagttggggttttgaacattgctagtgtcgtgtgattgggaaggctaatgtgatgccttcgatgcagagttttcaatgaatgccttggtgcaaacgtacgattgtgtaataaaaaaaaaaaaaaaaaaaaaaaaaaaaaaaaaaaaaaaaaaaaaaaaaaaaaaaaaaagaaaaaaaaaaaaaaaaaagcggcc

SEQ ID NO: 1360 - DNA, 2220 bp, Zea mays
  UNSURE (1)..(2220): unsure at all n locations
  Clone ID: PAT_MRT4577_159689C.1
  unsure (1)..(2220): unsure at all n locations
acgaatgactcgtattcccaaatcccaaaaggccaaaaaccatacgccgcccaaatgcaaaagctgaagagggcgggggggcgtccaggttcaatgcatgtacacgaccccccttccgtcttgatctgacctgtgggctgtggcctgtcgctgctacatgcaactgcaatgagacagacggacgcgtggggcaggtcatctctttcaaaccccacacggccacacggcatgtttcaaaggcaggtccagattccagcagctctgagctatagaaaaaacggcttgggggcgaggcggagagaggggtatttgcagtataagtacctttggatcgaagagcatcactcgaagatgcatcgaggactgttcttcttcttcctcaagctgtagcctgtgggaggagaggccggagaggcctcccatggagttcccccactcatcacttcttgttggtcccctgctagctgttcgttccctcagcaggtagctagagatgatcttgctttaattttgtgctgatctcttactcgtcgtgtacgctcatatgcatggggcgacggatttgtctctgatcgttcccatgccgcctcttgtatcttgacttggatctatatatcaatgcaaataaatcatcgatgggtgacaatcgaaaaaaaaaaaaaaaaaaaaaaaagcggccaaaaaaaaaaaaaaaataaccgcagccgcagcacaatcgcctcgcctccccttccccaccagcccgtctctctctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcccccggcggcgcgcccgccaacgtcgcctgcgccatcgccaagctcggcggctcctccgccttcgtcggcaagttcggcgacgacgagttcgggcacatgttggtgaacatcctgaagcagaacaacgtgaactcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagccaaggccgcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgangctctcaagttctccaacgcttgcggcgccatctgcacaacaagaagggcgccatcccggcgctgcccacggtcgccaccgcccaggacctcatcgccaaggccaactagatggccgcacgccccgccgttccaccacgtcactgtcccccgccgccccgcccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaataaaatgttggcatgcgtggtgggatgctatccttttttttattttattttattttatttttagcttggatcagttggggttttgaacattgctagtgtcgtgtgattgggaaggctaatgtgatgccttcgatgcagagttttcaatgaatgccttggtgcaaacgtacgattgtgtaataaaaaaaaaaaaaaggaaaaaaaaaaaaaaaaaaggccccta

SEQ ID NO: 1361 - DNA, 1749 bp, Zea mays
  Clone ID: PAT_MRT4577_159691C.1
atattgtgtagtggtcacctgtccagtttatggcctcaagactagtctaccctgtttgtcacaacatctgccctgaaaaatcatactgcagctgtactggagtggtccgtcccagctgtgatcttcctaaaaaaaaaaaaaaaaaaaaaaaaaaaaaaaaaaaaaaaccgcagccgcagcacaatcgcctcgccttcccttccccaccagcccgtctctctctcttctctctgactctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcccccggcggcgcgcccgccaacgtcgcctgcgccatcgccaagctcggcggatcctccgccttcgtcggcaagttcggcgacgacgagttcgggcacatgttggtgaacatcctgaagcagaacaacgtgaactcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagccaaggcggcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaagggcgccatcccggcgctgcccacggtcgccaccgcccaggacctcatcgccaaggccaactagatggccgcacgccccgccgttccaccacgtcactgtcccccgccgccccgcccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaataaaatgttggcatgcgtggtgggatgctatccttttttttattttattttattttatttttagcttggatcagttggggttttgaacattgctagtgtcgtgtgattgggaaggctaatgtgatgccttcgatgcagagttttcaatgaatgccttggtgcaaacgtacgattgtgtaataatgccttctattgatcagcgactccaaaaaaaaaaaaaaaaaaaaaaaaaaaaaaaaaaaagtactctgcgttgttaccactgct

SEQ ID NO: 1362 - DNA, 1610 bp, Zea mays
  Clone ID: PAT_MRT4577_159693C.1
gggtacctcgaggccggccgggatacagagtaaatagcatggccccaccaccgcagccgcagcacaatcgcctcgccttcccttccccaccagcccccgtctctctctctcttctctctgactctctctctcgtagccgcgtccacctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcccccggcggcgcgcccgccaacgtcgcctgcgccatcgccaagctcggcggctcctccgccttcgtcggcaagttcggcgacgacgagttcgggcacatgttggtgaacatcctgaagcagaacaacgtgaactcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagccaaggccgcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgacgagaagaacgtgctgtcgctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaagggcgccatcccggcgctgcccacggtcgccaccgcccaggacctcatcgccaaggccaactagatggccgcacgcccgccgttccaccacgtcactgtccccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaaataaaatgttggcatgcgtggtgggatgctatcctttatttttattttattttattttttagcttggatcagttggggttttgaacattgctagtgtcgtgtgattgggaaggctaatgtgatgccttccatgcagagttttcaatgaatgccttggtgcaaacgtacgattgtgtaataatgccttctattgatcagcgactccaaaaaaaaaaaaaaaaaaaaaaaaaagtactctgcgttgttaccactgct

SEQ ID NO: 1363 - DNA, 334 bp, Zea mays
  Clone ID: PAT_MRT4577_159754C.1
gagttgacttctcctccccctccggttcgttttccggttcgagaggttctccgggggtcggtttcatagataagcggagccagatggcggcctccgatgttcagtaccgctccttcgccggccgcctctcctggaccactgacgaccactcactacacaacgccttcagcacctacagcgaggtactcgagtccaagattatcctccatcgggagacgcagaggttccgccgcttccgcttcgtcaccttatgcacagaagaggcgatgcggaacgccatcgagggcatgaacagcaaggtgctggacgggcgtaacatcaacgacaactaggc

SEQ ID NO: 1364 - DNA, 220 bp, Zea mays
  Clone ID: PAT_MRT4577_159790C.1
gcgtccgattcatccagctagctgctgtgagcccgctgccttctgacacacaacattagtgccgttctactgcacactgcgcctaacgttggcccctcttacaactgcacaattgctgcattcgaccaacttgctttgcaaacccacagtgttctaccaacaacccatattggtgggccctctttagattgctatgagttataggcaataataagttttt

SEQ ID NO: 1365 - DNA, 580 bp, Zea mays
  UNSURE (1)..(580): unsure at all n locations
  Clone ID: PAT_MRT4577_159876C.1
  unsure (1)..(580): unsure at all n locations
atgggtnaccctcgggccggccgggatggaaaccacacggccagtccagcactgaacacttgattgattcactgggtagatagctagctgaatcacaatggatcctaccaagttccgaccgtccagtagccacgacacgacaggtgacgacgacgaacgctggagctcctgtggggaacgacaacgaggcgctgactgtggggcctcgcggtgccatcctgctggaggactaccacctgatcgagaaggtggcgcactttgcgcgcgagcgcatgccgcagcgcgtggggcacgcgcgcggcgcctacgacaagggcttgtatgagtgcacccacgatgagacggcgctgacgtgcgccgacttactgcgcgcgctcggagtgcggacgcaccgtgatcgtgcgcttgtcgacggcgatccacgagcgggggtgcccggagacgatccgggacccgcgcgggttccccgtgaggttgtacacccgcgaggacaactgggacctggtgggcaacaacttccccgtcttcttcatccgcgacggcattaagttccccgacgtgatccacgcggtcaagccca

SEQ ID NO: 1366 - DNA, 2067 bp, Zea mays
  Clone ID: PAT_MRT4577_159877C.1
ggagcccccacccccaccgtataccgccggctccagacaaccgattccgttccatcccccctcccccctcgctcgagcgcgaggcttctctcccctcccctcccttctcctccccccccggcgcggattcctacagccagctccctcgccgatcgcggtcccgtcccgagggagaggtgatgataaaggatatctgctgaccaaacttgcagtagttcttcttaaggaaatagaaattggcgtcatgacacatagaaatatgctctggacacatcagtctgttaatcctgaatgggagcaaagacatgtccaagttcaaccaggaagttcctattatgcaggcactgcaagtgatccatccaacctgggtgtgcaagttgctgtgggagttccaggaaatactgctaatgttggtatatgtgatttgcggaatcatgagtgcccgcatgttcataattcatacccacatgccggtgttacatcaagatttgtcttcccaactactatgtacagccctagcatgtcagcagcagctgtcaacatatatattcctcagactcaaagctttggactgggcagtgtgctaccaccatctttacataatcaagtttccacaggaattattgatgagagtagcagcagtgtcaattttggtgatagtgctattggattcatgaaaaggaaaaatgcagtagttgctggaagccataattttcttcatggatttgctgggtcaagttcatctgtccatgtgcctcagaatcctgtgcatggggcatggaatccttcatctcaatcaaattgtttacccagttctgcagcttcaaacctaccagaataccacaatagtaatgggtggccatacttagaagaatcttctgcagatgcttcaaacagtttcagttctgtggctgcttgcccggagctggcacctcatggtaactatttatatccagcttgtcacataagccagtccaatacatgggttccacagcctgcaggttacggagtaccacagtggggatatagtaatgcagtggtcaatcctccagacatgtcaaatgggccactgcctcatttctgccagaatagtatgcaggcacctcaaatacaagtgccccatcaacagtccatcggtaacaatgtggtgcatggtttaaatccttctgccacaggtcttcctttacatccaagaatgctggctctcccattcaatgctgagcacacttttgggcatcaagtgcatccacctctgataaaccaagccaacaatggggctttaagaattctgccatatcagaatgctacagtgatggatcattcaaggatttatgaagcaggacatgttatcgatgaacatagcgatatgcgtttagatgtggataacatgacttatgaggaacttgtagcattgcaagagcagataggcgatgtcaatactggtttgacagaaagctatatccaggaaaacttgaggtccagttttcatgttccaggagcagctagcatgtctgatcagttttctgagctttctttggagaatgatgcttgcataatatgccaggaggagtataaagctaaagaacttataggaacccttgaatgcggtcacaagtaccatgtgaactgcataaagcaatggttgatgatgaaaaacctgtgccccatatgcaagacgacagctttgtcatcagatagaaggaacggatgaccgtcgccaataatgttgttggttgtttaccgcgtggcaaattagcgtggattttgtatatagacatggttgcctttatttgcccgtcccctttgctgtggacataaactgagcttcgaaacactgtacagatattttgtaggatgttttagacgttaaatggcaccatggtgtgtaaagctcccatgactgccttggtagatgccctcttcctttacattgtacattgtatttatctttactcttcaaaaaaagaagcttgaaaaccgtaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1367 - DNA, 1979 bp, Zea mays
  Clone ID: PAT_MRT4577_159882C.1
gccggccgggttgggaaaccacactccactccagcactgaacacttgattgattcagtgggtagctagctagctgaatcacaatggatcctaccaaggtgagctcagtatactctgcttcttcttcttccgtcatatcgatctttgatttgagattcgtagctcagtacctgttttgtgttgtttacttgtgttgattttgcttgcagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtcaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggagccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcggcccggggctggtggtgccagggatctactactcggacgacaagatgctgcagtgccgggtgttcgcctacgccgacacgcagcgctacaggctgggtcccaactacctgatgctgcccgtcaacgcgccgcgctgcgcgcaccacaacaaccactacgacggcgccatgaacttcatgcaccgggacgaggaggtggactactacccgtccaggcacgcgccgctgcggcaggcggcgccgcccacgccactgccgcccaggccggtcgcggggaggagggagaaggcaaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaaggcaaacatgtgatgcttctgctgaatagaataataatgaagacgcatgcatgtcgtcgccaggaacaagagaaataatacaagaccaccacgcatgggcatactccatatatatatgtatagcccgtgcccgtgtccgcctttgtaccaatacaagccaagactagtggatgtattattattattattattgcgctatcacatacatgtacccctgctacctgaagatggatgtgtatcgagttatcaaattaagacacctgcagcaaaaaactatatatgttgcataaaaaaaaaaaaaaaaaaaaaaaaaa

SEQ ID NO: 1368 - DNA, 2248 bp, Zea mays
  Clone ID: PAT_MRT4577_159884C.1
agcataaaaagaagtacatgtaaaccacacttccactccagcactgaacacttgattgattcagtaggtagctcagctagcctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgcgtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtgaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctcaggcccgtggggaggctggtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggaccaaactacctgatgctgcccgtcaacgcgccgcgctgcgcgcaccacaacaaccactacgacggcgccatgaacttcatgcaccgcgacgaggaggtggactactacccgtccaggcacgcgccgctgcggcaggcggcgccgcccacgccactgccgcccaggccagtcgccgggaggagggagaaggccaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcttctgctgaataataatgaagacacgcatgcatgtcgtcgtcaggaacaagagaaataatacaagaccagcacgcatgggcatactctatattatagatggccaaaaagcacgaggcccgtgagcccggcacgaagcccgctttttgggcccggtccgagcacggcacggtagaataagcgggcgggcttgaacaggaaactaggcacggcgggctagcccggcacggcctgtttacctctaagcccgttaaacccgtttttttttacactaaaacgtgcttaccggcccgtttagcccgcttttcggcccgttatttcgtgctaaacgggccggcccggcccgtttaggcccgctgcgggccgggcttggacagaaacttaagcccgctggctcagcaggcccggcccggttttggccgggcttcaccgggcccgggccgggccgggccggcccggcccgtttggccatctctactctatatatatgtatagcccgtgcccgtgtccgcatttgtaccaatacaagccaagcctagtcaagtggatgtgtattattgttgcgctatcacatacatgtacccctgctacctgaagatggatgtgtatcgagttatcaaattaaggcaccagcagcaaacgctatatatatattgcataaaaaaaaaaaa

SEQ ID NO: 1369 - DNA, 2220 bp, Zea mays
  Clone ID: PAT_MRT4577_159885C.1
cctcgaggccggccggggatgtaaatcacactccactccagcactgaacacttgattgattcagtaggtagctagctagctgaatcacaatggatcctaccaaggtgagctcagtataatcttcttcttcctcctccgtcatatcgatctttgatttgagattcgtagctcagtacctgtgttgattttgctttgcgttgcagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgcgtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtcaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggcttgtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggaccaaactacctgatgctgcccgtcaacgcgccgcgctgcgcgcaccacaacaaccactacgacggcgccatgaacttcatgcaccgcgacgaggaggtggactactacccgtccaggcacgcgccgctgcggcaggcggcgcccgcccacgccactgccgcccaggccagtcgccgggaggagggagaaggccaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcatcatgcttgtgctgaataataatgaagacgcatgcatgtcgtcgccaggaacaaagatcgagaaataatacaagaccagcacgcatgcatgggcatactctatatatatatatgtatagcccgtgcccgtgcccgcctttgtaccaatacaagccaaaccaagtggatgtgtattattattattattgcgctatcacatacatgtacccctgcctgctacctgaagatggatgtgtatcgagttatcaaattaaggcacagcagcagaaactatatgtattgcataagaatactcgtctcgatatggacatgattccctcagctgctaatttgaagctatatgcttcggaatatctcgtgtatcctcgttgtcttcttctgaatacaactgtgggcaagaagttgattaccatgtcatttttcactggtcgatatttctatggctgcatatatataaaataaaagcgactttgacgtttcgattgtacacgttaccttttattcatttcaatataagtgccagtggtttgcattatttattt

SEQ ID NO: 1370 - DNA, 2062 bp, Zea mays
  Clone ID: PAT_MRT4577_159887C.1
cattgggtacctcgagggccggccggatgtaaaccacactccactccagcactgaacacttgattgattcagtaggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgccccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtcaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcggcccggggctggtggtgccagggatctactactcggacgacaagatgctgcagtgccgggtgttcgcctacgccgacacgcagcgctacaggctggggcccaactacctgatgctgcccgtcaacgcgccgcgctgcgcgcaccacaacaaccactacgacggcgccatgaacttcatgcaccgcgacgaggaggtggactactacccgtccaggcacgcgccgctgcggcaggcggcgccgcccacgccactgccgcccaggccggtcgcggggaggagggagaaggcaaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcatcatgcttgtgctcaataataatgaagacgcatgcatgtcgtcgccaggaacaaagatcgagaaataatacaagaccagcacgcatgcatgggcatactctatatatatgtatagcccgtgcccgtgtccgcctttgtaccaatacaagccaaaccaagtggatgtgtattattattattattattgcgttatcacatacatgtacccctgctacctgaagatggatgtgtatcgagttatcaaattaaggcaccagcagcaaaaactatatatgttgcataagaatactcgtctcgatatggacatgattcactcagctaatataaccctccaacaaattctataagatcctctcgctcctcagtctatggttgaatactcttatattcatcccaatcaacggattaaattggattgaggtgtaatttagggggtgtttggttcgtaaagattaattttagtccgtctcttttt

SEQ ID NO: 1371 - DNA, 365 bp, Zea mays
  Clone ID: PAT_MRT4577_160252C.1
ttatactcctatacctttctgcgaccggctttacaggaaccatgtccccgcaatgctcgcaagctactatagcttcccttcttcccccctacctctcaccacctgagtcttcggtatgttaaaacccaattcttcaaccctacaagatccaacaggcaatcacagctggcatcttacctttatcaccctttatccctacaacaatcatcaaccctattacatcacttaccttctatgcattaattgtcacaaaacattagcccacaacaactacaacaactttgtctaacataccttgctacctactctcagcaacaacactttctttcattcaaccaactagcttcatttaactctgcttctta

SEQ ID NO: 1372 - DNA, 397 bp, Zea mays
  Clone ID: PAT_MRT4577_160263C.1
cttaagattaacttagaataaagcctgacgggggtcacagcatgcatggatccggagtccatgctgttggatgcacgggtctgctggagccgaggatgaacacaggactaacatctgacacagagcgaccttgcaatcaaaaacacagatgggcaacaacaaacacgagacgaacgaagataaaccctctggactagggtaaacatcacggcagtgaacaggataactgggccgggcgggccccaccgctcagttgctccagttaccgtgggagttgcggtagccgtcgtcacggttgccacctgcgaagccggcgtcaccaccaccgtagccgtcgccgtcaccgtagtcgtcgacaccgccgtagccgtcgtcgacatcacggtgcccggcaccg

SEQ ID NO: 1373 - DNA, 365 bp, Zea mays
  Clone ID: PAT_MRT4577_160335C.1
gtgcaccacctagatgcaccactttttttccttaggatcgaacttataataaagcctgacgggggtaacaagccccatcgatccgcagtccatgctgaccgatgcgtgggtctgctggtaaccgtaggatgaacacattactaacaactgacacagggcgaccttgaattaaaaacacagatgggcaacaacaaacacgataccaacgaccataaacactctgtactatggtaaacaacacggaagccacacaggataactttgtcgaccgggccccaccggtcattttctccagtgcccgtctgagttgccgtatccgtcgacacagtagccaccgccgtagccgccggaccaccatcttattc

SEQ ID NO: 1374 - DNA, 1079 bp, Zea mays
  Clone ID: PAT_MRT4577_160418C.1
ccgggtatgaccgccccttctattcccttcctgctgtgaacaccctccacgcgtccgagtttttttgtcgtctggtcgtaaaaaagttgttgtgcttctcgtttcaccgtgcgccacaagcacacaactagggcgaccgccgccgacctacggccagctgtgcccatgtcttcgtcgggccctttgctggcgacgggaacccaccacaccggccgccaacctgaggttttgtgggctcagcgctccgagaagattttcttgactatctcattgccagatgcgaaagatgttgtgttaaagaccgatcctaagggcctctttaacttctctgctgttgtccatggggaaccttttagcttcactttggagctttttgattcaatactgtcagagggaagtaaaacgaagacaaagatgggcctgcgaaacataatctgctcaatccagaaagaaaagaaaggttggtggaagcgcttgctaaagtcagaggaaaagcatccatacatcaaagttgactggaacaaatggtgcgatgaggatgaagagtctgagttctctggggattcagatggtggctttgatgaggcaaatgaaggagatgaaagtgatgatgatgatgggatgctttatctccccgaccttgaaaagctaaggggcaagtgatctggctgcttcggtgaagggagtagggttgatgtaacaagttaccgttgacgtgacagagtaggcttatcatcgacgtagttggggtcttacttgctgagcatctgcgacggcttgagacttttaggcatgtcttctatctccgaagcactctttcggtctttcctgatcagtgagctagcgctctgaaaacgtagcgatgagctgtcccattttcgactaactatttagtgccagtgaatggcctaattctacaactatcacgatgtgcctatatgttaggggattatggattctgtggtccgtctttgtggtatgggatttccgttggcaggcaggccagtgtgatatgcagttcacttcgtttaaaaaaaaaagcggccaaaaaaaaaaaaaaactgagactagtctcgtgc

SEQ ID NO: 1375 - DNA, 1844 bp, Zea mays
  UNSURE (1)..(1844): unsure at all n locations
  Clone ID: PAT_MRT4577_160568C.1
  unsure (1)..(1844): unsure at all n locations
ccggccgggccggggttcacacaccgtcgcgagctagctagccacaccacaccttcctcctcactcccaattccatatagttcctctgcccacgcgcgcacaaaggccatggcgacgacgcggcctcgcggtgggggtggggcggcgagcggcgcgctggtcatggcgatcgtcgtgctgctgctactgccgccatatggagccggcgcggaggagtgcgaggacggcggcatcagcagccgggcgcgcgcgggcgaccgcgtggaggcgctgccggggcagccggcggtggcgttcgcgcagtactccgggtacgtggcggtggaccgggaccgcggccgcgcgctcttctactggctcaccgaggccgtcggcgacgacgcggccgccaagcccctcgtgctctggctcaacggaggtcctggatgctcgtcggtggcgtatggagcgtcggaggagatcggcccgttccggatcaaaccaaacgggacaggcctgttcctcaacaagtactcatggaacagagaggcaaaccttctgttcctcgagtcgcccgcgggagtcggcttctcctacgccaacaccacctcggacctcaagacgtcgggcgacgagaggaccgctcaagacgcgctgcagttcctggtcagctggatgtcacggttcccgcagtaccggcaccgagatttctacatcgccggagaaagctacgcgggccactacgtcccccagttggcaaggaagatcgtcgagtacaacgaggcctcgcctcaccccttcatcaacctcaagggaatccttgtgggcaacgcggagaccggcaactactacgacaacatcggcacggtcacctactggtggacgcacgccatgatctccgaccgcacctacaaggccatcctcaggtggtgcaacttcagcagcagcagcatctcccgcccctgcaaccgcgccatgagctacgccatgaaccacgaattcggggacatcgaccagtacagcatctacacgccgtcgtgcgccgccgcnnnggccagggccaacgccaccgtgctcaggttcaagaacaccctcgtccgccgccgccgctcctccggctacgacccctgcacggagacctacgccgagaggtactacaacaggatggacgtgcagagggcgatgcacgccaacaccacggggatcccctacagatggactgcctgcagtgatgtgctgatcaagacatggcaagattcagagttctccatgctgccgacgtacaagaagctgatgaaagcaggactgaggatatgggtgttcagcggcgacacagattcagtcgtcccggtgaccgcgacgaggttcgccatcagtcatcttggtctgaagatcaagacccgctggtatccatggtactcagctggacaggtaggaggatggtctgaggtgtacgaagggctcacgtttgcgtcggtgagaggcgcagggcatgaggtgccgttgttccagcccaggagggcgttcaggatgttccggtcgttcttggccggggagccattgcccaagtcctgaaggttcctgacatgtgactgaggcnnnnnnnnnnnnnnnnnnnnnntctagctacggtcctcacggaaatgtagaagacgggtgagaaggtgccgttccccaggtagagaatgacttgttgataggcgcgcagttcatagctgaggagtgattgattggtctcgggagaaggatgtagagaataataaggatggctatgttatgccatggaaacccatgagccattgcaaaatgattnaagcgaataatttcagtgtctcctctcaagtgcttatgttatgttatgttat

SEQ ID NO: 1376 - DNA, 1383 bp, Zea mays
  Clone ID: PAT_MRT4577_160779C.1
tcaacaagggcggccgggatcaccacattcggcataaccgcacgccttcccgttgtccatttgctccacgggccagcctgccggcgccgccactgcaaagtccgtacacacagacacacaacgcacgtcaccgccatgtctgccgccactgcttgcatgcccctggtccttgatccgtctcctctccatggatcggcggcaatggcagatgccgttgagaggcggcagcccggtggcatggagaccaccaagaccggttccgagggaacgctcggccgcgtcgtcaggagccaagtgtttggcaacgaggacgacgaccgtgctgggcacggcgacggcgacgaggtgagcaagccgcgggcggtggtccacacactgacgtgcgagcgcaagccattgttcgagggcttcgcgctctggcggagcatcggcaggcctgagcttcccgaactggatccaatcttatcgttcgacgaattcgagttttctgctccagctggcttccttgaccatcctcacaggggatttgagaacgttacctatatgctcgaggctgcttcaggcggcatcagttaccacgacttttcaggccacaagggaaccatcaacccaggagacgttcagtggctgacggcggggcgcggcgtcgtgcacgcggagatgcccgccgccggccagggagtacagaggggcatcaacatctggatcaacctctctgccgccgacaagatggtggagccgaggtaccaggacctggcgagccacgacatccccgccgccgcggcggacgccgctggcggcgtctccgtcaaggtcatcgcgggcgagtgcctcggcgcgcgctccccgctccggccccgcaccccggcgctgtgcctcgacgtcgccctgcggcccggcgcgcgcctgcgccagcctgtcccgcgcgggtggagcgcctgcgcgtacgtcatccacggcgaggccgccttcggcactgcctccggcgagggtaacggcgcctccacggctaccgcgcgcacgctcgtcgtgttcggtggcgacggcgacggcgtggagctgcggggcgatgcagcgggccagggcgcgagggtcatgctggtcgcagctcggtcgcacggcgaggcggtggcgcgggacggccccttcgtcatgaatacccgggaggaggtggaccaggcgcgggaggactaccgccaccgccgcaacggcttcgagatggccgacggctggacctccgatcacgcctccgcagctgaaaagcattcataggatacacctaccttaggctagtcgcgcgcggatgcaactgtgtaaggctttatatgtagtttgatttccatcaataatccacaagttttatttccaaaaaaaaccccaaaa

SEQ ID NO: 1377 - DNA, 1547 bp, Zea mays
  Clone ID: PAT_MRT4577_160794C.1
ctcgaggccggccggggcagcttcagccaccaagagaccagggctgaactgctgaagctgagataggattgagaatcgctgccagtggaaagcggcactagcagcagggcagaagcaagaaccagcaagaaaggggagagagaaagcggaaggactttttctcggattggatccttcgcttttgggggaaggagaaggcccctctctgtcctctctccatccttgcggagggcgctagcaggagcagcggaaggaggaagagatgttcccgcctggcctgatccaccaccgccctgacgcccccgttcccggcgatggggcgacacgctccggccccggcgggccgagccttgtactgacggcggaccccaagcccaggctgcggtggacggccgacctccacgagcgtttcgtcgacgccgtggcccagctcggcggacccgagaaagcaacaccaaaaactatcttaaggacaatgggcgtcaagggtcttactctttttcacttgaagagccatcttcagaaatacagattagggaaacaatctggtaaggagggatcagagcaatctaaagatgcatcctatcttctagatgctcaaagtggaatgagcgtgtcccctagagttcctgcccaggatatgaaagaaagccaagaagttaaagaagcactgagagcgcagatggaagtccaaagaagactgcatgaacaagtggaggtccaaaagcgcgtgcagatcagaatggaagcgtttcagaagtacatcgacagtatcctggagagcgcgtgcaagatggtcaccgaacagttcgcttcaagtggcttcagcatctctgaccctgatctcccggagatatcccctggaggggtggtcatgtgtggcggccccacggacacgttgagctcgtcggtgttcaaccagctttccgtcagctccatcggctcgcacagtccaggaggcaaaccttccccttccccatcaggcatggaatgtccgccgctgctcctccacaagtcgcatgagctcaagcggaggtcctcttgaactgacaaatcggcgaagcctgagggcgcggtgatggctgtctttgctagtgttgtcggatatggtggtactggtggtgacaagggaaattggtggtccagtcttgtggtagctgactttctccaggtagcaagatattgctgtgtttgtttgatcagtcaaagcatcaaacagacagacctacgttcatgtgaactgcctcatgcatgtgctagattgaaaaaaaaagttatcatattttgtcatgagattatgattctactagctagcatccttagcacacttgagatgttgttgactcgtgtcctagtgtcctctgtgttgatccatgtatgcacagcgattcatgttgggagttgggactgggacatgttaacaccagatgtttcaagcttcgtacttaaaaaaaaaagatgtggacatgcatgcagcaggcatcccagtactacacctgctgttgaacttgaacactactgtattcagcctatgaatgattcatgct

SEQ ID NO: 1378 - DNA, 1986 bp, Zea mays
  UNSURE (1)..(1986): unsure at all n locations
  Clone ID: PAT_MRT4577_160925C.1
  unsure (1)..(1986): unsure at all n locations
gacaacaccaaaaggacaagcctcgcccctccctccctccctccctccctttccaatcctcagaaccaataaaccgtagacgagagaagttacgagcttctccttgtcccgtgtcttttcaaggatagcccgggcgcagccgcagcatttcttggcgtcggtgtccgcgggttggcgactaagcaatggcgacgaggaaccaccgcgccgctgccgctccgcagccggcgaacagaggtgccgcgagggtcgccgggaaacagaaagccgccgccgccgggacacgccgagccctcggtgacattggcaacgtcgtctccgatgccctcgacagggcgatcaagctgccggaggggatccatcgccccatcaccaggagcttcggcgcccagctcatgaaggccgctttggcgaacaagaacgccgacgccgccgtagctcctgctcagcctgtagcggcgcgcgccgttacgaaaccagctaggaaagtgactacgaagaacgtccctcgtcctggcgctgggcaggctcccaaggagaacaagaagccatcagcagagggtgccgccgccggcagcggccgctctgtgcagaagaacaggaggaagaagcccgcgtgcacgctttcgaccgtcctttctgcgcgttctaaggctgcctgtggccttaccgagaagccaaaggagcccatcgaggacattgacaagttcgacggcgacaaccagcttgctttggtggactacgttgaggacatctacacattctacaagaccgcccagcatgagagccgccccattgactacatgggcaaccagcccgagctcagccccagaatgcgctccatcctcgcggactggctcatcgagtctcaccgaagattccagctcatgccggaaacgctctacctcacaatatacatcgtggaccggtacctgtcgctgcagcccacgccgaggagggagctccagctcgtcggcgtggcagcgttgctgatcgcctgcaaatacgaggagatctgggcaccggaggtaaatgacttaatccatatagccgatggcgcgtttaaccggagccagattcttgccgccgagaaggctattctgaacagcatggagtggaaccttacggtccccaccccgtaccacttcctgctgcggttcgcgaaggctgccggtagtgctgatgaacagcttcagcatacgataaacttctttggagagctcgcgctgatggactacggtatggtgatgaccaatccttcgacggcggctgcttgcgctgtgtacgctgctcgcctcacgttggggaggagtcctctctggacagagaccttgaagcaccacactggcctcaacgagcagcagatcatggaaggcgccaagacactggtcggatctcatgctgctagtgctagccctgatggcgaggctgaaggccgtctaccagaagtacgccacggagcagtttgggcgtgtggctctgcacccaccggcaccgactgctcttcccgaccttgtctagagtttttacttgacaagctgagggatttggttgagttcgctttgattgacaagttcgagagttgtttcgtatactctattctcgcgagtgtattagacactagtagtaacaactattcataactatatgaataaccacaatgaaaatttatgattggctgaacttctttcgaaagactgtgaggtatttccacagttttgtaagactgtcagaatgaaacggtcttgattaaaaagagctgtctgccaactgcatgaagaagctccgtcttcgacgtgaaataagtaggacggcgcggctgcttcggtgagccgtgccacgggatcgggagctccaaaaaaaaaaaaaaaaaaaaaaaaaaaaaaaaaaaaaaaaaaaaaaaaaaaaaaaaannnnnnnnnnnnnnnnnnnnnnnnnnnnnnnnnnnnnnnnnnnnnnnnnnnnnnnnnnnnnnnnnnnnnnnnn

SEQ ID NO: 1379 - DNA, 386 bp, Zea mays
  Clone ID: PAT_MRT4577_160953C.1
atctacgggcacagcacatcagggcacaacatctacaacaacttgtgctagcaaacctgtgctgggtactctcagcatcagcgggttgttacattcaaccaactaggaccatggaactatgcttctaatgcgcaacttcttcaactacaattcagacaactacctgctgcataccgtgagcaatttcttgcattcaaccacctaacagcattgaactctgctgcttacatacagcaactacaactactaccattcaaacagctagctggcgtaagccctgctaccttcttgacacatccacagtcgctgccgatctaccatcacgttgtagcctaacgctggcacgctattacaagtgcaacaatcgctgccattcaaccaacttg

SEQ ID NO: 1380 - DNA, 291 bp, Zea mays
  UNSURE (1)..(291): unsure at all n locations
  Clone ID: PAT_MRT4577_160962C.1
  unsure (1)..(291): unsure at all n locations
cgnctccacagcaacccgtatcgtcttctccgtcttgtccggttcgggtggtccgcggtcggggtcagtgagtgagcaggtttgcttctccatctccccgttcccttccctccgcagcgccccggcccggcggcggtgcgtgaccctgacgccgcagcgctacctatctcgccggaatcgcacgtggcggcgcgcgagctgagagcacaggagcacctgaccggctcgggcaggcgaccgccacaaaagaccgcgggagagcagctgtggagactgcggcggcggcggcac

SEQ ID NO: 1381 - DNA, 369 bp, Zea mays
  Clone ID: PAT_MRT4577_160976C.1
cgtccgtagacacacacaaacagagcgggaagagtaaataccacactcctaccgtcctacgtagagtaggaaggactcgagatggacaccgtcatggtgcccgtggtggccgatgcaaatggtatcttaaaggtgcagcgcacggtgcctgtatagctactgggaggagcactccaagtgcctgactgacgattacatgatgctcgactccctagccgccgacctcaacacggaagagcgaccctacattctgtctttggttccctcttacaaagggacatcaagtctaaaacttggtgctgttataggaccctctactggacatctggcaaaagaagctggagacgttgtgtcactagactttattga

SEQ ID NO: 1382 - DNA, 328 bp, Zea mays
  Clone ID: PAT_MRT4577_161126C.1
cgatcctctgcgggtcattcttactggggaccggattcgttgctttcttgcttccatctcatgttggaggactgagagagggagttgtaatttcaaataccagctagaggactgtcactcagctgttaagctggtatataatgggtggctgctgccgctgttggtgcataacatctgaagcagttagagcacgagcacgagcagatatatatgatcaacaatatgttgacgagcaggaatcatgggcttcaatttttgatggatcatattcagcctctgcaattgttgcattatacacaaatatggatactttcacacctgacacata

SEQ ID NO: 1383 - DNA, 2550 bp, Zea mays
  Clone ID: PAT_MRT4577_161280C.1
gggcgagagagcggaagcgacccagcagcgaagcgacgactagctctgcggcctctgcctgccccaagcgccgacgatgggtgccggtgctactgccagggacgaggaggctgctaccggccgccaccatgggaggaagccgcatggcgcggcggcggagtacgcgcaggacgggtccgtggacctgcgcggcaaccccgtgctccgctcccagcgcggcggctggaccgcctgctccttcatcgtcggtacgtagcgcgtgcgggcggtgtgccggtgtgtgtgtcgactgtcgactagctacttcctgtttcactcttgctcttgtcgttgcccgcccctcctcggtagagatggatgaaccgcgcgaatggacgatacggccgggcgcctgatgcggtgtgtggtgcatgcatgcagtgtacgagctgttcgagcggatggcctactacgggatctcgtccaacctcatcatctacctgacggacaagctccaccagggcaccgtcgaggcctccaacaacgtcaccaactggtccggcaccgtcttcctcacgccgctgctcggcgcctacgtcgccgacgcctacctcggccgctactggaccttcgtcgtcggctccgccatttacctgctggggatggtgctgctggtgctgtccgtctcggtgccggcgctgaagccgccgccgtgcggcgccggcggcgtgtgcccgcaggcgtcggcgctgcagctcggggcgtacttcggcgggctctacatcgtggccctgggcaacggcggcaccaagcccaacatctccaccatcggggcggaccagttcgacgagttcgacccgcgggagcggacgcacaagctgtccttcttcaactggtggatgttcaccatcttcctgggcatcctcttctcctccaccgtcctcgtgtacctgcaggacaacgtgagctggtccgtgggctacggcatccccacgctgggcctcatggtctccatctccgtcttcctcgccggcaccaggctgtaccgccacagggtgccgcagggcagcccgttcacgagcatgggcagggtcctggccgccgcgctctggaagtggagcgtcccggtcccggccgacgccaaggagctgcacgagctggacgtcgaggagtacgccaggaagcgtaggttcaggatggactccaccgacgccatggccttcctcaacaaggccgccgccgtggccgtgcccagcggcgggccggcgtcgacgccggcgtggagcctctgcacggtgacccaggtggaggagacgaagcagatcctgaggctggtgcccctcctggtggccatgatcgtgccctgcacgctcatcgcgcagaccaacacgctgttcgtgaagcagggcacgacgatggaccggcacatgggcccgcgcttcgagatcccggcggcgagcctgggcgcgttcgtgacgctgaccatgctggtggctgtggtggtgtacgaccgggtgttcgtgagggccgtgcggcggtacaccaaggacccgcgcgggatcacgatcctgaggcggatgggcacgggcatgctgctgcaggtggcgaccatggcggtggcgtcggcgatcgagagccggaggctggcctacgcgcggagccacggcctggacgccacggggggccagctggggctcaccatcttcgcgctgctcccgcagttcgtgctgatgggcctggccgacgcgttcctggtggtgggcaagatcgagttcttctacgaccaggcgccggagagcatgaagagcctgggcaccgccatgtccctcaccgcgtacggcatcggcaacttcctcagcagcttcctgctgtccacggtcacgcgcgtcacgcgggaccgcggccacgcctgggtcaccaacaacctcaacgcctccaacctcgactactactacgccttcctcaccgcgctcggcgccgtcaacttcgtcgccttcctcgcgctcagcgccaggtacaggtacaaggcccagtccaccgacacgatcgacgctgccgtcggcctggggaccgagaaagccaagcttcaggcggagccactgggctgacgtcgacgacgacgacggggtgcgtctgcctctgctgttaaaagcggagaagatcagccatgaatgcgtatcgtccaaggcgacgtgtgtatggtagcatcaactcacttgtaaaaaaaaagcacaggatttccacccgaaaccaaaagcagtgtctgcagtatcaactcccttgtaaaaaaaagacagtccatgatctttcatttcattcacacgcaaaaaaaaagagtatagatcgatccaaaaaaaaaaaaaaaaaaagcctctacatgcacggtttttagctcgtagtatgtagtacgtactgtgattgtgaccatcaactgaactctccacgcatgcagctagacggagcaagtactgttcttcagacagattcgcatggtgcatctgtagcatgcagtgactggcattcaaaaatacagtagtttcatcgtgacgatcggtagcattcaaaacaccc

SEQ ID NO: 1384 - DNA, 757 bp, Zea mays
  Clone ID: PAT_MRT4577_16136C.1
ggatctagactactacacgaatcacgaacgcgtccacctgcgcgcatcgccacgcaggttctctccaccaaaccttaacctccccttccagaaaccctccaagaggcagctcaaaggaatagtgagccgccccgccgctcctcagccatcctctccatctcggtgtcacacactccgcatacgcacctacgagagtcgagtgacagcgagcgagcgagcgagcgaagccatggctctccgcaccctggcatcgaagaacgccctatccttcgcgctcggcggcgcggcccggccgtcggcggcgtccgcgaggggggtgacgacggtcgcgctccccgacctctcctacgacttcggcgcgctggagccggccatctcgggggagatcatgcgcctgcaccaccagaagcaccacgccacctacgtcgccaactacaacaaggcgctggagcagctcgacgctgccgtcgccaagggcgacgcctccgctgtcgtccagctccagggcgccatcaagttcaacggcggcggtcatgtgaaccattcaatcttttggaagaacctcaagcctattagcgaaggtggtggggagccgccacatgggaaacttggctgggccatcgatgaggattttggttcatttgaggcacttgtaaagaggatgaatgcagaaggcgctgctttacaaggatctggatgggtgtggttagctttggataagaggcaaaaaactttcagttgaaactacagctaatca

SEQ ID NO: 1385 - DNA, 303 bp, Zea mays
  Clone ID: PAT_MRT4577_161386C.1
ccggccgggccggggctgccttctccctcatctcccgttccatttccccatctccacagatccgattcgcgagtgctccctcctctgccggcatggaggtctctgtgtgagaagacctcctgtggacgggagtacaatgtcaaggatctctcacaagaggacttccgccgcctccagattgagctcggtcgaggtcgaaatgcccggcctcatggcgtgccgcgtcaagatcggaccgtccaagaccttcatcgacgataggatctcaatgtctctccacatgaccatccacaccagcgacct

SEQ ID NO: 1386 - DNA, 269 bp, Zea mays
  Clone ID: PAT_MRT4577_161406C.1
ctggctaatcttgactgctcggaggaagttggatgctatcgaggagaaggatcgagggctcgatgagtaagacgggtttctggtgtcgatctgcttctgagtttttttttctttacatatcactgcgaactcgtagttgtcctttggttatcagccaaaccaccctattagctccaataatgccttctctcaacatgtgatgctacaattccacatgctttgtacatctgtatacagctagctctaagtgggcagccgctttataccca

SEQ ID NO: 1387 - DNA, 282 bp, Zea mays
  Clone ID: PAT_MRT4577_161669C.1
catttctcagatccaattcgccagttctgcgtcgtgtgcggtcatggtgctctctattgaaaacacctgggctggacgggagtacaaggtcaaggatctgtcccaggcggacttacgccgcctcgagattgagctggccgaggtcgaaatgcccagccttatggcgtgccgcacctagttcagcccgaccaagcccttcgccagcgctaggatctccgggtctatccacatgaccatccagaccggcgtgctcatcgagaccctcagcaggctcggcgccta

SEQ ID NO: 1388 - DNA, 1547 bp, Zea mays
  Clone ID: PAT_MRT4577_161720C.1
ctcgaggccggccgggggcccgcgcctcgctctctcttgtctcgcccgctagctcccatcccagcctcccaccgcgcccgcctgccccaacatcccccctccccgctccgctccttggcagaaaatggcgatgatggtggatccccccaatggcatggcaagtcaaggaaagcattactatactatgtggcagacactgtttgagatcgacaccaagtacgtgccgatcaagcccatcggaagaggagcttacggaatcgtttgctcatctgttaaccgcgagaccaatgaaaaagtcgcgataaaaaagataaacaacgtctttgacaaccgtgtggatgcgctaaggacgctgagagagctgaaactccttcggcacctgaggcacgagaatgttattgctctcaaggacataatgatgcctgcgcatagaaggagcttcaaggacgtttacttggtttatgagctcatggacactgatctgcatcaaataattaagtcatctcaaccactatccaatgaccactgccagtatttcctttttcagctgctccgaggcccgaagtacctccattcagccgggatactccacagagacctaaagccggggaacctcctggtcaacgcaaactgtgacctgaagatatgcgacttcgggctcgcccgcacgaacaacaccaagggccagttcatgacggagtacgtggtgacccgctggtacagggcacccgagctgctgctctgctgcgacaactacggcacgtccattgacgtctggtctgtggggtgcatattcgcggagctgcttggccgcaagccgatcttcccaggaaccgagtgcctgaaccagctcaagctcatcgtcaacgtcctcggcaccatgggcgaggccgacctcgcgttcatcgacaacccgaaggcccgcaagtacatcaagtcccttccgtacgccccgggcgcccccttcaccggcatgtaccctcaggcgcaccctctcgccatcgacctgctgcagaagatgctcgtgttcgacccgtccaagaggatcagcgtcaccgaggcgctggagcacccgtacatgtctccgctctatgacccgagcgcgaaccctcccgcgcaggtgccgatcgacctcgacatcgacgagaacctcggcgtcgacatgatcagggagatgatgtggcaggagatgatccactaccaccccgaggtcctcacgagaatcagcatgtgagtatgtgatgtgaccagacaggcagcaatgaaacatgtggacagaggtctgctgcgccaggatcatcacatgttcgcccttcttacgagcttaactgcgattacggcaccgagtcgaggtatcactacatgtatcggaaccgtcgggcggtctcttgtgtaaatatgcgctgaataagatgtgtggcaatctcttgttttttggttgtacatggacctcgctgttgtacgagtctgtgaagtggaaccctggtactaagacctgtaatttcagaccctaatctgttgtatggaaatctgaaggccttgactcg

SEQ ID NO: 1389 - DNA, 1797 bp, Zea mays
  Clone ID: PAT_MRT4577_161721C.1
cattgggtacctcgagggcggccgggtgggcggctcccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggccgtgccatcctggcgacgatgacagcgtaagcgggcggcggacgaccgcgcccccccggcccctactcccgaggtcattggcgtgtgctccttggcagaaaatggcgatgatggtggatccccccaatggcatggcaagtcaaggaaagcattactatactatgtggcagacactgtttgagatcgacaccaagtacgtgccgatcaagcccatcggaagaggagcttacggaatcgtttgctcatctgttaaccgcgagaccaatgaaaaagtcgcgataaaaaagataaacaacgtctttgacaaccgtgtggatgcgctaaggacgctgagagagctgaaactccttcggcacctgaggcacgagaatgttattgctctcaaggacataatgatgcctgcgcatagaaggagcttcaaggacgtttacttggtttatgagctcatggacactgatctgcatcaaataattaagtcatctcaaccactatccaatgaccactgccagtatttcctttttcagctgctccgaggcctgaagtacctccattcagccgggatactccacagagacctaaagccagggaacctcctggtcaacgcaaactgtgacctgaagatatgcgacttcgggctcgcccgcacgaacaacaccaagggccagttcatgacggagtacgtggtgacccgctggtacagggcacccgagctgctgctctgctgcgacaactacggcacgtccattgacgtctggtctgtggggtgcatattcgcggagctgcttggccgcaagccgatcttcccaggaaccgagtgcctgaaccagctcaagctcatcgtcaacgtcctcggcaccatgggcgaggccgacctcgcgttcatcgacaacccgaaggcccgcaagtacatcaagtcccttccgtacgccccgggcgcccccttcaccggcatgtaccctcaggcgcaccctctcgccatcgacctgctgcagaagatgctcgtgttcgacccgtccaagaggatcagcgtcaccgaggcgctggagcacccgtacatgtctccgctctatgacccgagcgcgaaccctcccgcgcaggtgccgatcgacctcgacatcgacgagaacctcggcgtcgacatgatcagggagatgatgtggcaggagatgatccactaccaccccgaggtcctcacgagaatcagcatgtgagtatgtgatgtgaccagacaggcagcaatgaaacatgtggacagaggtctgctgcgccaggatcatcacatgttcgcccttcttacgagcttaactgcgattacggcaccgagtcgaggtatcactacatgtatcggaaccgtcaggcggtctcttgtgtaaatatgcgctgaataagatgtgtggcaatctcttgttttttggttgtacatggacctcgctgttgtacgagtctgtgaagtggaaccctggtactaagacctgtaatttcagaccctaatctgttgtatggaaatctgaaggccttgactcccaaaaaaaaaaaaaaaaaaaaaccgatcgcgatctagagcgggct

SEQ ID NO: 1390 - DNA, 335 bp, Zea mays
  Clone ID: PAT_MRT4577_16178C.1
aaaaaaaaaaaataaaaaaaaaaaattaaataaaaaaaaaaaaaaaaaaaaaaaaaggaagggtaaaaaaaaaaaaaaaaaaaaaaaaaaaaaaaaaaaaaaaaaaaaaaaaaaaaaaaaaaaaaaaaaaaaaaaaaaaaggggcgccccttttaaagaacccaactttacttccccttcatttcaaaataaaagcttttttaaagggcccccaaatttaaattaattgccctttttttaaaaacttcgaaattggaaaaaccttggttttccccaatttaatccctttggaaaaaatcccccttttccaaattggcttaattacaaaaagcccc

SEQ ID NO: 1391 - DNA, 2375 bp, Zea mays
  Clone ID: PAT_MRT4577_161959C.1
ttgggggtaaccccgggccgtagttgtaggccttccacttcgcctcctcttctctctctcccccgtctcctgtctccacctgttccatcgcattctcctcccaccaccaccacaccaggcctcgcttatccccccccccccgagacccgacccctgctcgacgacgtgctggcaaaacctcctcctagtcctctcgcagaaggaggctgtgttcttttcttcatcggcgcggcaacagcgaaagcttctcggtctctcccaccgctgctccgccgtttgggtggttccgcgccttggccgcgcgggttggatccgagctccgtgcagcagctccgccgcgatacgtatcgcataggattccactggattcagctgctgagcagggtactggaaggtggatttgatactagctctgaacagccagtagaatttctcaaatactgtccaggatcatggcttctctctgtgatttctgtgggaaacaaaggtcaatgatctactgcagatcagatgcggcatcattgtgcttatcatgcgaccgtaatgttcattcagctaatgcactgtctcgacgtcatacaaggacccttctttgtgatcgttgtggttcacagcctgcatcagtccgatgtcttgaggacaacgcatcactttgccaaaactgtgactggaatgggcatgatgcagaatcaggggcttctgggcataaaaggcaagccataaactgctactcagggtgcccatcatctgcagagctttcgagaatctggtcatttattactgatatcccgactgtagcagctgagcccaactgtgaggatgggctaagcatgatgacaattgatgacagtgatgtgactaatcatcacggtgcttcagatgataaacgattgttggaaatagctaacacagcactcatgagtgatccaccttcacccgacaagcttaaatctccgacaggctcttcttctggagatgggtttgatgttatgactctagccacagatcagcctgctggaccagtttcagcaacgcctaaggtacctaatgccagagatgatgataagttcaatgatggcatgtacgaagacttgtgtgtagatgatgctgaccttacattcgaggattatgaagagctatttggtacctctcacattcgaacagaggaactctttgatgacgctggaattgacggttacttcgaattgaaagagacaccacctttttatttcaacgagcagcccaaagctatgcagatagaatgtggcaacgtggtatcagctgattgtgcgatgtcaaacccaggggcaagggctgattccagcctttgtattcccgtcaggcaggtcagatctagtatatcccactccttatctggtctgactggtgagagcagcgctggagatcaccacgactgtggggtgtcaccaatgctcctcatgggtgagccaccctggcattctcctggtggtccagaaggctcagtcgctggaggcagcagagatagcgctctcacacggtacaaggagaagaagaagaggagaaagtttgacaagaagatcagatatgcttctcgcaaggctagggcggacgtgaggaagcgggtcaagggacggttcataaaggccggtgaagcgtacgactatgatccgctaagccagactagaagctactgagccttgggagtgtgactgttgttgtcgtccagtgtcagcctcgcaatctccagccgctcgtcggttgcaggctgcgctacaggcaagatcactggagagcacaacgatcgcattgcatcagagcctgcatctgaaaaaacgttaagaagagataccaagtgttgggatgaatgaaaaaaaaaagacaaaaaagaaagatgcagacttgccggactcatatccattattcagtttctctgcggatgagtggcttggatcgcactgtgccatctgcgcgtcgaacagatgcagtgatggatgggcgctcgtcgtcctccagctgtaccgctgtgcgctaggacctgcgtcggctatatacggctgttcggcagtgagctgccaggttgtacagtctgggtaacagcctaacagggtatgcttatacctctcggttttcgttctgtaatacgtacgtattgtttgcgcttgccaggagactgttcttcggccgtgtgtatgtttgtagatggttgcaacattggtaaaaaaaaaagtagccgtcgtgaatgtaaatttgtattcttgttaggtcgcatatagcgttggcgatgagcaggagaatcacacgtatctggacactgaacgacccttgtaactatttttgcgccagaataaccttcttgtgccttgtcgtttaaaaaaaaaaaaaaaaaagcggcc

SEQ ID NO: 1392 - DNA, 1623 bp, Zea mays
  Clone ID: PAT_MRT4577_161960C.1
cctcgaggccggccgggaaaaaaaaaaaaaaaaaaaaaaaaaaaaaaaacgtcctcttccagtctccactctccacgtgttccatcccattctcctccccgcgccccgtccccctcgcctcgcttatcccccggacccggccgacccctgctctgctcgacgtgttggcaaaacctcctcctagtcctctcgcagaaggagcttgttttctttaccggcgcggcaacagcaacagcgaaagcttctcgatctctctccccgctgctccgccgctgggtacggtggttccgcgcctcggacgcgcccgtgcgggttggttggatccgagctctgtgcagaagcgccgccgcgacacggtcgaattccactggatccagctgctgaacggggtaccagaaggtggatttggtagtagcactgaacagcgagtggaatttctctaatactgtccaggatcatggttcctctctgtggtttctgtgggaaacaaaggtcaatgatctactgcagatcggatgcggcatcattgtgcttatcatgcgaccgtagcgttcattcagctaatgcactgtctcggcgtcatagaaggacccttctttgtgatcgttgtggtttacagcctgcatcagtccgatgtcttgaggacaacacatcactttgccaaaactgtgattggaatgggcatgatgcagcatcaggggcttctgggcataaaaggcaggccataaactgttactcagggtgcccatcatcagcagagctttcgagaatctggtcatttattatcgatatcccgactgtagctgctgagcccaactgtgaggatgggctaagcatgatgacaattgatgacagtgatgtgactaatcatcacggtgcttcagatgataaacgattgttggaaatagctaacacagcactcatgagtgatccaccttcacctgacaagcttaaacctctgataggctcttcttctggagatgggtttgatgttctgcctctagccacagatcagcctgctggaccagtttcagcgacacctaaggtaccttatgccagagatgacaataagttcaatgatggcatgtatgaagacttatgtgtggatgatgctgacctgacattcgagaattatgaagagctattcggtacctctcacattcgaatagaggaactctttgatgacgccggaattgacagttactttgaaatgaaggaaacaccgccttttgatttcaatgagcagcccaaaattgtgcagctacaatgtagcgatgtggtaccagctgattgtgcgatgtcaaacccaggggaaagggctgattccagcctttgtattcctgttaggcaggtcagatctagtatatcccatcccttatctggtttgactggtgagagcagcgctggagatcaccaagactgtggggtgtcaccaattctcctcatgggcgagccaccctggcattctcctggtccagaaggctcattagctggaggaagcagagatagcgctctcacacgatacaaggagaagaagaagagaagaatgtaagcacgtttaaatgtctgcttgaggttgttctgcgcttaacattcatagatcgtggctatctttttaaggca

SEQ ID NO: 1393 - DNA, 326 bp, Zea mays
  Clone ID: PAT_MRT4577_162088C.1
taaaagcaacacaagacgaaaacagagagccagcaaagcaamcccarggmcwttgrggkgctgctctgctagsgtagtacgtgctamagcatgtcacgtacgaggtacacgasgacgacgacgacgaacggrgggacactaracgaataatcactagtgggtscatraycwacttctttattatktcccaccctgatgacacacacgtagcwaggacaycyctscaacgacgacgactgcatgcggckgagggccacgtacgcggccayccaacgagcgascaaccyccactatggttccatcgatcagttgatcttggtgcagtc

SEQ ID NO: 1394 - DNA, 545 bp, Zea mays
  UNSURE (1)..(545): unsure at all n locations
  Clone ID: PAT_MRT4577_162166C.1
  unsure (1)..(545): unsure at all n locations
ccgggncgacccagcgnccggcagccctcccccacaccaagccggggggggggctccctcaagaccggnncgggnggnccgcggncggggngagngagngagcagcnnngcnncnccaacnccccgnncccnncccnccccagccccccggcccggcggcggnacgngacccngacgccgcagcgcnagcnagcgggggggaacggcaggnggcggcgcgcgaccngagagcacagcagcaccggaccggcncaggcaggcgaccggcagaaaagaaggcgggagcagcagcngnggagacggcggcggcggcggcagcggccaacggaaaagcgngcngccacgccgccaaggggcccgggnacgccacgccgcnggaggccanggagaagggccccagggagaagcncgncnacgncaccngcgncaacaacggcacnggaannaacaagccggannaccnngcgacggnggannnggancccagcncnccaacanacncccaggnganccacaggcncccggncacccacancggcgacgag

SEQ ID NO: 1395 - DNA, 1801 bp, Zea mays
  Clone ID: PAT_MRT4577_16218C.1
cgtgggtagctagctaggtgaatgacaatggatcctaccaagttccgtccgtccagcagccacgacacgacggtgacgacgacgaacgctggcgctcctgtgtggaacgacaacgaggcgctgactgtggggcctcgcggtcccatcctgctggaggactaccacctgatcgagaaggtggcgcacttcgaccgcgagcgcatcccggagagggtggtgcacgcgcgtggcgcgtccgccaagggcttcttcgagtcgacccacgacgtgacgtcgctgacgtgcgccgacttcctgcgcgcgcccggcgtgcggacgcccgtgatcgtgcgcttctcgcaggtgatcccagagccggggtccggacggacgatccgagacgcgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgggtgttcgacttcctgtcgcacctccccgagagcctgcacaccttcttcttcctcttcgaccacgtgggcgtgccgtccgactaccgccacatggaagggttcggcgtgaacacgtacacgttcgtgagcgcggcggggaaggcgcagtacgtgaagttccactggaagccgacgtgcggcgagcggtccatcctgacggacgaggaggcgcgcgtcgggggacggaaccacagccacacgcaggacctgtacgactccatcgcggcggaggggagcttcccggagtggacgctgtacgtgcaggtgatggacccggcacagcaggagcagtacgacttcgacccgctggacgacaccaagacgtggccggaggacctgttgccgctccgccccgtggggaggctggtgctggacaggaacgtggacaacttcttgaacgagaacgagcagctggcgttcgggccggggctggtggtgccagggatctactactcggacgacaagatgctgcagtgccgggtgttcgcctacgccgacacgcagcgctacaggctgggtcccaactacctgatgctgcccgtcaacgcgccgcgctgcggcacccacaacaaccactacgacggcgccatgaacttgatgcaccgcgacgaggaggtggactactacccgtccaggcacgcgcgccgctgcggcagggcggcgcccacgccactgccgcccaggccggtcgcggggaggagggagaaggcaaccatacgcaagcccaacgacttcaagcagccaggggagaggtaccgctcctgggacgccgaccgacaggaccgattcgtgaaggcgattcgccgactcgctcggacacccaaacgtcagccagagctcaggtccatctggatagacctcctcgccaaggtcgacgcgtcgctggggatgaagattgccacccggctcaacatgaaggcaaacatgtgatgcttgtgctgaatagaataataatgaagacgcatgcatgtcgtcgccaggaacaagagaaataataacaagaccaccacgcatgggcatactccatatatatatgtatagcccgtgcccgtgtccgcctttgtaccaatacaagccaagactagtggatgtattattattattattattgcgctatcacatacatgtacccctgctacctgaagatggatattgtatccagttatcaaattaagacacctgcagcaaaaaaactatatatgttgcataagaaaaaaaaaaa

SEQ ID NO: 1396 - DNA, 806 bp, Zea mays
  Clone ID: PAT_MRT4577_162288C.1
tgggacctcgagcggcggggccggtgcacaggaaatctctatccacagacacacaagcagccagtgcagtagtagcccggtatatagagagtgtagcacgattatacaatatatcacagagctagctagttagtatatacgtactatatatatagtctattgctcgctagcttgctgaatcaagctgaactatatagtaagagactaattaaagagctattagccacagcgcgtgatccacgattaatggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcaccatgaagggcgccacggccgtgctcaacttccccaccagcggaggatcagctgccgcggctcccggcggccggaccagcggcggcggctcctcctcgtccaccacgtcgtcggctccggccagcagggggagggcccgtgttcccgactcggagaaggtggagctggagtgcctcgacgacagggtcttggaggagctgctcgcggaggacaagtacaacaagaactaatgaaacgctagctgatgcacaacatacatatgttggtagtagccttattagccgccgcaacgcgctgctagctagagctagctcttcgctgccgcttccagtaaattatatttaagggagacagaactatattaactttaatatactatactcactacccaatt

SEQ ID NO: 1397 - DNA, 3239 bp, Zea mays
  UNSURE (1)..(3239): unsure at all n locations
  Clone ID: PAT_MRT4577_162559C.1
  unsure (1)..(3239): unsure at all n locations
gttcttcctcccgttcttcccttgcttccccgtcgcgctgttcaacgttcaaacccttacacctcctcctcccttggccgcgcagtcgccattgacgacccgaccccctctcactctcccctcccttaaatccctcctctccccgcgtccttctccccatcaacgcttcattcgctccagtctcatcgaatccaattcacagccagccagacagggcgggagatctccaagaagctatcttggaatccgagaacaccttgcattcgcggtcagtcaaggattcgaattctgacggacgagctctccggccaaaaaagtcagataattttcgggatagctcgggtggcgtctcggcaaccggaggagaccccggggggattaaggaaggggcaagatggtgaggctgccttacacaacggcgctgaccacgctgttcagctacgggctgctcttcgccttcggccagctcagggatttcttccgcaagttcgtcgactggttcaaggccaagaacgcaaggtacgcagggcggccggccggccggccgaattccgcctccccgcacccggatccgggagattccgtcccaatttttcttggtatttctgattcagcgtttggcttcatacagggctacgcgccgatctgcctggngcctggaggatttctatgtgcgagcgagttatctccggctcgaacccgtactcctcaagcaaaaccactggaggagcaccaagagttatctccggctcgaacccgagccaggtcctgactcctgatccgcaccgcacacggcaagggggcatagccgacgggccgtcagcggcgagacccaagccaacacagcccagcgatgtcggcgcgtgaccgcgagacggccgaggcgctggtgcgcctcgccgcctcgctggacggggcggtgctcggcctcggcacggctgccgtcgccgtcgcgtcgtgggtcaagtacctcgccgtctcggggcagctacgcctcgtcgcctccgcgacgacggcctccatcgccgacgcccactccctcctctcaggcgacggcgccgagccgcggatcgccgcggtgcggggctacgtgcgggcccatgacaagttcttccgggccccgttctcaggcgaggcgggcgtcgtcacgaagcacacccagatgtgtttgttcacagaatggagaggcatctttggatggacctttgatctgcatgctcttcttttcagatcatggaaagagcaaattgtgacgtcttttagatcggttccatttgttctggttagtactgaattaggaaatcctacgggagtggtacatataaatgtggataaggcggatcaaccgttgcctcttactacagtgtttcataaacttatcccacttgagacgactccttacacattgtttcaaactattattggcaacggctatccgattgcgttgttggatgaagaaaaaatactaccgattggtaagaaaattacagcaataggactatgtcaagcaaaggatgcagaaagtgttgagataacatcgtgcccagagtccccttttttcttatctgaactaaccaaggatgagatgcaagctcagctggcttcacgtgctaggatactcttctggggtagtattgttttgggaaccttgtcggtttgcctagtgggccatgccatttacaggggctggacgagaatcaaactacgaagagaggctaggcatgcacgacagatgtttgaggaggctgaagatgctattcacagggatgactctagtgatgatgatgaaataggagacgggcaactatgtgttgtgtgcttaaggaagagaaggagggcagcttttattccatgtgggcatcttgtctgctgttccgaatgcgcattaacaatagagcgtacacctcatccattgtgccctatgtgtcgtcaagacatcagatacatgatgagggtttatgactcttgaggtatgctgctgataagatctacacgcttccttgctgacccatgcaaacctgaggagcacaactgttcgtcctgctgggcgttttcctagtcaaggtggcctaccctggatttgtgaatataatgtcttgaccctccaaattatgctcttgattgcctgggacaaatagcttagctgaagtcatgaactaacgtagagttattttttgtttgctttgcgcatatgtctatccatcatgtaaagcacagggtttactgcaaataggttaaagatttggacattttctgccatctgatcgtcacctctagtgctgtggaagaggttgcaaaaaaaaaaaaaaaaatgctgctcgtcgtgatgaacgcaatgctgttcctgctctacggtaacctggcaccagataacagcggtgtcggagccttatgcttgccagcggataacatcgccgaagcgtgaagtcttgttctgatgctggctgcgtggtgtttggtttgctagaacagtggtgtccactctacgccgaatcattgagaaactttcgtgttagcaaactgtaattttagaacaggcgtagagtggagtttttaaaactctaaactggctgcctggtgaatgctgttctagcaattctatggttttactaacgtagagttattttttgtttgctttctacatatctctgtccatcatgtaaagctcagggtttactgcaaatagtttaaagattaaaacattttctgcgttagttcatgacttcagctaagctatttgtcccaggcaatcaagagcataatttggagggtcaagacattatattcacaaatctagggtaggccacctagactaggaaaacgcccagcaggacgaacagttgtgctcctcaggtttgcatgggtcagcaaggaagcgtgtagatcttatcagcagcgtacctcaagagtcataaaccctcatcatgtatctgatgtcttgacgacacatagttgcccgtctcctatttcatcatcatcactagagtcatccctgtgaatagcatcttcagcctcctcaaacatctgtcgtgcatgcctagcctctcttcgtagtttgattctcgtccagcccctgtaaatggcatggcccactaggcaaaccgacaaggttcccaaaacaatactaccccagaagagtatcctagcacgtgaagccagctgagcttgcatctcatccttggttagttcagataagaaaaaggggatctctgggcacgattttttttttcnccggccgg

SEQ ID NO: 1398 - DNA, 283 bp, Zea mays
  Clone ID: PAT_MRT4577_162639C.1
agaagaaggatttgctcacgggcacctacatgccttccacctccctcaccggcatctaccgcgtcatcacgtacctggacccctccgagcacatacacactaaggcgaagcagctgcacttcaccctcatgcgctcccgcaatgacgacgttatccctaccttccgctccaacttcttctcgctcttcgccaccgcggatgctgagcatgccaagggtggcaaggccgagttcaacaagctcaacgacgttacttccttcgacttcatcggcgatgcctactt

SEQ ID NO: 1399 - DNA, 1698 bp, Zea mays
  Clone ID: PAT_MRT4577_162655C.1
cccgttcctctctatctcacacacaggcacaccgagtagaaggcggcagttgccagccagcacaagcagagcgcaacccgtgggcggcagcggcacgcaatggtgtcggagaggcagcaggcggcggggaaggtggccgccttcaacctcacggaggccgggttcggcgacgggtcggacctgctggacgacgacgggcgcgagaggcgcacggggaccctggtgacggcgagcgcgcacatcatcacggcggtgatcgggtcgggcgtgctgtcgctggcgtgggcgatcgcgcagctggggtgggtgatcggccccgtggtgctgctggccttctccgccatcacctggttctgctccagcctactcgccgactgctaccgcgcgccgccgggccccggccagggcaagcggaactacacctacggacaggccgtcaggtcatacctgggggagtccaagtaccggctgtgctcgctggcgcagtacgtcaacctggtgggcgtcaccatcggctacaccatcaccacggccatcagcatgggggcgatcaagcgttccaactgcttccacagcaggggccacggcgccgactgcgaggcgtccaacaccaccaacatgatcatcttcgcgggcatccagatcctgctgtcgcagctccccaacttccacaagctctggtggctctccatcgtcgccgccgtcatgtccctcgcctactcctccatcggactcggcctctccatcgcaaagatcgcaggcaagctcatgcatggcagctactgtacgtacgttctatctctcattctgagtcgagacttttaattgactgcaggtggggtgcacgttaagacgtcgctgactggtgccgccgtgggggtggacgtcaccgcggccgagaaggtctggaagacgttccagtcgctgggggacatcgccttcgcctacacctactccaacgtgctgatcgagatccaggacacgctgcggtcgagcccgccggagaacgtggtgatgaagaaggcgtccttcatcggcgtgtccaccaccaccgcgttctacatgctgtgcggcgtgctgggctacgcggcgttcggcagcgacgcgccgggcaacttcctcacgggcttcggcttctacgaccccttctggctcatcgacgtcggcaacgtctgcatcgccgtgcacctggtcggcgcctaccaggtcttctgccagcccatctaccagttcgtggaggcctgggcgcggggccgctggcccgactgcgccttcctccacgccgagctcgccgtcgtcgccggctcctccttcacggccagcccgttccgcctcgtgtggcgcaccgcctacgtcgtgctcaccgcgctcgtcgccacggtcttcccattcttcaacgacttcctggggctcatcggcgccgtctccttctggccgctcaccgtctacttccccatccagatgtacatggcgcaggccaagacgcgccgcttctcgccggcgtggacgtggatgaacgtgctcagctacgcttgcctcttcgtctcgctgctcgccgccgcgggctcagtgcaggggctcgtcaaggatctcaagggatacaagccattgttcaaggtctcctaaataagggactgctgcatggcatgtgtgcgatgatcgattggaacactgttagttatacattagctagctgca

SEQ ID NO: 1400 - DNA, 267 bp, Zea mays
  Clone ID: PAT_MRT4577_162693C.1
cgatgaccaactagcaacatagaaagcacaatagtgtaccaacaatggcagccaaaataatttggcttcctaatgctccttggtcttcctgcaattgctgctacggcgaccattttcccgcaatggctcgcaagctccctatagtttcccttcttccccggtacttctaaccaggggtggtcttccggtaatgtgaaaacccaattcttcaaccctacaggatccaccaggcattcgaagttggaatcttacctttataacccttgt

SEQ ID NO: 1401 - DNA, 253 bp, Zea mays
  Clone ID: PAT_MRT4577_162739C.1
aggccacagagacatcacatgccctatttctttttctttcgcaggaaatccatagttgttgccattagcaaaacgtgtgtttcaccttgggaccaggcggacgaactcacgtatttctaattaaacattgaatttgggcactcctcttgtacaggtaaaacctcgaagagggtaatttttggggtgcattaccgtgctgctattcaggtaacatgctaattactactgttcctgggagcaaaaataaactgcc

SEQ ID NO: 1402 - DNA, 1922 bp, Zea mays
  Clone ID: PAT_MRT4577_162877C.1
cggacgcgtgggcgagttgtccgccccgcccctcgctttcgtccccgttttccggtgccttgcttccccctcctcactcaaatgcctcacaggccgaggctccgaggccgcggggaggaggaggagcggcagccagcaggggaggaggacacgaatcgtagtcggcctcccgcccgccccggcaattgttgttgctgctgcgcgcagggcggttctggattgcggtctgccccacccacgaacaatccatggctccatctccgcctcggcgtgctgcgctcctcctcgccacggtgcttctgctggcggcggccgggtccacccccggcgccacggctgctggcatcttccaggtgcgccgcaagttcaccgccggggtgggagggggtgctggcgccaacatcagcgcccttcgcgcccacgatggcacccgtcacggccgcctcctcgcagccgccgacctccctcttggcggcctcggcctccccactgacactggcctctattacacggagatcaagctcgggacgccacccaagcactactacgtccaggtcgacaccggcagcgacatcctctgggtcaactgcatcacctgcgagcaatgcccccacaagagcgggctcgggttagacttgacgctttacgaccccaaggcatcctcgaccgggagcatggtgatgtgcgatcaggcattctgtgcagccacctttggcggaaagctgccgaagtgcggcgccaatgtgccctgcgaatatagtgtcacctacggtgatggtagctcgacgataggttcctttgtcaccgatgcgctgcagtttgatcaggtgactagggatgggcagacacagccggctaatgccagcgtcattttcgggtgtggtgctcaacaaggtggggatttgggaagttcaaaccaagcccttgatggaattcttggttttggtgaggcaaatacatcaatgctatcacaactaactaccgctggtaaagtgaagaagatatttgcccattgtttggataccataaaaggaggtggaattttttctattggggatgtggtgcagccaaaagtaaaaacaacgccattggtagccgacaagccacactacaatgtgaaccttaagacaatcgatgttggtggcactactctacaactcccagctcatatttttgaaccaggagaaaaaaagggtaccataatcgacagtggtaccaccttgacataccttccagaattggttttcaaagaagtaatgctcgcggtatttaacaagcatcaggatataaccttccatgatgttcaaggttttttgtgtttccaatatcctggaagtgtagatgatggattcccaaccatcacattccattttgaggatgatcttgcactacatgtgtatccccatgagtactttttcgcaaatgggaatgacgtatactgcgtgggattccaaaatggtgcatcacagtcaaaggatggaaaggacattgtgcttatgggagatcttgtcctttccaacaagttggttatctatgacttggaaaatcgagtcattgggtggactgactacaactgttcgtcgagcattaaaattaaggacgacaaaacgggcgcaacatctactgttaattcacatgacttgtcctcaggatggaagttccactggcacatgtccccggttctattgttggtaacaacggtgtgcagttatttaatatgctaactccactgtacaggaaatccatctggttcgtatatcctttccacgaaaaggatcggagagatgtagggctatctttaggttgtgttctcccaccacggaaaacaatggaaatagaaaaacactgtaatgctttactgagccattgtttaactaggtaatgctgaggtgaggtaatgttctgtcatttctttgggaaaa

SEQ ID NO: 1403 - DNA, 1444 bp, Zea mays
  Clone ID: PAT_MRT4577_163021C.1
cagacgcattgggtacctcgaggccggccgggactcaaacaaactcaagcctgccctgccctgccttgttaagcaaagcaacccagctgcgagacacgagagctagctagagagagatggcggccacggtttcctccttcccggtggtgaacatggagaagctggagacagaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgggagagcaccttcttcgtccgccacctcccggcctccaacctcgccgacctccccgacgtcgacgaccgctacaggcaggtgatggagcagttcgcatcggagatccggaagctgtcggagaggctgctggacctgctgtgcgagaacctgggcctggagcccgggtacctgaaggcggccttcgcggggtcggacggcccgacgttcggcaccaaggtgagcgcgtacccgccgtgcccgcgcccggacctcgtcgacggcctccgcgcgcacaccgacgccggcggcatcgtgctgctgttccaggacgaccaggtgagcggcctgcagctgctcaggggcggggaagggggggacgtgccggccatccgccacgccatagtcgccaacgtcggcgccgggctgggtgtgatcaccaccgggccgtgcacgggcgtcatgcaccccgtgctcacgcgccccgatggccaccgcatgtccggcccgtcctgccccaacccgcgcgccggagccctggtacgccggggccccgcgctcgtcggcgccgcccaggagcggcgcggcgaggccccgcacccgcgcttcgtgctcgaggactacatgaacctgtacgtgcgccacaagttcgaggccaaggagcccaggttcgaggccatgaagtcggccatcgccaccgcgtgagagaagactgccttccgctgcgggcttccttcgtggcgtcaagccttgaggcttgaacgaacaacgtacgtccatgtgcttatagtggcacagttatgtgtgtaactaccgatcgtggaacggcctaatgtatttcggttgcctcagatcgatctatatgtgcgtatacattatgtactgaaaagtgtgtagcgtctggttaatgtatgagcagtgtgtatgtgaccgggacccggtgtgtagttgctattactaccatatccggtgaatgatcaaaccttttggtgtattaaaaactagatgttcatccaaaaaaaaaaaaaaaaaaaaacaataaaaacaaaaaaaaaaaaaaaaaaagggggactctttgc

SEQ ID NO: 1404 - DNA, 1368 bp, Zea mays
  Clone ID: PAT_MRT4577_163023C.1
tgcctgcatcactgactgtcaagctgcaacccactgcgagctagtgagtgtgagagacgagagttagagagcgagatggcagccacggtttcgttcccggtggtgaacatggagaagatggagaccgaggagaaggccacggccatggaggtcatccgcgacgcctgcgagaactggggcttcttcgagctgctgaaccatggcatctctcacgagctgatggacgaggtggagcggctgaccaaggcgcactacgccaacttccgggaggccaagttccaggagttcgcggcgcggacgctggaggccggcgacaagggtgccgacgtcaaggacgtggactgggagagcaccttcttcgtccgccacctcccggcctccaacctcgccgacctccccgacgtcgacgaccactacaggcaagtgatgaagcaattcgcatcggagatccagaagctgtcggagaagctgctggacctgctgtgcgagaacctgggcctggagcccggctacctcaagtccgccttcgctggctccaacggccccacgttcggcaccaaggtgagcgcgtacccgccgtgcccgcgcccggacctcgtcgacggcctccgcgcgcacaccgacgccggcggcatcatcctgctgttccaggacgaccaggtcagcggcctgcagctgctcaaggacggcgagtgggtggacgtgccgcccatgcgccacgccatcgtcgtcaacatcggcgaccagctggaggtgatcaccaacggccgctacaagagcgtcatgcaccgcgtgctcacccgccccgacggcaaccgcatgtccatcgcctccttctacaacccgggcgccgacgccgtcatcttcccggcgccagcgctcgtcggcgccgccggcgccgaggaggagcgcgccggccaggccaggtacccgaggttcgtgttcgaggactacatgaacctgtacgtgcgccacaagttcgaggccaaggagccacggttcgaggccatgaagtcggccatcgccaccgcgtgatgaacaaacacactgctgccttcaattctgctccttgtcccttcgtgtcctgcattatgctttgagcttgaagccttgatgaggctgcaatgaacagtgtccatgtgcttatatgtagtttggcacggtggttatgcgtgtatcgtggaacggcgtaatgtattttggttgtctcggatctatatgtatgtacgtatatattgagtactgtatgtaaagtgtgtgtagcatctgatccaatgtatgagcagtgtgtacgtgaccaggacctgatgtgctgctattactaccacctcaagtggagggaacatgaattattagtagttctcatac

SEQ ID NO: 1405 - DNA, 1316 bp, Zea mays
  Clone ID: PAT_MRT4577_163024C.1
gccggccgggtctcgacaaaagcttggcctgcctgttaagcaacccggcgagcgaggtggtgagagaacgagcgagagggagatggcagccacggtgtccttcccggtggtgaacatggagaagctggagaccgaggagagggacacggccatggcggtcatccgcgacgcctgcgagaactggggcttcttcgagctgctgaaccatggcatctcgcacgagctgatggacgaggtggagcggctgaccaaggcgcactacgccaccttccgggaggccaagttccaggagttcgcggcgcggacgctggccgcggccggcgacgagggcgccgacgtcagcgacgtggactgggagagcaccttcttcgtccgccacctcccggcctccaacctcgccgacctccccgacgtcgacgaccactaccggcaagtgatgaagcagttcgcatcggaggtgcagaagctgtcggagaaggtgctggacctgctgtgcgagaacctgggcctggagcccgggtacctgaaggcggccttcgcggggtcggacggcggcccgacgttcggcaccaaggtgagcgcgtacccgccgtgcccgcgcccggacctggtggccggcctgcgcgcgcacaccgacgccggcggcctcatcctgctgctccaggacgaccaggtgagcgggctgcagctgctcaggggcggcgacggcggggagtgggtggacgtgccgccgctgcgccacgccatcgtcgccaacgtcggcgaccagctggaggtggtcaccaacgggcggtacaagagcgcggtgcaccgcgtgctcgcccgccccgacggcaaccgcatgtccgtcgcgtccttctacaacccgggcgccgacgccgtcatcttcccggcccccgcgctcgtcggcgaggaggagcgagccgagaagaaggccaccacgtacccgaggttcgtgttcgaggactacatgaacctgtacgcgcgccacaagttcgaggccaaggagccccggttcgaggccatgaagtcgtcggccatcgccaccgcgtgagcacataatactgccgtgttctcccttcgtggggtgcatatgcttgagcttgaagagccatgtgcttgtatgtagtggcacgtacggtggttatgcgtgtatcgtggaatggcgcggcgtgatgtattttggttgtctcagatctaagtgtgtgcgtatatattgtgtactgtaaagtttgcagcgtctgattaatgtacgagcagtgtgtgtacctaaccagaaaaaaaaaagtagctggctgtgtgctgatattactacc

SEQ ID NO: 1406 - DNA, 1398 bp, Zea mays
  Clone ID: PAT_MRT4577_163025C.1
tcgaggactggatagggggattggactcctcgaggccggccgggactcaaacaaactcaagcctgccctgtcctgccttgttaagcaacacagcgagacatcacgagagctagagagagatggcggccacggtttcctccttcccggtggtgaacatggagaagctggagacagaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgggagagcaccttcttcgtccgccacctcccggcctccaacctcgccgacctccccgacgtcgacgaccgctacaggcaggtgatggagcagttcgcatcggagatccggaagctgtcggagaggctgctggacctgctgtgcgagaacctgggcctggagcccgggtacctgaaggcggccttcgccggggtcggacggcccgacgttcggcaccaaggtgagcgcgtacccgccgtgcccgcgcccggacctcgtcgacggcctccgcgcgcacaccgacgccggcggcatcgtgctgctgttccaggacgaccaggtgagcggcctgcagctgctcaggggcggggagtgggtggacgtgccgcccatgcgccacgccatcgtcgccaacgtcggcgaccagctggaggtcatcaccaacgggcggtacaagagcgtcatgcaccgcgtgctcacgcgccccgacggcaaccgcatgtccgtcgcgtccttctacaacccgggcgccgacgccgtcatcttcccggcccccgcgctcgtcggcgccgccgaggaggaccgcgccgaggccgcgtacccgagcttcgtgttcgaggactacatgaacctgtacgtgcgccacaagttcgaggccaaggagcccaggttcgaggccatgaagtcggccatcgccaccgcgtgagcaaagactgacttccgctcccggcttccttcgtggcgtcaagccttgaggcttgaacgaacaacgtacgtccatgtgcttatagtggcacagttatcgcgtggaacggcctaatgtatttcggttgcctcagatcgatctatatgtgcgtatacattatgtactgaaaagtgtgtagcgtctggttaatgtacgagcagtgtgtatgtgaccaggacccggtgtgtagttgctactactaccatatccggtgaatgatcaaaccttttggtgtattaagggggtgtttggtttctagggactaatttttagtccctacatttt

SEQ ID NO: 1407 - DNA, 1304 bp, Zea mays
  Clone ID: PAT_MRT4577_163140C.1
attcggctcgagcacaccagaccagctcatcatcacattcgcatacatctcttctagcacgcaaagatcgagctatagctagctctgcaaccagagagaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcggcggccaaacaggaggcggcggcggcggcgcccggctgcacggcatcgtcagcagccgccacaaacaccaccagcagcagcagcgccgccgtcgtcgtcggctccttcgtcaaagtgagcatggacggcgccccgtacctgaggaaggtggacctgaggatgtacaggggctacagggagctccgggaggccctggaggccatgttcgtctcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgtcgtcagcgaggcaacaatgaagatgacccatctgattcgagaggacctgcatgcccggcaacgttaacatgtcgatcgatcgtcatggccttattaattgtttctttcttttcttttcttttctgtttaattatttttgttgttctggttggcgccgccgtggatcggagggatccccaagccgaaggatgagcttggctggcgcatcgaagcgcatgcaacggatgtgtgcggctttggttctgtaataagacaaccaggggtccttttttcgatctgttattagcggcacaaaaggagctagatgcatgctgaggttgtttcagttcactctccatgtgtgtctgtacaaacgaaacaatacagttatattttgatcgttgatcccttaataaaaaaaaaaaaaaaaaaaggccgatcgcctaaaaaataaggaaggaagaactaaagaataggaaagagcaaagaaaaaaagggggggccgcccc

SEQ ID NO: 1408 - DNA, 567 bp, Zea mays
  Clone ID: PAT_MRT4577_163214C.1
ggccgggaaaaaaaaaaaaaaaaaaaaaaaaaaaaaaaaaaaaaaaaaaaaaaaaaaaaaaaaaaaaaaaaaaaaaaaaaaaaaaaaaccgggggaaaatttccaaacgcagaaaagcccctcgcgccgccggccttttaagccttgcagaacaccgccgccagcccgagggaccgttgaagcctaggtttccggccccgatggcggttaagggaggaaagggtttgttggcggccaaaacaacgggggccaaaagcaccgacagggacaaggacaggaaaaaggcccccgtgtcgcgcttttcccgggccggcctcaagttccgggggggtcgaatccaccgccagttaaagtcgggtgcctttgcccacggccgggtgggcgccaccgccgccgtttattccgccgccatcctggagtacctaaccgccgaggtcctcgagctggccggaaacgccagcagggacctaaaggtaaagcgcataaccccgcgccacctgaagttggccatccggggggacgaggagctcgacaccctaataaagggcaccatcgccgggggcgggg

SEQ ID NO: 1409 - DNA, 163 bp, Zea mays
  Clone ID: PAT_MRT4577_163449C.1
gcgccagcctcgccaccgtggacgtgaacaagtgcaccatcggggcgcacccctcggtcatcccggcgctcgcggggctcctccggcggggaggactcagggagcgcatataggccgcaacattgctttacgagctatgcaagctgacgcgagaaccggagcc

SEQ ID NO: 1410 - DNA, 758 bp, Zea mays
  Clone ID: PAT_MRT4577_163452C.1
tttcctcgttcccaatcatcttgccgcgcgccgcacgtagctagggtttcgtcctgtcgttgcacccgcattactagcattcaatccacgccaatggctgagaagaagatggttacgctcaggagctccgaccacgaggagttcgaggttgaggaggcggtggcgatgaagtcagagatcatccgtctcttgatcgaggacgactgcgccgacaacgccatcccgcttcccaacgtggattccaagactctcgccctggtcatcgagtactgcaacaagcacgttcacgccgtcgccgccgacgactccgccgccgcggagaccagcaacgcctcatcagctgcgggcggcggcgacgtcgacctcaagaagtgggacgcggagttcgtcaaggtcgagcaggcgacgctcttcgacctcatcctggctgccaactatctcgacatcaaggggttgctggacctgacctgccagacggtggccgacatgatgaagggcaagtcaccggaggagatccgcaggacattcaacatcaagaacgacttcaccgaagaggaggaggaggagatccgcagggagaactcctgggccttcgactgatgtagtctccccgtccgcggacctagctcggtggttattactgttagattcgatctctagtgctagtttgttcgtctgcacttatcttctgatctgaaacattaataagtagttcgtttgtctacagttaccagttgatattaccaaaaaccaaaagg

SEQ ID NO: 1411 - DNA, 570 bp, Zea mays
  Clone ID: PAT_MRT4577_163642C.1
cactttcttatttgtgggaagccacacacatcacacaaaaaactttattagtgaactatcactcataagaaatctaagagagggcaccaccagtgatggggtggtggtagaacgctggtgggtttgacaaagcaagttgggtgagtggcaacaagtggtgcaggtgtaagagggtgccagcgataggcgcagcgcgctggtagaacggccacaactgtgggtgtgtcaagaaggtaacagggctcacaccatctagctgtctgagtggtaataggtggtgctgctgtaaataagcaagagagctcagtgctgacaggtgggtgaatggaagaaattgctgggggtaggcaacagatagctgtctgaatggtaggtggtggtggtgcatataagaagcagagctcagtgcatctagttgggtgaatggaagacactgctgttgctgagagtacgcaacaaggtttgctagcacaaggtggtgtatgtggtgcgccctgatgttgtgcgccaataagcgcaccagaggtaactgctgtaatagggctgaagattgttggaggaacaagggtg

SEQ ID NO: 1412 - DNA, 344 bp, Zea mays
  UNSURE (1)..(344): unsure at all n locations
  Clone ID: PAT_MRT4577_163700C.1
  unsure (1)..(344): unsure at all n locations
gccggccggagctcggatcggcctcagtcgcacatatctactatactatactctaggaagcnaagacaccaccgccatcggcaggccangatgctctgcattgttcgntctcccaggtntttgtgcaagcgccactagtggcgaccatattccaggggcacttgccaccagttatgntattgggtaccctgtaaccatggctgcagtactgaatgatgcaacaagagcttggcagcttgatggcgtgtccgtgcctgatgctgcagcaactgtctggcttacccgcttcagtcgatggcagtagatgatgccacagatgatgacgccctaaatgatgtcaccat

SEQ ID NO: 1413 - DNA, 562 bp, Zea mays
  Clone ID: PAT_MRT4577_163757C.1
gaccctcgaggcctgccgggatctccctgttaataatccttaagcgcaaagtacgtaagctcggaattcggctcgagagaagggatggcggcccgtggcaaggctatcggcgctggcgccgcgaagaaggcatcgttgaggagctccaaggccggactccagttccccgtcgggaggattgccagggtcctcaaggcgggcaagtacgcggagcgcgtctgcgccggcgcccccgcgtacctcgccgccgttctcgagtacctagcggctgaggttctcagaacttgccgggaacgccgcgagggacaccaagaagacccgaattgtgccgagccacatccagcttgctgtgcgcaacaaccaggagctgaccaaactgctgtgtggcgccaccatcacgagcggaggtgttatgcctaacatccatcaacatctgcttcccaagaaggctgcctactccaaggccactgtcctctacgtccacaactgacactgcttcctgcaaatgtgatccgaccactgacttgttttgtaagaataggatgatgccaacttcggtgag

SEQ ID NO: 1414 - DNA, 1193 bp, Zea mays
  UNSURE (1)..(1193): unsure at all n locations
  Clone ID: PAT_MRT4577_163759C.1
  unsure (1)..(1193): unsure at all n locations
ggtgcggagctcgaggcgcacgccgcctcctcctcgtcgtcccattgggtacctcgaggccggccgggccgggatctccctgtttaatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgccaggttcctcaaggcgggcaagtacgcggagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcgatcggggaggagtcgggtatgctgggaaggagaattagattagtatctgtttttttgaatgggatgtgaacgtggctgtgaatctcaggattgtatgctcgttgagaaagaaatggaaggacttcgtgatgcacgatgttgatgccgcatcatattcagcgtaaaaatgcatttcttctgagtggcaatggtgtcaccgaaaaatgaaagtatttggctggtgtcgccaatctgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcgatcggggaggagtcgggtatgctgggaaggagaattagattagtatctgtttttttgaatgggatgtgaacgtggctgtgaatctcaggattgtatgctcgttagaaagaaatggaaggacttcgtgatgcaaaaaaaaaaaaaaagaaaaaaaaaaaaaaaaaaaaatagtaaagtatttggctggtgtncnngccaatnnctg

SEQ ID NO: 1415 - DNA, 2533 bp, Zea mays
  Clone ID: PAT_MRT4577_163763C.1
cggacctggctacgaagcgcaggcagtacagacagcaccgcctggtttgagcggctgccgccgctgcatatactccctccctgccttccagtgccaggggtgaccggcgtgcgtgccattccacgctctcgcggctcgtgtgccagcggtgaccagcgctcgtgctcgtccagtccaccaggcgctgctgttccggcaagccagccagcagcagccgccgccgccgccgtctcggagctcgagctcctagtcccccggggccgaggcgccggcgccatggaccagctccggcccgagccggccgcgggcgcgcacgagatcgagaagacggcggcgccggacgtggagtcggagcccgcggcggcggtgccggagccggagcgcgtgccgccgtggcgcgagcaggtcaccgcgcgcgggatggtggcggcgctgctcatcggcttcgtctacacggtgatcgtcatgaagctgagcctcaccacggggctcacccccaccatgaacgtctccgccgcgctgctcgccttcctggcgctccgcggctggacgcgcgccctcggccgcctaggcattgcctgccgccccttcacccgccaggagaacaccgtcgtgcagacctgcgtcgtcgcctgctacaccatagggttcggcggtgggttcgggtcgttcctgctgggcctggacaagaagacgtacgagctctccggggtgagcacgccgggcaacgtgccggggagctacagggagcctgccatcggctggatgaccggattcctcctcgccgtcagcttcgtggggctcctcaccttgcttccactcagaaaggtgctcgtcatcgactacaaactcacttatccaagtgggacagccaccgcggttctcataaacgggttccacacacctcaaggagataagaatgcaaaaattcaggtccgtggattcctcaagtacttcgggatcagcttcctgtggagcttcttccagtggttctacaccgccggcgaccactgcggattcgcccagttccctactttcgggctccaggcttttaaccagacgttttccttcgacttcagcctgacgtacgttggtgctgggatgatctgctcgcacctcgtcaacctctcgttgctgttcggtgccgtcgtttcctggggcgtcatgtggccactcatcggcaagcagaagggcaactggtatccggcagatgcatctcagaatagcatgacaggcatctacgggtacaaggccttcctttgcattgcccttctcgtgggagacggtctctacaacttcgtcaaagtcatagctatcactgtcaagaacatacgcgagagatcacgtcgcaagaacctgaacagagtggcggacgcggacacgatggcgctggacgacatgcagcgcgacgaggtgttcaacagggacaacatcccgacgtggctgtcctacgcggggtacgcggcgctgagcctgatcgcggtgatcgccatcccgatcatgttccgggaggtgaggtggtactacgtggtggtggcgtacgcgctggcgccggcgctggggttctgcaacgcgtacgggaccgggctgacggacatgaacatggggtacaactacgggaagatcgcgctgttcgtgctggcggcgtgggcggggaaggacagcggcgtggtggccgggctggtggggtgcgggctggtgaagcagctggtgctcgtgtcggccgacctgatgcacgacttcaagacggggcacctgacgctgacgtcgccgcggtcgatgctggtggggcaggccgtgggcacgctgatggggtgcgtcctggcgccgctcaccttcatgctcttctacagggcgttcgacgtgggcgagccggacgggtactggaaggccccctacgcgctcatctaccgcaacatggccatcctcggcgtggagggcttctcggcgctgcccaggcactgcctgcagctgtgcgcggggttcttcgcgttcgcggtgctggcgaacctggcgcgggacctgctgccgcgccggctcgcgcggctcgtgccgctgcccatggccatggccgtgccgttcctcgtgggcgccagcttcgccgtcgacatgtgcgtggggagcctcgtggtgttcgcgtggcacaagctcgacggcaagaaggccgcgctgctggtgccggccgtcgcctcggggctcatctgcggcgacgggatctggacgttcccgtcgtcgctgctcgcgctggccaaggtcaagccgcccatctgcatgaagttcacgccagggagctagagggcgcgctgacgatgcgtacagaacagagggcatcgttcgtcgtttgtggggtggaatccgtgtagtagaattacataccaatcaggcctgttctaatgtccatatgagcttaatgtacggtgtatatatgtaaaacggaaatctgaaggatgacaggatgaattgcctgttgtctagtagcacgcatattattattattatagcagagcactaataaaactctttatcttacacc

SEQ ID NO: 1416 - DNA, 255 bp, Zea mays
  Clone ID: PAT_MRT4577_164044C.1
gcggtctcttccccctcttaccagggtcacctcggtttagggatccttagggttctgtggaggggcaatggggggctgctgatgtggagtaccgatgcttcgtcggcgggcttgcctgggccaccatcatcgagtcgctggagaatgccttcgcctcctacggcaagattctggacttcaaggtttataccgaccggcagacgggggggtctcggggcttgggctacggtacctttttctacgtgaactccatgc

SEQ ID NO: 1417 - DNA, 438 bp, Zea mays
  Clone ID: PAT_MRT4577_164214C.1
gggagcaccaaaaagcaccattttttccttgagggataacttaaaacaaaacctgacaggggtaacaggatccatggatccaaagtccatgcggggggaagcaggggtctgggggagccggggatgaacacagcactaacaactgacacagagggaccttgcaatcaaaaacacagaggggcaacaacaaacgagacgaacgaagataaaccctttggactaggggaaaaataacgggagcgaaaaggaaaacttggccgggcgggccccaccggtaaattcctccagttcccggggggagttgccgaaacccccgccacgggtgccaccgccgaaaccgccaccaccaccaccggagccaccggcgccaccgaagccgccgccgccaccggcgaaaccgccgccgccataaaggggcccgccaccgccgaaaccgcc

SEQ ID NO: 1418 - DNA, 226 bp, Zea mays
  UNSURE (1)..(226): unsure at all n locations
  Clone ID: PAT_MRT4577_164249C.1
  unsure (1)..(226): unsure at all n locations
ctatagtgagtcgtattaaacnntgggagttacccgcttgacgggcgtaattgtacagagtttacagagcgacaaggaagtatttttacatgagcgtgtaagtaacgcgagtggtgcaggggagatgctgggattcggcagcgtgagtggtgcttcagtgttggatgatgggggtgagttggtgatagtgagtgaaccggacctagaggcggggacaatcactatt

SEQ ID NO: 1419 - DNA, 914 bp, Zea mays
  Clone ID: PAT_MRT4577_164254C.1
tttttttttttttttgaagacagatacaggagtttccactaaacatcaggtttcagaaatgtccacactccacaatccagttgaacacgcctaggctgcacttcactctgcagtagctgaatcagttcagtttcaggccggcgcagtgacagtggcagacggccgcacggggggatacatgctagctgatgaggtgagcaatgagctagctagtcgatgaggattgggctggacgaggtgtacccgccggcccgctcccggatctccgcggggatgtcggcgcggagcacctgcaccctgaacaccacgcgctccgccctgccgtccaccagctcgaagacgcacccgtcgccgagcttgagtccgttgtccagcgcgaagccccgccacccggcctccaggcgctggatctgccgcccccccgtgaaccgcatctcccaggaccgcccgtgccacgtcaccgtcgccggcaccgtcgtccccgggaggaacggcgccagcgacttggggaccaccacttggaacggctggttgacatgagacttgcagaggatgcatgtgaagtatggcttcccgaggagagggaggaccccgggctgcacggaacacggcgtctccgacatcggccgccgcgggtcaggtccgtctgctgctgggctctcgccgccgactggtttgcatctgctcatggaaactctgcggttggtagccacgcccacgctggtaagtattgctctgaggaaggtgtccctgaatcggtcagagaatcaaatgctgcgaggacttggggtttggtcttttggtggaacctttgctcggcgacggaggatttcgagctagtctgaggtgaggacgggagggtaggaggaaggaagaaacgcacagtcacacaggttagctcacgagatcacagt

SEQ ID NO: 1420 - DNA, 1755 bp, Zea mays
  Clone ID: PAT_MRT4577_164353C.1
ccggccgggcgccagcgaggccgcgtccacacccgcacacggcacaccccaccatcttcctcgcctacgccttcgccttcgtctccacggtccactatataacccgccgcctcgccacatcaccagaaatttccccacacgcgcccacctcctccggtcctcccctctagtcctctctcccgaccccacctctgccgtccgtgcgtccgtccggcaaccgcgacgcaacaatggcggccgggcgagagctggtggtgagtttcggcgagatgctgatagacttcgtgccgaccgtggcgggggtctcgctggccgaggcgccggccttcctcaaggcggccgggggcgcgcccgccaacgtcgccatcgcggtctcgcgcctcggtggcggggccgccttcgttggcaagctcggcgacgacgagttcggccgcatgctcgccgccatcctccgcgacaacggcgtcgacggcggcggcgtcgtcttcgacgcgggcgcgcgcaccgcgcttgccttcgtcaccctgcgcgccgacggcgagcgcgagttcatgttctaccgcaaccccagcgccgacatgctcctcactgccgacgagctcaacgtcgggctcatccggagggctgcggtctttcactacggatcaataagcttgattgctgagccttgccggacagcacatctccgtgccatggaaattgccaaagaggctggtgcactgctctcttacgacccaaacctgagggaggcactttggccatcccgtgaggaggcccgcacccagatcttgagcatctgggaccaggcagatatcgtcaaggtcagcgaagtcgagcttgagttcttgacaggcatcaactcagtggaggacgatgttgtcatgaagctgtggcgacctaccatgaagctgctcctggtgactcttggagatcaaggatgcaagtactataccagggatttccatggagctgtcccttccttcaaagtacaacaagtcgatacgactggcgcaggcgatgcgtttgttggtgcgctgctccgaaggatcgttaaagatccatcctcgctacaagacgagaagaagcttgtagagtctattaaattcgctaatgcgtgtggagcaatcaccgccacgaagaagggtgcgatcccgtctttgcccactgaaactgaggtcttgcagctaatagagaaggcatagatagatcactgtaattgctttggttttcactagcttccacttctgcaaattgcaaaatgtattgtattctgatctggaacagaagaagtgggtgctccatcttacctgccattttttgcttgccctagttcctaagggtgttttgttttagaactctacttgcaataagtagagcccttttatatttatgtatatcagcatgcgctcatttgataaaaaaaaaaaaaaaaaaaaaaaaaaaaaaaaaaaaaaactatctgggtttcatggacatgctcttggagacaccaccaatggatgcagtgacagctggaccacactacaatcactgcgagcaaggagcatggggcaccagaagatgagaaccgccatgctggtgatcttggaaacgtgacatctggagcagatggcgttgctaatatcaatgtcactgacagccagatcccactgactgggccaaactcaatcattggcagagctgttgttgttcacgctgatcctgatgatcttgtaaagggtgggcacgagctcatcaagatcactggaaacgccg

SEQ ID NO: 1421 - DNA, 449 bp, Zea mays
  Clone ID: PAT_MRT4577_16442C.1
cgactcggtccaattttaatattataaaagtaaatattcagaactccagctccaaactaacagaaacaactttgttcgaatggacaaacttaaacaaaaatgcatgttgcgcgactacaggtagcgataaatgccatagcacaaatactgatcgccgcataagatagcactacttggatgggacgaaactttactcgtcatcctcggcgtcgatatctgcgccgcccgaagaggtgagttggttgagcctttcaatgagaatggccttactctgctcgtatgtcaatttcttggggatgtaccttttgtgctactttgggggctgcttggttgacttgaccacagaaaggtcatcccgggtggcagcttggacctctttgtacagagcttccatgtgggcagcctcaatttccttgttaatggactcactggagtgagactgggacttc

SEQ ID NO: 1422 - DNA, 813 bp, Zea mays
  UNSURE (1)..(813): unsure at all n locations
  Clone ID: PAT_MRT4577_164467C.1
  unsure (1)..(813): unsure at all n locations
ttgggtccctcgaggccggccgggccggngattcccccatgcgcacctctctccatctctctgctcctccgactccttcttgatccagccaagacagtgatcgccatgtcggactcggaggagcaccacttcgaatcgaaggccgacgccgtagcgtccaagacctacccgcagcaggatggcaccgcccgtaagaacggcttcatcggcatcaggaaccgcccctgcaagggtgcggaggtttcgacctcgaggagtggtaagcatggccatgccaaatgccactttgctgccatatacatattcaacggcagaaagcttgaaccatattgttccttcatcacacaactgagatattccgcatgtgaaccgtactgagcaccagagtgattgatatatcataggatggatttgtgagccttcttacttcagatggcaacactaaggatgatcgtacactcccaactgatgatactcttgtggcccagatcaaggaagggtttgacagcggcaaggatcttgttgagactgtacagtctgctatgggggaggagcagatctgcgcgctgaatgatgctgcccccaaataacttacctgccttggaatactgtatctcagaacctaaatcgaaaggagaaatgtatcaaggattgctacagagacatccatctggcttgaactgtgtactgctatgccacacaccagagcatgtatcgctgcgtgttgcaccgtgactgcattagctgcgaatacattctggaccctgtattttctatggatgtatgccccctactgcttactattaatcatca

SEQ ID NO: 1423 - DNA, 641 bp, Zea mays
  Clone ID: PAT_MRT4577_164472C.1
tctctgcgcgctactttcttctctctctgctcctccggctccgcctgatccatcctagacagggatcgccatgtcggactcggaggagcaccacttcgaatcgaaggccgacgctggggcgcccaagacctacccgcataaggctggcaccgtccggaagaacggcttcatcgtcatcatgaaccgcccctgccacgatgtggaggcctctacctccaagactgctaagcatggccacgccaaatgccacttctgtcgccatagacatattcaatgggaatgagcttgaacagattgttccttcatcacacaactgggacattccgcatgtgaaccgtactgagtatcaactgattgatatttctgaggatggatttgcgagccttcttacttcctggcagcactaaggatgatcttagactcccaactgatgagactcttgtggcccagattagggaagggttccaaagcgttgaaggatcttgtcgagactgtccagactgcgatgggggaggagcatatctgcgcgatgaaggatgttggccccaagtaacttccttggatttggagacggaaccctactgtatctcaacttaaatcggaaaagaactgcatcaccggaggattgctaccgagacatt

SEQ ID NO: 1424 - DNA, 669 bp, Zea mays
  UNSURE (1)..(669): unsure at all n locations
  Clone ID: PAT_MRT4577_164476C.1
  unsure (1)..(669): unsure at all n locations
ctgtgcggcgctcgaggcggtctcaatccnacatcgccatccgacctctcttttctccctgctcctccgcctccttcttgatccagccaacgcagggatcgccatgtcgagactcggaggagcaccacttcgaatcgaaggccgacgccggagcgtccaagacctacccgcagcaggctggctgcgcccgtaggaacggcttcatcgccatcaagaaccgcccctgcaaggcagtggaggcttctacctcatagactggtaagcatggccatgccaaatgccactttgttgccatagacatattcaacgggaaaaagcttgaagatatcgtgccttcatcacacgactgtgatattacgcatgtgaaccgtactgactaccacctgattgatatatcagaggatgaatttgtgagccttcttacttcccatggctacactaacgatgatgttatactcccatctgatgagactcttgtgcgccagatccaggaaaggcttgaaagcgaaaaggatcttgttgtgactgatcagtctgctatgggggaggtgcatatctgcgcgctgaacgacgttggtcccaaataactgacctgccttgcaatactgtatctcgaaacctaaatccatcatactgcgtatctaggattgctacagagacatccatctg

SEQ ID NO: 1425 - DNA, 755 bp, Zea mays
  Clone ID: PAT_MRT4577_164477C.1
cctcgaggcggccgggaataacataacataaaaatcacttatcatccccatccgcacctctctcaatctccctgctcctccgcctgctttttgatccagtcgagtcagggatcgccatgtctgactcttaggatgaccacttctaatcgaaggccgacgtcggatcgctcaagacctacccgtattaggttggaaccgtccgcaagaacggcttcatcatcatcaataaccgcccctgtgaggttgtggaggtttctacctcaaagactggaaagcatggccatgccaaatgccactttgttgccatagacatattcaacggaaaaaagctcgaagatattgttccttcgtcacacaactgcgatattccgcatgagagccgtactgactaccatgtgattgatatatcaaaggatggattggtgatccttcttacttctcatggcaacactaaggatgatcttagactcccaagtgatcgacactcttgtggtccagatctaggaagggtttgaaagcggcaaggatcttgatgtgactgtcgcagtttgctatgggggaggagcaaatctgcgcgctgaatgatgatgcccccaagtaactgtcctgccttggaatactgtatctcaaaacctagatcgaaaacatgagtgtatcaaggattgctacagatacatccctctggcttgagctggcttttgctatggcaaacacaagtgcagggatcgctgggtgttgcaccgtgtctgcattat

SEQ ID NO: 1426 - DNA, 709 bp, Zea mays
  Clone ID: PAT_MRT4577_164479C.1
ttgggtacctcgaggccggccggggagtttattacttatcatccccatccgcacctctctccatctccctgctcctccgccttcttcgtgaccagacaagccagggatcgccgtgtctgactcggaggagcaccacttcaaatcgaaggccgacgccggatcgtccaagacctacccgcaacaggatggcaccgtccgaaaaaacggcttcatcgacatcaagaaccgcccctgcaaggttgtggaggtttctacctcaaagactggtaatcatggtcatgccaaatgccactttgttgacatagatatattcgacgggaaaaagctccaagatattgttccttcatcacgcgactgtgatattccgcatgagaaccgtactgagtatcagctgattgatatatcataggatggatttgagagccttcttacttcagatggcaagcactaacgatgatcttagactcccaactgatgagactcttgaggcccagatcaaggaaggcgttgaaagtgccaaggatcttgttgtgactgtccagtctgctattgcggaggagcatatctgcgcgctgaatgatgttgcccccaaggaacttccctgccttgcaatactgctatctcgaaacctatatcggatcaagaagcgtatcaaggattgctacagagacatccatctggcttgagctggctcttgctatgtcaaaca

SEQ ID NO: 1427 - DNA, 729 bp, Zea mays
  Clone ID: PAT_MRT4577_164482C.1
atacttatctctcctccgacctctcttctctccctgctcctgcgtctccttcttgatgcagccaatgcagagatcgccatgtcggactctgaggagaaccacttcaaatcgaaggccgacgccggagacgtgcaagacctacccggagcacgatggcaccgtccgcaataacggcttcatcagcatcgagaaccgcccctgcaaggatggggaggtttctacctcaagactggtaagcatggccatgccgaatgccactttgttgccatagacatattgcacgggaaaaagctcgaagatattggtccttcggcacacaactgtgatattccgcatgtgaaccgtactgagcaccagctgattgatatatcagaggatggatttgtgagccttcttacttcagatgggaacactaacgatgatcttacactcccaactgatgagactcttgtggtccagatcaaggaagggttcgaaagcggcaaggatcttgttgtgactgtccagtctgctatgggggaggagcatatctgcgcgctgaaggatgttggccccaagtaacttccctgccttggaatactgtatctcaaaacctaaatcgaataaagaagtgtatcaaggattgctacagagacatccatctgggttgagctggcttttgctatggcaacacaagtgcagggatcgctgggtgttgcaccgtgtctgcattatccgtggttacattct

SEQ ID NO: 1428 - DNA, 652 bp, Zea mays
  Clone ID: PAT_MRT4577_164510C.1
cctctctccatctccctgctcctccgcctgcttcttgagccagccaagacagagcatcgccatgtgcggagctcggaggagcaccgcttcgaatcgaaggccgacgccggagcgtccaagacctacccgcagcagggtggcaccggccgtaagaacggcttcatcgtcatcaagaaccgcccctgcaaggttgtggaggtttctacctcaaagactggtaagcatggtcatgccaaatgccactttgtgtgccatagatatattcaacgggaaaaggctcgaagatattgttccttcgtcacacaactgtgatattccgcatgcgaaccgcactgagtatcagctgattgatatatcagaggatggatttgtgagccttcttacttcacatggtgacactagggatgatcttacactcccaactgatgagactcttgtggaccagatcgaggaagggtttgaaagtggtaaggatcttgctgagactgtccagtctgctatgggggaggagcatatctgcgcgctgaaggatgttgggccccagtaacttccctgacttggaatactgtatctcagaacctacatcgaaaaaagaagtgtatccaggattgctacagagacatccatctgggttgagctggcttttgctatg

SEQ ID NO: 1429 - DNA, 788 bp, Zea mays
  Clone ID: PAT_MRT4577_164511C.1
ccggccgggcacccaaactccgctctcatcccaccccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggtaagcgagagccctcctgcttggggtgcgttcttcgtaggctgcttggttctcttcgagcccgatttgctctttgtagcctggctctttccgagcgcagtctgttcttcgtctcgtctcctctgctggaggtttgcaggatctggtatgatatggtgatgtatgatgaactgacgacgcacgctgctgtcgcgtgcgtggtgtgtgtctgtgcaggcgtagatttccggcggccatggggggcgccgtgatggtcgccatcgcggcctctatcggcaacttgctgcagggctgggacaatgcgacaattgctggagccgtcctgtacataaagaaggaattcaacctgcagagcgagcctctgatcgagggcctcatcgtcgccatgtccctcattggggcaacagtcatcacgacgttctccggggcagcggccgactgcgttggtaggaggcccatgctggtcgcctcggctgtcctctacttcgtcagtgggctggtgatgctttgggcgccaagtgtgtacatcttgctcctcgc

SEQ ID NO: 1430 - DNA, 694 bp, Zea mays
  Clone ID: PAT_MRT4577_164518C.1
gatacttacccctcatcatccccatccgcacttctctccatctccctgctcctccgcctccttcttgatccagacaagccagggatcgccatgtcagactcggaggaggaccacttctaatcgaaggccgacgccggagcgtccaagacctacccgcagcaggctgccaccgaccgcaagaacggcttcatcgtcatcaagaaccgcctcctgcgaggtctgtggaggcttctacctcagagactggtaagcatgtgcatgccaaatgccactttgttgccataaacatattccacgggaaaaagcttgaggagattgttccttcatcacacaacgtgtgatattccggatgtgaagcgcactgagtaccagctgattgagatatcagaggatggatttgagagccttcttacttcagatggcaacactaaggatgatcttatactcccaactgatgagactcttgtggcccacatcaaggaagggtttgaaggcggcaaggatcttgttgagactgtccagtctgctatgggggaggagcagatatgcgcgctgaaggagttggcccaagtacttacctgccttggaatactgtatctcaaaacctaaatcgaaaaaagaagtgtatcaaggattgctacagagacatccatctggcttgagctggcttttgctatggcaaacaccagtgcag

SEQ ID NO: 1431 - DNA, 679 bp, Zea mays
  Clone ID: PAT_MRT4577_164521C.1
atgtgcagcgctcgagcggcgacttcctcctatctctgcgctctactttcttctctctctgctcctccggctccgcctgatccatcctagacagggatcgccatgtcggactcggaggagcacgacttcgaatcgaaggccgacgctggggcgtccaggacctacccgcagcagggtgctaccgtccgtaagaacggcttcatcgtcatcaagaaccgtccctgcaaggatgcggaggattctacctccaagactggtaagcatggtcaccccaaatgccactttgtcaccatagacctatgcactgggaaaaagcttgaagatattgttccttcctcgcacaactgcgacattccgcatgtgaaccgcactgagcatcagctgattgatatttctgaggatggatttgtgagccttcttacttccgatggcaacactaacgatgagcttaaagtcccaactgatgagactcttgtggcccagattaaggaaggattctagagcgatcaaggatcttgttgtgactgtccagtctgcgatgggggaggaccagatctgcgcgatgaaggatgttgatcccaagtaacttccttgcctttggagacggaaccctactgtatctcaacttggatcccaaaagaagaggatcaccaaaggattgctaccgagacgttccctg

SEQ ID NO: 1432 - DNA, 587 bp, Zea mays
  UNSURE (1)..(587): unsure at all n locations
  Clone ID: PAT_MRT4577_164523C.1
  unsure (1)..(587): unsure at all n locations
cccatccgcacctctctgctctccctgctgctccgcctccttcttggagcagccaagccagggatcgccatgtgggactcggaggagcaccacttcgaatcgagagcggacgccggagcgtgcaagacctacccgcagcaggcggggaccgtgcgtgagaacggggtcatcgtgatcaaaaaccgcccctgcggggggggggaggtttctacctcaaagactgggaagcatgggcatgccaaatgccactttgtggccatagacatattcaacggggaaaaagctcgaagatattgtgccttcgtcacacaactgtgatattccgcatgtgaaccgtactgagtaccagctgattgagatatcagaggagggatttgtgagccttcttacttcagagggcaacactaaggaggagcttagactcccaactgatgagactcttgtgggccagatcaaggaagggggtngaaagcggcaaggatcttgttgtgactgtgcagtctgctatgggggaggagcanatctgcgcgctgaaggatgttggccccaagtaaccttcctggcttggaatactgggtctcaaaacc

SEQ ID NO: 1433 - DNA, 705 bp, Zea mays
  Clone ID: PAT_MRT4577_164524C.1
ccggccgagatacttatcatccggatggcgtacctctttccatctccctgctcctccgtcttcttcttgatccagccaagccagggatcgccatgtcggactcggaggagcaccacttggaatcgaaggccgacgccggagcgtccaagacctacccgcagcaggctggcaccgtgcgtaagaactggctccatcggcatcaagaaccgaccgtgcaaggctgcggagggacctacctgaaagactggttagcatggtcatgccaaatgccactttgctgccatagatatatctaacgggaaaaagctcgaagatattgttccttcgcgacacaactgcgatattccgcatgagaaccgtactgagtatcaggtgattgatatatcagaggatggatgtgtgagccttcttacttgagatggcaacactaaggatgatcttagactcccaactgaggagactcttgtggcccagatcaaggaagggattgaaagtggcaaggatcctgttgggactgtccagtctgctatgggggaggagcagatctgcgcgctgaaggatgatggccccaagtaactgccctgccttggaatactgtatctcaaaacctaaatcgataaaagaagtgtatcaaggattgctacagagacattcatctggcttgagctggctgttgctatgtcaaacacaagtgcagggatcgct

SEQ ID NO: 1434 - DNA, 664 bp, Zea mays
  Clone ID: PAT_MRT4577_164528C.1
tgcggcgttctcatccttatctctgcgctctacatttcttctctctctgttcctccgcctccgcctgatccatcctagacaggaatcgccatgtctggactcggtaggagcaccacttcgaatcgaaggccgacgctggggcgtccaatacctacccgcagcatgctgccaccggccgtaagaacggcttcatcgtcatcaagaaccgtccctgcaaggttgtgcaggtttctacctccaagactggtaagcatggacacgccaaatgccactttgtcgccataaacatattcagtgtgaaaaagcttggagatattgttccttcatcacacaactgtgacattccgtatgtgaaccggactgagtatcagctgattgatatttctgaggatgtatttgtgagccttcttacttcatatggcaacactaaggatgatcttagactcccaactgatgacactcttgtggtccagattaacgaatcgttctaaagcgggaaggatcttgttgtgactgtccagtctgcgatggggtaggagcagatctgcgcgttgaacgatgttgcgcccaagtaacttccttggctttgaagacggaaccctactgtatctcaacttaaatcggaagagaagtgtatcaccaaaggattgctaccgagaattca

SEQ ID NO: 1435 - DNA, 438 bp, Zea mays
  UNSURE (1)..(438): unsure at all n locations
  Clone ID: PAT_MRT4577_164542C.1
  unsure (1)..(438): unsure at all n locations
ccccattcccacctcnctcttctctctgctccnccgcctccttcttgaggcagccgagccatagatcgccgtgtccgactcnnaagaacaccacttcnaatctaaggccgactccggagcgtccaagacctaccctcatcaggctggcaccgtccgtaataactgcttcatcgtcatcaagaaccgcccctgcaaggttgtggaggtttctacctcaaatactgttaatcatggccatgccaaatgccactttgttgccatagacatattcaactgtaaaaagctctaagatattgttccttcgtcacacaactgtgatattccacatttgaaccgtactgagtaccatctgattgatatatcataggatggatttgtgagccttcttacttcagatggcaacactaatgatcatcttatactcccaactgatgaaac

SEQ ID NO: 1436 - DNA, 853 bp, Zea mays
  Clone ID: PAT_MRT4577_164545C.1
attgcttatcatctgcgcctctaatttcttctctctctgctcctccgcctccgcctgatccatccaagacagggatcgccatgtacggactcggaggagcaccacttcgaatcgaaggccgacgctggggcgtccaagacctacccgcagcaggctggcaccgtccgtaagaacggcttcatcgtcatcaagaaccgtccctgcaaagttgtggaggattctacctcctacactgtaaagcatgaacacgacgaatgccactttgtcgccatacacatattccatgcgaaaaagattgaagatattgtgccttcatcacacaactgtgacattccgcatgtgaaccgtactgagtatcagctgattgatatttctgaggatggatttgtgagacttcttacttcagatggcaacactaatgatgatcttagactcccaactgatgagactcttgtggcccatattaaggaagggttcgaaagtggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggacttgagctgccttttgctatggcaacacaagtgcagggatcgctgggtgttttaccgtgactgcattatgtggatacattctgaaccctggattgtctatgcttttatgcccctactgtttagcattaattatcaataaatctgtttggcacctgtgaaaataacgaaaaggaccgcagcgatctcccttccaaaaggccccta

SEQ ID NO: 1437 - DNA, 826 bp, Zea mays
  Clone ID: PAT_MRT4577_164549C.1
agccatatccgaacttatgtccatcttcctgctcatccgccttcttatggagccggccaagccagggatcgccatgtcggactcggaggagcaccacttcgaatcgaaggccgactccagagcgtccaagacctaccctcagaaggctgtcaccgtccgtaagaacggcttcatcgtcatcaagaaccgcccctgcaaggatgtggaggtttctacctcagatactgttaagcatggtcatgccacatgccactttgttgccatagatatattcaacgggaaaaagctcgaagatatggatccttcgtcacacacctgtgatattccgcatgtgaaccgtactgagtatcatctgattgatatatcatacgatggatttgggagccttcttacatcagatggcaacactaaagatgatcttaaactcccaactgatgagactcttgtgggccagatcaaggaagggtttgaaagtggcaaggatcttgttgtgactgtccagtctgatatggtggaggagcatatctgcgcgctgaaggatgttggtcccaagtaacttccctgagcttggaatactgtatattaaaacctaaatctaaaaaagaagtgtatcaaggattgctacagagacattcatctggcttgagctggcttttgctatgtcaaacacaagtgcatggatcgttgggtgttgcaccgtgtctgcattatctgtggttacattctggaccctgttatttttatgctattatggccctactgattagtattaataatcaataaatttgattgggcacgcctaaaaaaaaaaaagaagggtagccag

SEQ ID NO: 1438 - DNA, 731 bp, Zea mays
  Clone ID: PAT_MRT4577_164554C.1
attcgcttcagccttcaggccctcgaggcgggggccgcttatccaatcaataatacacgacgctccctccttcctcgagagcgtgtatgcgcacctgcagctccgcaaggcagatgttgctgactcgtctgtccagcgtttcttgctcgtcaacagcgcagcagttgcatgcgggcgcgtccaagacctacccgcagcaggctggcacacgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggatttgaagacggaaccctactctatctcaacttaaatcggaaaagaagtgtatccccaaaacgattgctaccgagacattcacctgggcctgagctggattttgctataa

SEQ ID NO: 1439 - DNA, 259 bp, Zea mays
  UNSURE (1)..(259): unsure at all n locations
  Clone ID: PAT_MRT4577_164571C.1
  unsure (1)..(259): unsure at all n locations
ggcgaacttatctatttaaaacattctacatttgtagtttaataacaaatgttattgctgtacattttcaggaatctgagtactcccattcacaacaatgtgaacaattaatacatggatcgccantgtctatcacttttttatatacaatattgatctgaacgtntgtcaaattatataaccatcaggcttctccantctcgctcactgtctttgtcatctgttggcagataatgctgtcgtcttgcagatggggcac

SEQ ID NO: 1440 - DNA, 1196 bp, Zea mays
  Clone ID: PAT_MRT4577_164577C.1
agtcccagcgcaagctttgctccaagtgagaacatagagattgaaatctcgatagcatgtgagtaatgttgctatatatgtgtcaatgaatgaaatttgtacatatgcatggggcaacattcacaggttcagctggtcatttgtttgtggagccatgaactattatgaagttgtcctgttattctgaaagtaaaagagtgcagagatcatatgtaatgtgacagatatttagtatcaaaaaaaaaaaaaaaaaaaagaagcttatcgcttatcatccgcgcctctacatttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaatgcatgaagtttctttggttaccaaaaaaaaaaaaaaaaaaaaaaaaaaaaaaaaaaaaaaaaaaaaaaaaactcgagaagggggcccggtacccc

SEQ ID NO: 1441 - DNA, 1366 bp, Zea mays
  Clone ID: PAT_MRT4577_164581C.1
tgggaccctcgaggcccggccggggagcttatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatgcttttatgccccctactgtttagtattaattatcaataaatttgtttgggacggttgaattgcatgcattgcatgaggtttcttgttcgttatttgttttctcttgccatgcttccagtattggtgatggcagtttactcgtaattttttttgtacttgtttcgaaaactggtgggcagtttacccgcgcttgtgctccatccattgttctagtgttatccattcctcttttttcccccttcaaaatataaactataaagaagaaaatattatgacttacataaagaatcgttttagagaagcggtaccaaacatgactcgacggaaaattgctccaaaccaactattaactcgatgtttgtattttttttcttctctgccaaaacctgtcaacccgctttatggtaactttgtggtatatgttctcgaaagaaaactggtgtatagagctactcccctaatttcaagttgtaagacattttgcccatttgatatatgtaggtagaaaagatgtcttgtaatctaaaacagagggagtatttatgtagcttttttgagataaaatgtcttatttaaaacaga

SEQ ID NO: 1442 - DNA, 2392 bp, Zea mays
  Clone ID: PAT_MRT4577_164582C.1
aaagacgccctccgtttggtattcaggagctatgtagccatatgtcccaacaactcgccgagtgttcgccttctgctggttgtcgccgaagatctgtgccatgccgaagtccgctatcttaggcctcatctcggcgtccagcaggacgttgctcgctttgaggtccctgtgtatcaccgtcagccttgagtcttgatggagatacaggaggcccctagccacccccttgattatccccagcctcgccggtatcttcctcttgggcggcaaggagaaattcggtggttatctgtgccgcgaaggcgagaggcttaggcagcaggacagagccacgatgggccgaagctaagcgttagcttctttggtatctcaagggagcaatagcccttggaaatttcacaagattcctgcgtccctaccagaacaagtccctatctaggatggaatccatccttctgcaggctttcactttcctgataataacagtaacaataaattgacaatggtttgtgttcttctgcaacctttttggctccctggtttcgcaagggttccgtgctttgtttgaagtcatcacttgcatgcgttggtataaaaaggttgctgttgcatttaaaaaaaaaaaaaaaaaagatgaggtcgaggactatgatgagaagcttatcgcttatcatccgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaaaaaaaaaaaaaaagtcagagtcctcccaccgcacgcaacaagtacgcaggcagcgcagcctcgagccgtcgccatggcgagcaagcacctcgtcctcgccgcatgcctcctcctcctgcccaccgcctcggtcgccaccgacgtcgactactgcagtaagaaggactacccggtgaaggtgagcggggtgcagatcgtgcccgatccggtcgaacccggcaagcccgccactttcaagatctccgcttctactgataaaaccatcgagaaggggaagctggttatcgacgtcaagtatttcttcttctacgtgcactcggagacccgcgacatctgcggagagacttcctgcccagcgaccggcgacttcgtgctgtcccaccagcagacgctgccaggcttcactccgccggtgagatttctccgcacagccagcaatcacacgtctgggccctgtttggcagcattgttttctaatcctgattgtcagactcggattggtgtcagccaaacgctgttcatgcacactgatgcgttctgaggctctttccactccgtcgcagggctcctacacgatctacatgaagattgtcggggacgacaacgaggagctgagctgcatctcgttcgggttcagcatcggcttcgtcgcgtccagctgaacgcgtccgagcctgggcacgagaggcagccagcccatggatgtaaattacgtggagcacactctgtatcctatgactttcaagtatctaggtccatgtaagctttttgtgggtgtctgtgttcaactgagacgtttttatccggagttgaacatcacaataaagcaaagtcactgataccatgtaatggaactctgagcgcttgatgggacaaaaaaaatttagactcacaataaagacggtttgtgtttgtgc

SEQ ID NO: 1443 - DNA, 317 bp, Zea mays
  Clone ID: PAT_MRT4577_164782C.1
tctcactaccccctccggtccgggtccgggtccgtaaggtcctccggggttcggtttcctgggtaaccggatcaaaatggcggcttcggatgttgattaccgcggcttcatcggcggcctcccctgggccacggacgaccactccctcaacaacgccttcagcacctacggcaaggtcctcgagtccaagatcatcctcaatcgggagacgcagaggtcccacggcttcagcttcgtcaccttctccacggaagaggcgatgcggaacgccatcgacggcatgaacggcaatgagctggacggacgcaacatcaccg

SEQ ID NO: 1444 - DNA, 545 bp, Zea mays
  UNSURE (1)..(545): unsure at all n locations
  Clone ID: PAT_MRT4577_164831C.1
  unsure (1)..(545): unsure at all n locations
tggagctcgagggccgtttttttttttttttttttgggggggcaccgaggggggnaggaaatttttgaattggatagattagggagggtgcacattcatcacccatgttttatttgccgacagtcaaatcccaacgagcatagctccgaccgaacggacacatcgcatgcttattgtgtgcatccctctctaggagggggggggccgctctacatctagaaaaacccaccccaactacaaatgcgaccgaccgagagttgccagttgacccattattattcctccgtctgatcgacataacacactggtttgcttcattcatctgtccgttcttttttttaggcctgtccctcaagcaggatcgtgttcgaagggccacacccagtgcccagttgccgactctccttagctggcgcggccgacttggagatcttgtttgtggcttgcattctgctcgttggggaagtaactctctatgaaggctgtcaggtgcgggtcgttgaaccttggtgccgcaccatgcaggtttgtgcaggttgttattg

SEQ ID NO: 1445 - DNA, 1464 bp, Zea mays
  Clone ID: PAT_MRT4577_165073C.1
gactcctacctgcgattgggccgggcggggccgattcgcgaaggcccatttcgtcgtctctcgctccctcggtccttccttcacccatctcacccgcgacccgcccctttcccctaagccatctccttcctcctcacctcgccatggcgttcttctctcatcaccatctccagcagccacacgcgcagcagccagtgctcccttccttcaggaacgcgctaccggtgcctgtggatggccagatcccagcgcccctcaccttcttcaacccgccgcctgccttcccggagcaacccgcgcaggcacctctggtggatgcggtgggcttgacggcagctgcggggcttgggtggaggcagccgagggagcaggaactgcttggggaaaactcccagatgtcgtccattgattttctgcagacgggctcggcagtgtcgacggggttggcgctgtctctggaggaccggcgccacggcggcggcggggctgggaactcctctggcgattcaccgctgctcctgctgcccatgctggacgatgacatctcacgcgaggtccagcggcttgacgctgatatggaccgctttattaaagctcagagtgaacggctgaggcaatctatactggaaaaagttcaggcaaagcaatttgaggcactggcctcagttgaggacaagatactcagaaaaataagggacaaagaggcggaagtggagaccataaacaaaaggaactctgaactagaggaccagattaagcatttgggagtggaagttggtgcttggcagcatagggccaagtacaatgaaagcatgatcaatgcactcaagtacaacttggaacaagtatgtgctcaccagagcaaggatttcaaggaaggctgcggcgatagcgaggtagatgacacggcgtcctgtcgcgatggtggtgctatcaattttcaactgactccgaaggagaacagacaaccgaaggatttaacggcttgcagggtctgtaaatcaagtgaggcatccatgctcttgctgccgtgtcggcatctttgtctatgcaaggagtgcgagagcaagctgagcatctgccacatgtgccagtcctccaagatacttggcatggagatatattatgcgtagaatagaatttatgtatcacatgagtatcgtacgagatactgctatgttaatacgattaatctattgccaaactttagaacctatgtaccagtaccctatgacttgccactggatcaaaagacactgccgtttatggtagatttaacgcagcaaatttctttgcgaagcttattgttggtttgtgcccctagtagacttggcagagtttgtcttgtgcgactgattgttaccgtctatgtatttccattagcagaccctttcaggcagtgtttggaactcaggaaatttcaccagtgctgtgttttcgctgctaaattgaattgatttatgt

SEQ ID NO: 1446 - DNA, 1547 bp, Zea mays
  Clone ID: PAT_MRT4577_165077C.1
aataagttatgttctgtattcctagttatcattttgccatttgccacccccaactcccgagggcccatttcgccgtctttcactccatcaccccctctcccccgtccctttcccctcagccctttcccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtagatgacacggcgtcctgtccctatggtggtgctgtcaatttgcaactgatgccaaaggagaacagacaaccgaagaatttaacggcttgcagggtctgtaaatcaagtgaggcatgcatgctcttgctgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgcagcaaatttctttgcgaagcttaaaaaaaaaaaaacggaaccatcgttgatttgtgctcctggtaaacttcttggcggagtttgtcttgtgcgactgattgttaccgtccgtctgtatttccatcatctgaacttctcaggccgtgtttggaactcagaaaatttccccggcccctgtgctttgactgctacattgacttggcaatttggtaaatttttatgtgtatatat

SEQ ID NO: 1447 - DNA, 392 bp, Zea mays
  Clone ID: PAT_MRT4577_165108C.1
ttcttactcgtccgaggacgcgggggggcgtttgtttggttctggagaagccaccggtgacggcgttcgctcacaagacgctgctggagggccactacgaggcggaggccaaggcgccagcctcgttcgggcccgtgggcgccgtgctgctggagaacgagcaccacaaggagatcttcatcaaggagatcaaggtcgtcaccggcagtgacagcagcaccagtcgtcaccttcggctgcaactcctgggtgcactccaagatggacaaccccgagaagcgcatgtccttgaccctcaagtcctacctggcgtgcgacacgcccaagggcctggaggacctgatgaagaaagacctgcatgcgcttaggggcgaccggcacagtgagcgcaa

SEQ ID NO: 1448 - DNA, 1998 bp, Zea mays
  Clone ID: PAT_MRT4577_165280C.1
acgtacacaccagatgcaagatggactgcatttcttttcctacacggctactacacctacattacactagcattagtcaaagcgtccagtagatcagtttttacgcgtagctacagatggatgtgttttttttttcattttcatgtcgccgcgggctgccgacgcgactgctgttaattaggttcccccgttctcctagctggctgccacggacggttgcgaacgcgtgggccggccgggctcggcgcacccaccgggcacaggaacaggaagccggaggcgaagatgtcgtcggtgttcaccacggcccccttcttggcttcctcgcctcgtcttctcctacggtcccctgattaagtgcattttaaatcccaagacgtctctcactcttcagccgctttacaactccccaccccatcccatccacacacacttcacccagcgcggcggccgccggccgccggcaatggaggccgtggcgcgcagcggcgactacctttggcggttcgtggcggagacagagtggtacaacgaggttgtcctcagcgccgtggcgccaggcgactggtggcgcggcctgccgcacccggtgcagtcatggatgcgcaactgcgtcggcggttacctcctctatttcatctctggtttcctctggtgcttcgtcatctactactggaagcgccacgcctacatccccaaagatgccatccccacaaatgaagctatgaagaagcaaatagttgtagcatcgaaggctatgcctttttactgcgctcttccaactttatctgaatatatgattgagagcggatggactcggtgctacttcaatatcagcgaaattggtttttctatgtacctctgttatatggctatgtatctcatctttgtggagtttggaatttactggatgcacagagagttgcatgacataaaaccattatacaaatatctgcatgcaacccaccatatttacaacaaggagaataccttgtctccatttgctggacttgcatttcatccactggatggtattctgcaagcaataccgcatgtgttcgcgctcttcctctttccaacgcacttcaggacacatattgcactcttgttcctagaggctgtgtggacaacaaacatccacgactgcattcatggcaagatatggccagtcatgggcgctgggtatcacaccattcaccatacgacttaccgccacaactatggccactacaccatctggatggactggatgtttggtacgctcaatgagccagatgatatcctcaagaaggcttgagtttctcgtagctgtggttttcctacggtgctggatgtgcttggtctgttctgtccccagtgcctctaatccgctgagcctgttcagcactgtctgtttatgtaggcatcagtgtgttaattagtttgctaggttcatatggctttgtgcttattctgtaatttagtgatgtttgtctcatgacgcaacggagttcaggacgaataaaactttgctagacacattctggattccagctgcttgtacaatgttgcaactcaactgtcaatataggatgtaaaacggattccttctagtcttgtacctggtgagttatttgtggtttctgtgcatgcattgctcagcctatgaatgttgcttatgttttgtggtcaagccaaatgaaggtcacatttgaaatccaggtgtcaggatgcattgtcaaatcaccccaactgacaattgggtatccgtttccaaatgctgctgtactgaaggtggttaagttggcccgaagacatgcttgttcattgcttgctcttgttaagatagtggatacccttctttgtgaaccacatatcacttatgaaaataaaatgtatagcttcctcataaatctgtctttctccttgaaactgatatccggctagttcagacatctgtagtgtctgatgtagttccgaaacagagaaacttttcgatcgaccaaaaatacccttctc

SEQ ID NO: 1449 - DNA, 743 bp, Zea mays
  Clone ID: PAT_MRT4577_165318C.1
cgcgacccaggtcatgagaccattagcctcatactaaggccacttttgtagcggcaatggcggccacaagatgttgccttcttatgctccttggcctttgtgaaagtgctgttacgtcaaccattcacaccacattgctacaagctgctatagcttcccttcttcccccgtacctctaaccagcggagtcatatggaatggcgaaaacccaaactttcaaccctataggatccaacacggaatcgcagctggcatcttacctttatcacccttgctcctacaacaattatgagccctattacagtcagtcaccttcgttgcatttattggcacaaaacatcagggcacaacagctacaacaacttgagctagcataccttgctgcctactgtcatcaacaacagtatgttacattcaaccaactaactggattgaactatgcttcttattggcacaacaacaactacgatccagtcagctatgtgctgcctaccctcagcactttcttccattcatccaactgacagctttgaactctcctgcttatttacaggaccaacatctactaccattcagccagtctagctggtagggagccctgctacctttttgacacaaccacaatttgttgtcggtctaccagcacgctgtgcctaacgctggcaccctcttaccactgcaacaattgctgccattcaaccaacttgctttgaaaaacccaacaggtttcttaccaacaaccc

SEQ ID NO: 1450 - DNA, 376 bp, Zea mays
  Clone ID: PAT_MRT4577_1653C.1
ttctgttggcttctactccccctccggttcgggggcaggttaatgaggttctgcggggttcgggttcgagggtgagccggatcgagatggcgtctatggatgttgatcaccgctgctttctcggcggccttagctgggccacggacgaccactccctccacaacgccttcagcacctacggtgaggtcctcgagttcaagatcattctcgatcgggagacgcataggtcccgcggcttcggtttcgtcaccttctccacggaggaagctatgctgaactgccatcgagggcatgaaactgcaaggagctggacggccccaacattaccgtcaacgaggtccacttcccctgcggccttggaggctgtcgccgcccg

SEQ ID NO: 1451 - DNA, 3477 bp, Zea mays
  UNSURE (1)..(3477): unsure at all n locations
  Clone ID: PAT_MRT4577_165462C.1
  unsure (1)..(3477): unsure at all n locations
gattaactcagtctcaacgatattggtgcagtaggtatctcatgggaagtcatatctgcagttctctagtgctactggtgatttgtctgcaacagagaacagcctccctcaacaaaatgatggttctctggagggcagccattggctatccatttttgaagacacagtcatccaatctatctgatatcctaaaagacagctttaagaaaactgacagttttacaagatggatgagcaaagagcttcctgaagtggaagattctcaaattcattctagttctggggcgttctggagcactgaagaagcaaataatatcatcgaagcatcaaaccatgaggcactggatcagttcactgtttccccgatgctctcgcaggaccagctctttagtatagttgacttttctccaaactggacatatgtaggttcaaagactaagattttagttgctggtaacatcctgaatgacagtcaaatcaccgagagatccaagtggtcatgtatgtttggagaagttgaagttccagcaaatattttagcagatggtactctcatctgttactcaccgcagcataaacccggtcgagttcctttttatattacctgctccaacaggttggcctgcagtgaagtgcgagagtttgaatttcgaccaactgtctcccaatacatggatgctcctagtccacatggtgaaacaaacaaagtttatttccagatacgccttgacaagttgttatcccttggaccggatgagtaccaggcaactgtatctaatcctactctggagatggttgacttaagcaggaagataagttcactgatggcgagcaacgatgagtggtccaacttgctaaagttggctgttgataatgagccttctactgctgatcagcaggatcagtttgctgaaaacttgataaagggaaaattgcatatctggcttctaaataaagttggtatgggtggcaagggacccagtgtgttagatgatgaagggcagggcgtgcttcacttagcagctgcacttggatatgattgggctataaggccaacacttgctgctggcgtgaatattaatttcagagatattcatggctggactgcactccattgggctgccttttgtggccgagagagtactgtagttgcgcttattgcactgggagcagctcctggagctttgacagacccaactcccgatttccctggaagtacaccagcagatcttgcatcttctaatggtncaaagggaatatctggtttcttggcagagtgttctctgaccagtcatcttcaggtccttaatctgaaaggagctaatatggctcanatatctggtctacctggtattggagatgntaccgagagagattcactgcagcctcccagtggagattcattgtaggagacctgactgactacgcgcgtccacagagctgtctactcctttggtccacgcttttttcgctgatgatcccaccgtgaccgcgggccggaaaaaaaaaaaaacaacaacagtccctcccctcccctcccctccctgctcctctaccccttcctctcccggcgaccagctggcctctcctttgttgaggcgagagacccccacccgatccggcgatggacgccgcgtccaggccgcctccgccccacggaacaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaaaggtgcaggactcaagcaccacttttacctggccttcctgatgatcttgctattgcctgccttatacgagttcctcgacttgaacagcccaaactcaggatggtttgcaaaagatggaaccgtcttttgtctgggaattacttttactccttgcgtaagaaaattggagtggcagaagaatgggtgtatgtctttaaaagggaccgtgaagggaagatatcctggtatgcctttgatccactccaccagctatggaagtcactcccaccagttccacaagagtattcagaagcattgggctttgggtgtgccgttctgagtggttgctatctgtacttgtttggcgggaaagatcctttgaggggttctatgaggcgtgttgtattctacaatgctcgtacaaacaaatggcaccgggctccggatatgatgaggaaacgtcacttttttggttcttgtgtaataaacaattgtctctatgttgctggaggagagtgtgaaggaatacagagaacgctgcagtctgcggaagtttatgatccaaataggaacagatgggcctgtgttactgaaatgaacaatgggatggtgcctttcattggagttgtatatgatggcaagtggttcttaaaggggctagattcccatcgccaagtaactagtgaggtctacttaccatcatccaatacatggtcagcaattgatgatgagatggtcacaggctggcggaacccaagtatttctttcaatggccgtctctattcagctgactgccgggatggctgcaagcttagagtctatgatgagaacacaggaacatggacaaggttcatggacagcaagcaccacttgggcagctcacgtgcctttgaagctgcagctttggtgtcactaaatgggaaactctgtgtcatcaggaacaacatgagcataactcttgttgatgtctccaacccaacaatgagtgttgagacagatagtgcgcgcatgtgggaaactgttgttcggaagggccagcacaggtcgtttgtggcgaacttatggtcgagcattgcaggacggaacttaaagagtcacattatccattgccatgtgctgcaagtttgagggcaggttttgttagtgggaacatgatcaagttttttaagaagcaaaaggttcagatcagtgacagaaccctccatttcgaaggtagtaaggtttcattgcagaatcgcggggaaaaaggtcattggcgtgccactgctgcccccaaagtcccaaatagttatttgctctcttccagaactgaaaattccaattactttctggcaacatttgaagactcttatcattcatggataaggtttttcagattttgagtgcaaaccagaaagtgagtaggaacttccctagtgtaatgacattttccccttgctggcaggctgggaaatgtgtttggtggatatattggtctcttatcatatttatctatctttgcatcgtgtaatatgtggcatcttactgtgtaatgttggtgtatattgtagtggcggactagctagactccaggattagagtagtcaggattatgcctattatgcttcaattttttgttggaatgttcataaatatatgacgccattgacgttttttcattgacgttt

SEQ ID NO: 1452 - DNA, 637 bp, Zea mays
  Clone ID: PAT_MRT4577_165711C.1
cgggcccctctcaccaacggtgttttcggtgtgagaaaacccaattgttcaaccctacaggacccaacaggcaatcacaggtggcctctgacctatatcacccttgtctctccaacaatcatcagccctatcaccagagatacctttggtgcatgtagtggcacaacattttttgtcacaacatctacaaccacttgcgctagcaaaccttgctgtatactctgagcaacagcagtttcttacattcaaacaactggctgtagtgaactgtgctttatatgcgcaacaacaacaagtaccatacagacagatctgtggtgtctacccacaggatttttttacatacaaccaactgacagtattgaactcttctgcttattcacagcagtcacatcttctaccattcagccagctagctggtgtgagccgtgataccttgttgacacaaacacaggtgttgccgttataccagcacgctgcgcctaacgctggcactctcttacaactacaacaattggtgccattaaaccaacttgctgtgacagacccagcagcattctaccaacaacccatgatgtggtggcgccctcttttagatgtcttatgagttatagctcaattataaagttttatgtct

SEQ ID NO: 1453 - DNA, 380 bp, Zea mays
  Clone ID: PAT_MRT4577_165843C.1
tttccacgagggctcaaaggccgacttggaggactttggagtccactccggtgatatggaatcggagcctcggggaatgggctgacgactacggcatgtagatcaagcccttggccgacaagagcacttatttcagagatggcttacgcaccatgactactgctggttatgatgccactgcacatagggtggccaaagggaagaggtagaatcaatacaggggtatacgccagcgcccttggggtaagcgggctgctgtgatcagtgattcgcacaagggcgctcgcgaatggcttggtactttgaatagtccggacgtagacgaaagagcttatgatgctgatgcgcgctagattcatggcaagaaggtcaaggttcac

SEQ ID NO: 1454 - DNA, 315 bp, Zea mays
  Clone ID: PAT_MRT4577_165929C.1
acatctagagggtaatgggtattgggaggggatacatcatccaacaaattgcaggggggctaagcttgaaaccctgaactaacagctggttctcccttacaccatcggatgcatgaatgtacttcgtttctacacacactactacagccttgaatggggtttccattccatccaacctcccgaccatgaaacgaactaaacgccccagtaagctcattcacaacagtcttcagggcggttgtttaaccgggcttcctacaaataaaccaaaggacttgtttgcaaaccgactttgcaatggaaccggatcatcca

SEQ ID NO: 1455 - DNA, 478 bp, Zea mays
  Clone ID: PAT_MRT4577_166188C.1
actgataccaactaccaacatacaaagcacagttttttaccaacaacggcatccaaaatattatgcgtccttatgctccttggtctttgtgcaattgctgctactgcgaccattttaccgcattgctctcaagctcctataacttctcttattgccccgtacctctcaccagcactgtcatcggtatgtgaaaacctcaattcttaaccctacacgatccaacaggcaatcgcagctggcatgttacatttatcatacttcgttccttcaacaaacatcagtcctattacaacaatcacttttggagcatttattgacacaaaacattatgatcacatcaactacaacaacttgtgctaacaaaccttgctgcctacttttagcaacatgcagtttcttccattcaaccaactaggctaattgaactctgtttcttatttgcaacaacaacaactaccaatgagtcaaaatacctttt

SEQ ID NO: 1456 - DNA, 454 bp, Zea mays
  Clone ID: PAT_MRT4577_166208C.1
tcttcctaccaactagcaccatacaaagcacaatagggtaccaacaaaggcagggaaagtattttacctccttatcctccttgctcttttttcaagtgcttctactgctaccattttcccacaatcctcacaacctcctatacctttccttattcccccgtacctatcaccagcgtattcttctttatgttaaaacccaattcttcaaccctatatgatccaacaagcaatcccagttggcatcttacctttatcacccttgttcctccaacaatcattatccctattacaacatttaccatttgtgcatttatttgcacaaaacattatggcacaacaacttcaacaacttgtgctatcaaaccctttcttccttacttttactatcaacatttttttcaattcaaccaactagcttcattgaactcttctttttatttgcaacaacaacaac

SEQ ID NO: 1457 - DNA, 1440 bp, Zea mays
  Clone ID: PAT_MRT4577_166288C.1
ctttcccactgccgtgacgattttcacagcgaattctccggccggcgccgccccgtccgtccgtccgttcttccgataccgaactcgccagtcgccacagcgatctctctcgctcgctccgccgacgcagcgctcggcttcagctcgagaggaggaaatggccagcagcggctacgaagggatcctcctggggatggggaaccccctcctcgacatctccgctgtcgtcgacgagggcttcctcgccaagtatgatgtgaaaccgggcaatgtcattcttgctgaggacaagcatttgccaatgtatgacgaattggctagcaagagcaatgttgaatacattgctggaggagccactcaaaactctatcagggttgcccaatggatgcttcaaattcctggtgcatcaagttacataggttgcatcgggaaggataagtttggtgaggagatgaaaaaaaatgcacaagctgctggtattaatgcccattatcatgaggatgataatgctccaacgggcacatgtgctgtttgtgttgttggtggagaaaggtcacttattgctaacttgtctgcggcaaactgctataagtctgaacatctgaagaaacctgagaattgggcacttgttgagaaggcaaaatatatttacattgctggatttttccttacggtatccccggattctattcaacttgttgctgagcatgccgctgcaactaacaaggtgtttatgatgaacctttccgctccctttatctgcgaggttttccgtgatgcccaagagaaagctcttccgtacgtggattacatctttggaaatgaaactgaggcgaggacctttgctaaagttcgaggttgggagattgagaatgttgaggagatcgctttgaagatctcccaattaccgaaggcttcaggaacacacaagaggattactgttatcactcaaggttgcgatccggtagttgtggctgatgatggaaaggtgaaaactttccctgtgatcctcttgcctaaggagaagcttgttgacaccaatggtgcaggtgatgcgttcgttggaggcttcctgtcccagttggtacaagagaagagcatcgatgagtgtgtcagagctgcctgttacgccgccaatgttgtcatccaacgttctggctgcacttaccctgagaagcctgacttcaactagagccatttcagaatttagagtcttatggcatctggtctgtataattagtcgggttcgccttggtctgtttacggcacattctagtgtcaccgtacaggtcaaatgttcatgcgtgtaaggcgtgtcatactgtcatggcactctacaagtgcatgtgccagaaacgtgcatgcgtctctcggttacggactctttacagttgcatctaaaacaattcaaagcaccttgcggtgcatccttgaaaagtt

SEQ ID NO: 1458 - DNA, 1709 bp, Zea mays
  Clone ID: PAT_MRT4577_166289C.1
cctcgagccggccgggccgagcccacttgggtgggcggtggcacgtgaggctgccgctaggaaactccggcctccgggttctctgttctccctttccttccgactttcccactgccgtgacgattttcacagcgaattctccggccggcgccgccccgtccgtccgtccgttcttccgataccgaactcgccagtcgccacagcgatctctctcgctcgctccgccgacgcagcgctcggcttcagctcgagaggaggaaatggccagcagcggctacgaagggatcctcctggggatggggaaccccctcctcgacatctccgctgtcgtcgacgagggcttcctcgccaagtatgatgtgaaaccgggcaatgtcattcttgctgaggacaagcatttgccaatgtaagtctcgttgcccctttagctccccttgcagtttgaaatgttggtcatcgatactagcttgtcctgaacggagaatgggaaacaaattcttgatgttgtcacattaagcacccatgagacggggagaaacatagtggactcgtaatttttatggccaggtatgacgaattggctagcaagagcaatgttgaatacattgctggaggagccactcaaaactctatcagggttgcccaatggatgcttcaaattcctggtgcatcaagttacataggttgcatcgggaaggataagtttggtgaggagatgaaaaaaaatgcacaagctgctggtattaatgcccattatcatgaggatgataatgctccaacgggcacatgtgctgtttgtgttgttggtggagaaaggtcacttattgctaacttgtctgcggcaaactgctataagtctgaacatctgaagaaacctgagaattgggcacttgttgagaaggcaaaatatatttacattgctggatttttccttacggtatccccggattctattcaacttgttgctgagcatgccgctgcaactaacaaggtgtttatgatgaacctttccgctccctttatctgcgaggttttccgtgatgcccaagagaaagctcttccgtacgtggattacatctttggaaatgaaactgaggcgaggacctttgctaaagttcgaggttgggagactgagaatgttgaggagatcgctttgaagatctcccaattaccgaaggcttcaggaacacacaagaggattactgttatcactcaaggttgcgatccggtagttgtggctgatgatggaaaggtgaaaactttccctgtgatcctcttgcctaaggagaagcttgttgacaccaatggtgcaggtgatgcgttcgttggaggcttcctgtcccagttggtacaagagaagagcatcgatgagtgtgtcagagctgcctgttacgccgccaatgttgtcatccaacgttctggctgcacttaccctgagaagcctgacttcaactagagccatttcagaatttagagtcttatggcatctggtctgtataattagtcgggttcgccttggtctgtttacggcacattctagtgtcaccgtacaggtcaaatgttcatgcgtgtaaggcgtgtcatactgtcatggcactctacaagtgcatgtgccagaaacgtgcatgcgtctctcggttacggactctttacagttgcatctaaaacaattcaaagcaccttgcggtgcatccttgaaaagttggggc

SEQ ID NO: 1459 - DNA, 348 bp, Zea mays
  Clone ID: PAT_MRT4577_166427C.1
gagctccccttcttcccccatacctgtcaccagagctgtcttcggtatgccaaaacccaagtcttcaaccccacaggattccaacaggcaatcgcaactggcatgttaccttcataaccctgggtcctccaacaatcatcagcgccgaggagagggggtacccttggtgcatttatgggcacaaaacatcagggcccaacatctacaacaacgtgtgctaccaaaccttgctgtctactgctcagcaacatgagggtgcttccagtcaaccaactagctgcattgaactctgcttcctatttgccacagcaacaagtgccattcaaccagcttgctgctggctacccc

SEQ ID NO: 1460 - DNA, 230 bp, Zea mays
  Clone ID: PAT_MRT4577_166466C.1
tctcgtgtctgggattcgccatgcagatctgtacgagaactgatgctctggatgttgcacgacataccactgctgctgttgctaagggttttgccattggctctgcagccttggtttcccttgcactagggggtgcgtttgtaagtcagtctgctagctcctactgtttatgttctgagtcttaaagttttcatcgggcttatagtcggtgttatgctcctgttctggtt

SEQ ID NO: 1461 - DNA, 256 bp, Zea mays
  Clone ID: PAT_MRT4577_166560C.1
ggcgacagagagcatcggaactggcgccggagatggtcactcagaccaagaggtggagctctgaacagtgaggtgggaattgggatgactcactgacggagatggctctgcgcgtgtgcgtagctttactagatcaagtgttttcgttgttttttcttgggacggcgtatatgcacttgtgtggcgtggtcgtgtgccttgttctactggggaacgggtccctgcggtactggtgtgctgccccgctccgttccgt

SEQ ID NO: 1462 - DNA, 324 bp, Zea mays
  Clone ID: PAT_MRT4577_166647C.1
gttggcttctactccccctccggttcgggttcgggttcgtgaggttctacggggttcggtttcgtgggtgagggatcgagatggcggcgtaggatgttgagtaccgctgcttcgtcgagcggactaacctgggccacggacgaccactccctacacaacgccttcagcacctacggcgaggtcctagagtacaagatcatactcgatcggaagacgcataggtcccgcggcttcggcttcaataccttctccaccaacgatgctatacttaacgccatggagggcatgaactgcaaggagctggacatgtccaacatcacagag

SEQ ID NO: 1463 - DNA, 282 bp, Zea mays
  UNSURE (1)..(282): unsure at all n locations
  Clone ID: PAT_MRT4577_166663C.1
  unsure (1)..(282): unsure at all n locations
tgctaaggcactcgnangtaatcacgtaattctactcgatgcaaggctcaacagccgacgcagagagatccgctggtggaggctgcagaccattatgtacaactgtctcctcatctccgtcgcattcatcatcgtatccgagcacaacatcgtgcacaacctcaaggccgccgctccattcaacactgtagacttagtaataaacatacagtaactagtatatatactgatcggtttggacgagtgatgggttaatcagtttcttaattaactatagctact

SEQ ID NO: 1464 - DNA, 222 bp, Zea mays
  Clone ID: PAT_MRT4577_166819C.1
aaagcaccatttttttcttaggattaacttaaaacaaatcctgacaggagtaacagcattcatagatccacagtccatgctggttgatgcatgggtctgctggagcccacgatgaacacagcactaacaactgacacagagccaccttgcaatcaaaaacactagatgggctataacaaacgaaacgaacgaaaataaaatctttggacttagggaaaaata

SEQ ID NO: 1465 - DNA, 544 bp, Zea mays
  Clone ID: PAT_MRT4577_166846C.1
gtacaagctttttttttttttttttttttttttttttttttttttttttttttttttttttttttttttttaaaacaaaaaagggactttcttatttctgggaagccacaaacatcaaacaaaaaactttattattgaactataacccaaaaaaaatctaaaagagggcccccccaatgatggggtggggggaaaacactgctagggttggcaaaacaaggtgggtgaatggcagcaattgttgcagttgtaaaagggggccagcgttaggcccaacgggctggtaaaacggcaacaactgggggtgggtcaaaaagggagcagggctcacaccaactaactggctgaatgggaaaagttggtgctgctggaaataaacaggaaagttcaatgctgccagttggttgaatggaaaaaattgctggggggaggcaacagggacctggctgaatgggaattgttgttgttgcaaataaaaagcaaagttcaatgcagctagttggttgaaaggaaaaaactgctgttgctgaaagtaagcaacaag

SEQ ID NO: 1466 - DNA, 474 bp, Zea mays
  Clone ID: PAT_MRT4577_166849C.1
aaaaaggactttcttatttcggggaagccacaaacctcagacaaaaaactttattattgaactataacccaaaaaaaatctaaaagagggcccccccaatgagggggtggggggaaaacaccgctaggtttgtcaaaacaaggtggttgaatggcaacaattggtgcagttgtaaaagggggccagcgttaggcccaacgggctggtaaaacggcaacaactggggttgggtcaaaaagggagcagggctcacaccaactagctggctgaatgggagaagttgttgctgctgtaaaaaaacaggaaagttcaatgctgccagttggttgaaaggaaaaaaatgttggggggaggcaacagggagctggctgaatgggagttgttggtgttgcaaataaaaagcagagttcaatgcacctagttggttgaatggaaaaaaccgctgttgctgaaaataggcaacaaggtttgcta

SEQ ID NO: 1467 - DNA, 300 bp, Zea mays
  Clone ID: PAT_MRT4577_166859C.1
gcgtgcttgcctgtgccaccatcatcgtgtcgctttagaatgccttctcctcctaccacgagagtctgggctccaaggtcatcaccgaccgggagactgtgaggtcccgcggcttcagcttcgttaccttctccttcgagaactccatgctcgacgctatcgagaacatgaacggcaaggagctcgactgtcgtaacatcaccgttaaccatacccatttcccgttgcagaagctgtggcggcggtggctacgtcggctgtcgcagcggcttgccgcggttatcgtggcgggcgccgtga

SEQ ID NO: 1468 - DNA, 646 bp, Zea mays
  Clone ID: PAT_MRT4577_166961C.1
cctgcacagcaggtgcatttttcagaggatgaagaactacacgatctatgcagtttccatcaccatccgtattgtgcttggctttatgcttattgccctgatctggaaatttgatttcgctcccttcatggtccttatcattgccattctcaatgatggtactatcatgacaatatccaaggacagagttaagccatctcccttgcccgacagctggaagctcaatgaaatcttcgccactggtgttgtgctgggaacctaccttgctctggtgactgtcgtcttcttctggctcatccacaagacagacttcttcaccaacaaattcggtgtcgagtcaatcaggaacaccgaatttaaggagatgtctgcactgtacctccaagtcagtattgtgagccaggctcttatctttgtgactcgttcccgtagctggtcctttgttgagcgcccaggtttcctcttggttaccgccttcctcctcgcacaattggttgcaacactcatcgctgtctatgccaactgggacttcgcaaggatcaagggaatcgggtggggctgggctggtgttatctggctgttcagcattgtgttctacttcccactcgacattttcaagttcttcatccgatttgtgctgagtgga

SEQ ID NO: 1469 - DNA, 1381 bp, Zea mays
  Clone ID: PAT_MRT4577_167145C.1
gacacacaccgctgcttcaagaaaccaccgagagcccaaccgcacaggcaggagagagagcagggagccagggacagtagcgtggggccggggagcaaagatggaggggaaggaggaggacgtgcgcctgggcgccaacaagttctcggagcggcagcccatcggcacggcggcgcagggcgccggggccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcggagggatgatcttcgcgctcgtctactgcaccgccggcatctccggaggacacatcaacccagctgtgaccttcgggctgttcttggccaggaagctgtccctgactagggccatcttctacattatcatgcaatgcctgggtgccatctgtggagctggagtggtgaagggcttccagcaggggctttacatgggcaacggcggtggcgccaatgttgtcgcccctggatacaccaagggggacggccttggcgcagagatcgttggcaccttcatcctagtctacaccgtcttctcggccaccgatgccaagaggaacgccagggactcccatgtccccatccttgccccactgccaattgggttcgcggtgttcctggtccaccttgccaccatccccatcaccggcaccggcatcaacccggctaggagccttggcgccgccatcatctacaaccgggatcatgcgtggagcgaccattggatcttctgggtcggccccttcatcggcgccgccctggctgccatctaccaccaggtgatcatcagggccatcccgttcaagagcaggtcttaagctgccgcgggtgtgctgagacatgtggggaatgtattgtctgcccacgcctagtttctctgctgaatcttccatctctcttcccttcaagactgctcactgctgcactgctctgttatctgaacccagaacttcgtgtactcctgtaccgagctgtgtgtatgtttttttttcttccatcgtgtttgttgcaagggttcccgtctccttttatgcgttgggatcgtggcaagaaagggcagatatcatgtggaaacgtgggtttataactatcagctggatttttcatccaagtggaatcgattcagaattttcttttaaaaaaaaaaaaaaaaaaaaaaaaaaaaaaaaaaaaaaaaaaaaaaaaaaaaaaaaaaaaaaaaacacctcgaggaggggccg

SEQ ID NO: 1470 - DNA, 1436 bp, Zea mays
  Clone ID: PAT_MRT4577_167152C.1
cattgggtacctcgaggccggccgggaaaaaaaaaaacagtcacagacacacaccgctgcttcaagaaaccaccgagagcccaaccgcacaggcaggagagagagcagggagccagggacagtagcgtggggccggggagcaacgatggaggggaaggaggaggacgtgcgcctgggcgccaacaagttctcggagcgtcagcccatcggcacggcggcgcagggcgccggcgccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcggagggatgatcttcgcgctcgtctactgcaccgccggcatctccggaggacacatcaacccagctgtgaccttcgggctgttcttggccaggaagctgtccctgactagggccatcttctacattatcatgcaatgcctgggtgccatctgtggagctggagtggtgaagggcttccagcaggggctttacatgggcaacggcggtggcgccaatgttgtcgcccccgggtacaccaagggggatggccttggcgctgagattgttggcaccttcatcctggtgtacaccgtcttctcggccaccgatgccaagaggaacgccagggactcccatgtccccatccttgccccactgccaattgggttcgcggtgttcctggtccaccttgccaccatccccatcaccggcaccggcatcaacccagctagaagccttggcgccgccatcatctacaaccgggatcatgcgtggagcgaccattggatcttctgggtcggccccttcatcggcgccgccctggctgccatctaccaccaggtgatcatcagggccatcccgttcaagagcaggtcttaagctgccgcgggtgtgctgagacatgcatgccagttcggaaggacgagcgtcttcctgtggggagtgtcttgtctgcccacgcctagtttctctgctgaatctccatctctcttcccttcaagactgctcactgctgcactgctctgttatctgaacccagaactttgtgtactcctgtaccgagctgtgtgtatgtttttttttttcttccatcgtgtttgttgcaagggttcccgtatccttttatgcgttgggatcgtggcaagaaagggcagatatcatgtggaaacgtgggtttatctatcagctggatttttcatccaagtggaaccgattcagaatttttttccaaaaaaaaaaaaaaaaaaaaaaaaaaaaaaaaaaaaaaaaaaaaaaaaactcgaggaggggc

SEQ ID NO: 1471 - DNA, 4104 bp, Zea mays
  Clone ID: PAT_MRT4577_167226C.1
taacgctcaagtccttctcctaagcaaagccccctcgcttttggcgtatgcccccgctggcgcgcccatgattcccgccgattcctccgcccgttcagtccagcaacccttgctgctgcagtgctgcggctagttcggtggcggggaaggaggaggaggcgagatcttggagtggggcgaagcggagatgtcgttgccgtcgaacaaccggaggacgtgctcccggagcagctctgcgcggtccaagcacagcgcgcgggtggtggcacagacgcccgtggacgcgcagctgcacgccgagttcgagggctcccagcgccacttcgactactcctcgtcggtgggcgccgccaaccgcccgtcggcaagcaccagcaccgtctccacctacctccagaacatgcagcggggccgctacatccagcccttcggctgcctgctcgccgtccacccggacaccttcgcgctgctcgcctacagcgagaacgcgccagagatgctcgacctcacgccacacgccgtccccaccatcgaccagcgggatgcgctcggcatcggcgtcgatgtgcgcacgctcttccgctcgcagagctccgtcgcgcttcacaaggccgccaccttcggggaggtcaacctactcaaccccatcctcgtgcacgccaggacgtcggggaagcccttctacgccatattgcaccggatcgacgtcggccttgtcatcgaccttgagccggtcaacccagccgacgtgccagtcaccgccgcgggcgcgctcaagtcgtacaagctcgctgccaaggccatctccaggctgcagtcgctgcccagcgggaacctgtcgttgctgtgcgatgtgcttgtccgtgaggtgagcgaactcacgggctatgaccgggtcatggcctacaagttccatgaggatgagcatggcgaggtcatttccgaatgcaggaggtccgatctggagccgtatcttggactgcactacccagccaccgacatcccgcaggcgtccaggttcctgtttatgaagaacaaagtgcggatgatatgtgattgctgtgccactccagtgaaggtcattcaggatgatagcctagcacaacctctcagcctctgtggttccacactcagggcttcccatggttgccatgcacagtacatggcaaacatgggttctgttgcatcacttgcgatgtcagtcactataaacgaggatgaggaggaagatggggataccgggagtgaccaacaaccgaaaggcaggaagctgtgggggcttgtcgtctgccatcatacaagcccgaggttcgtccctttcccactaaggtatgcttgcgagtttctcttgcaagtatttggcatacagctcaacaaggaggtggaattggctgctcaggcaaaggagaggcacatcctcagaacgcaaacccttctttgtgatatgctcctgcgggatgctcctgttgggatatttactcggtcacctaatgtgatggatctagtaaagtgcgatggagctgcattgtattaccagaaccagcttttggtgcttggatcaacaccctctgagtcagagataaagagcattgcaacatggctgcaggataatcatgatggttcaactgggctgagtactgacagcttagtggaagcgggttatcctggtgctgttgcacttcgtgaagttgtgtgtggcatggcggccataaagatctcttccaaagattttatcttctggttccgatcgcacacaacaaaggagatcaagtggggtggggctaagcatgaaccggttgatgcagatgacgatggcaggaggatgcatccacgatcttcattcaaggccttcttggaggtggttaaatggagaagtgttccctgggaagatgttgaaatggatgctatccattctttgcagttaatattacgtggctccctgccagatgaagatgccaacagaaacaatgtaaggtccattgtaaaagctccatctgatgatatgaagaagatacaggggctacttgaactgagaacagttacaaatgagatggtccgcttaattgagacagcaactgcccctgtcttggctgtcgacattgccggtaacataaatggatggaacaataaagctgcagaactaacaggtttacctgtaatggaagccatagggaggcccctgatagatcttgttgttactgattctatagaagtggttaagcagattttggactcagctttacaaggaattgaagagcaaaatatggaaatcaagcttaaaacattccatgaacatgaatgcaatggtccagtaatcttgaaggttaactcctgctgtagtcgggacctttcagagaaagtcattggagtttgctttgtagcacaagatttgaccaggcagaagatgattatggataagtatactaggatacaaggagactatgttgccatagtaaagaaccccactgagctcatccctcccatatttatgatcaatgatcttggttcctgcttagagtggaataaagctatgcagaagattaccggtataaagagggaagatgcgataaacaaattgttaattggggaggtcttcacgcttcatgattatggctgtagggtgaaagatcatgcaactctaacgaaacttagcatactgatgaatgcagtgatttctggtcaggatcctgagaagctcttttttggtttcttcgacacagatgggaagtatattgaatccttgctgacagtgaacaagaggacagatgctgagggtaagatcactggtgctctttgctttctgcatgtggccagtccagagcttcagcatgctctccaggtgcagaaaatgtcggaacaagctgcgacaaacagctttaaggaattaacttacattcgtcaagaattaaggaacccactcaatggtatgcaatttacttgtaacttattgaagccttctgaattgacagaggaacagcggcaacttctttcatctaatgttctctgtcaggaccagctgaaaaagattttacatgacactgatcttgaaagcattgaacagtgctatatggagatgaacacagtagagttcaaccttgagcaagctctgaatacggttctgatgcaaggcattcctttgggcaaggaaaaacagatttcaattgaacgtaattggcctgtggaagtatcatgcatgtacctttatggggacaatttaaggcttcagcagatcctagcagactatctagcatgcgcccttcaattcacacaaactgctgaaggacctatcgtgctccaggtcatgtctaagaaggaaaacattggatctggcatgcagattgctcatttggagttcaggattgtccatccagctccaggcgttccagaggccctgatacaggagatgttccagcacaacccaggggtgtccagggagggcctcggcctgtacataagccagaagctggtgaaaacgatgagcggcacggtacagtaccttcgagaagccgacacctcgtcgttcatcatcctgatggagttcccggtcgcccagctcagcagcaagcggtccaagccttcgacgagtaaattctgaccctcatgctgctggaactgcagcgagtgttctgccgtgtcgaagtctcggttgtagctagccaagtggctgctactgaaacatcggttggtcggttctggtatctagcacggcctgtgtagtgcggatagatttggttgtttggctttggagagataagctagctggctaggtgtaacgtaacgtcgaccgataactgtatgtgaatgatgatgagctgtgaggacgaataaaggcttcacttgtgttctctattgctcttcttagagtatgatggccaacagctgtacaggaaagcatccacctaaatctgggctcgctgaatgacggctaaaagttgtttggtggctttaaactcttttatgctttgtaatcccttacagtcggatgttggtctttaaactgtcagttaaatgctggtacggcggtaggtctgttttcttgatctctctgttgagcaaggccccccttttgttcggttagattacatgtaaccgttcagtttcttc

SEQ ID NO: 1472 - DNA, 351 bp, Zea mays
  Clone ID: PAT_MRT4577_167251C.1
gcagcaactgttggccttaccgagtttagattatgccagtgatgatgccacagatgatgaggcctaacatgatgtcaccattgatgataccacgcatgatttcactaatggtctttccgagcattatttaacaaatgatgatgccacaatgtcactgcgacgcctattcgcatataatgctgtatcaacagtaaccattcatgaacaacccaatggccatgacgaattcacctatgttcttacaacaactcattttttgagctacattctaaatataaatatgaaatttgtaccaaacaatgatttgacatgccatctttattaactcatgattattaactattactatta

SEQ ID NO: 1473 - DNA, 1477 bp, Zea mays
  Clone ID: PAT_MRT4577_167305C.1
aggtatactgaggcgaaggcaagctatctttgcgcttggggcaatgacgcagctcatgaggttataccgaggcgcgtcaattgctggttgaaaactatttccaaaccccctctgcggcccgcaagggccacagagaatttctggaagggctccctctaaccagggtaaagcccacactcatccattccatcatcccccttgcaagtatagtctcggcggctctagaagacgatgggcaaggacgacgtgatcgagagcggcgctggcggcggcgagttcgctgccaaggactacacggaccctcccccggcgccgctgatcgacgcggctgagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtcggggtgctgggcatcgcctgggctttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcgggggaagtcgtgagcgaggagaatgacatcatcgatcgacttgggtgccggtggttggttcgggtcgccttttttgtttcagcagctgctgcgttgcgcgcgtgcgtgagatttggtttggtttcgttcccctgcaatgtaatcatgtcgtgactctcaagggattattccgctctgctcttatggtctctgttttctatttaatgattgttattaccatgtagcagtaaccatcgtcatcagtgagaaccttgttgcttctgtctaaatcaaccgagacgtgtggagtggatgtggatcgagcaaaaaaaaaaaaaaaaaagcggcc

SEQ ID NO: 1474 - DNA, 1822 bp, Zea mays
  Clone ID: PAT_MRT4577_167306C.1
ctcgaggccggccgggccgggatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactgcaccgccggcatctcggggggccacatcaaccccgccgtcaccttcggcctcttcctggcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcgggggggccgtgagcgaggagaatgccatcattcatcgatcgacttgggtgccggtggttggttcgggtcgccttttttttgtttcagcagctgctgcgttgcgcgcgtgcgtgagatttggtttggtttcgttcccctgcaatgtaatcatgtcgtgactctcaagggattattccgctctgctcttatggtctctgttttctattttaatgattgttattaccatgtagcagtaaccatcgtcatcagtgagaatcttgtagcttctgtctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccccctttcaaaattaaaggtttttgttgttccccaacccaaattccaaaaggccaaaaaataagggcccccccccccccggggaaacaaaaagggccttccaaaaaaaggaaacctttaataacccaatttaaaatttctaattctcgggaaaggggaaaatggaaaaaaaaaattttgaaaaaaggattcccctggaaaattttaaaaaaaaaaataacccaccattggggggaaaattcaacccgtggaattcccccaaaaatggggaaaaaaaaaggttcaacggtggaaaaccccaaggaaaaaaaaattttggggcccccgggaaggaaaaaaaaaccctggccaagggggaaacattaaggtttaaggaaccccaagggttaattaaaaaaaaggtcccaacgggaaaa

SEQ ID NO: 1475 - DNA, 243 bp, Zea mays
  Clone ID: PAT_MRT4577_167427C.1
agctgcgaacaaaaaccttgctcattcttctttcgtctcgtttcatagcgggagcaaccaaagggaacaacaggggtaccaacacctaatgcacaggtagaacggacactaacactgtgacagaggcgaacggcaacacgatactattgatagattacataactcggacacagacatgatgggcccacacatcatgccctccaaccaccgacgtctacgacgttgtcgacacacaacacacct

SEQ ID NO: 1476 - DNA, 1200 bp, Zea mays
  Clone ID: PAT_MRT4577_16750C.1
ccgcacacacacgcaatctccctcccaacaccgctgcctgagtggcgtccccatcccggggcgcagatccgcccgcctgatgggctccccatccatgtcgacggcgcccacgcgacaatccagcagagctcgaaaaaagggtacgaatacgaaccccaatccagggccggaggagggcgagcgaactcaaaagcaagccgttccagtccaatccgcctcagtccaaatctaatcgccgggtttaggcagaaggggcgggacgcggcgaggtttaggcggggtttgttttgtcccttccgtgcgattctgctctccgcgcgggaggcaagtactgacggaagcgaaggcgaaggcggaggagggggtccccggcggtggaagtggaacgcgccgatgcgcaagtttcaggactccatcaaggccctccaggccgacatcgatcacgccaatgcgatggcgtcggaattcctgagggactacgacggctcggtcatccagatgcgggtggcgtacagcgccgtcgcgcatttcctcctgcagtggaccgactgcaagctcgccggcgcgctcggcctcctcaaggttatgctatacaaggtgtgcgcggacggctcgtcggcgcttcctgattgggagatggaggccagcatcagggagttctacggcgtcattttcccgtcgctgctgcagcttccgagtggcatcaccgagctggacgacaggaagcagaggaagctctgcctgaagaaattcaggagcagggatgagcagctctcggaggtggacacggagagggagctcgagtgcgggatctgcctcgagggcccaacgtgctgccgacgtgcccacatgctctgcatgcgctgctttgaggattggaacgagaaatcgaagtcctgccccttctgtcgcgcctgcctggaggaggtgaagccgggcagcctgtggatatacaccgacgacagcgacgtggtggacatggataccttgactagggagaacatcaggcggctgttcatgtacataaataagctgccacttgtagtcctacatgtagttgaccttgacgtttacaagtaccgcatcaagtaaaatgcaactgacccttctggtgcaaaaaaaaaaaaaaagacgaacggtcgtaccgctttagagcatacgagcgcgcgcacgcgcgcacatagactgttatagagtgtc

SEQ ID NO: 1477 - DNA, 263 bp, Zea mays
  Clone ID: PAT_MRT4577_167607C.1
cggtggagagccttcctctgcggccttcttcgcgaaggctgggctggattacgattcttgctccacctttcagggttccgattgctaggctagctgcagctcaggtgcttgtctgagggtgcctccacattgaaccaccggattgcctgctgatggtggatgtggtgatccacagtatgatcgcagagccatgctatgtgaacattaactagtagcagtgctcataaaagctacaatcccatgtcctttttttccccagtcag

SEQ ID NO: 1478 - DNA, 2732 bp, Zea mays
  Clone ID: PAT_MRT4577_167692C.1
ttgggtacctcgaggccggccgggaggtgtattcataccagcactaatgcaccggatcccatcagaactccgcagttatgcgtgcctgggcgaccggaacccaatccacccctcgcccaatgcgtagttgtatctgcatctccaacaccaccagcagaggttccagttagtttttttttagattagaaaaatcgagtccaacagactcgccgcactgcgcgggatcgacctcgtcgcaactcccgtgtgcgccgccaataatggagacccgggacacggatgcgacgccgctcccctactcgtacacgccgctgccggccgccgacgccgcgtcggccgaggtctccggcaccggcaggacgcggagcaggcggcggcccctctgcgcggcggcgctcgtgctctccgccgcgctgctcctagccgtggccgcgctcgtcggcgtcggtagccggcccggcgcggtggggatgacagagtcggcggcctcgtcgccgacgccgagcaggagcaggggccccgaggccggcgtgtccgagaagacgtccggcgcgtctgacgacggcggcaggctccgtggagccggcgggaacgccttcccgtggagcaatgcgatgctgcagtggcagcgcacgggattccacttccagccgcagaagaactggatgaacgaccccaatggccccgtgtactacaagggctggtaccacctcttctaccagtacaaccctgacggcgccatctggggcaacaagatcgcgtggggccacgccgtgtcccgcgacctgatccactggcgccacctcccgctggccatggtgcccgaccagtggtacgacaccaacggcgtgtggacggggtccgccaccacgctccccgacggccgcctcgccatgctctacacgggctccaccaacgcctccgtccaggtgcagtgcctggccgtgcccgccgacgacgccgacccgctgctcaccaactggaccaagtacgagggcaacccggtgctgtacccgcccccgggcatcgggcccaaggacttccgcgaccccaccacggcctggatcgacccctcggacggcgcatggcgcgtcgtcatcggctccaaggacgacgacggccacgcgggcatcgccgtcgtctaccgcaccacggacctggtgcacttcgagctcctcccgggcctgctccaccgcgtcgacggcaccggcatgtgggagtgcatcgacttctaccccgtcgccacacgaggcagggcgtcggccaacggcgtcgacatgtccgacgccatcgccagcaacggcgccgtcgccggggacgtcctgcacgtcatgaaggccagcatggacgacgaccgccacgactactacgcgctggggaggtacgacgcggccgccaacgcctggacgccgatcgacgccggcagggacgtcggcatcggcctgcgctacgactggggcaagttctacgcgtccaagacgttctacgacccggccaagcgccgccgcgtgctgtggggatgggtcggcgagacagactcggagcgcgcggacgtgtccaagggatgggcgtcgctgcagggtatcccccggacggtgctcctggacaccaagacgggtagcaacctgctgcagtggcccgtggaggaggtggagacgctgcgcaccaactccaccgacctcagcggcatcaccatcgactacggctccgtgttcccgctcaacctccgccgcgccacccagctggacatcgaggcggagttccagctggaccgccgcgccgtcatgtcgctcaacgaggcggacgtgggctacaactgcagcaccagcgggggcgccgccggccgcggcgcgctggggcccttcggcctgctcgtcctcgccgaccgccgcctccgccgcgagcagacggccgtctacttctacgtggccaagggcctggacggctccctcgccacgcacttgctgccaggacgagtcccgctcctccagcgccaccgacatcgtcaagcgcgtcgtcggcagcgccgtccccgtgctggaggacgaggccacgctctcgctccgggtgctcgtcgaccactccatcgtcgagagcttcgcgcagggcgggaggtccaccgccacatcgcgcgtctaccccaccgaggccatctacgccaacgccggcgtcttcctcttcaacaacgccaccgccgcgcgggtcacggccacgaagctcgtcgtccacgagatggactcgtcatacaaccacgactacatggcgccggtggcagacatctgatcgatgcaatgcaaccacgccactctgcaccgcaacaaattttccaacacacataaatataccaagcaattcccatctgtcaaattttcttatttccctgccatgattttggtctctatttttcctgctggctacttcttatcttccagcactagtaatgtacgtactggctagtaactagggtatccagtgggaagacgtgtgtagcctctagttgtacatgcatgtatgatgctgtgtagcaccgcatcatgcacaccacaccaatgcaaatgagttataaatgtttttaagctccaaattaaattttcggtgcctgaagagtcaagttattggagaatgatgaatggatcagataataacgcagacttgcagagactaaaaaaaaaaaaaaaaaagcggccaaaagaggaaaaagaaagggcggccgctcgcgatctagaacaagt

SEQ ID NO: 1479 - DNA, 998 bp, Zea mays
  Clone ID: PAT_MRT4577_167838C.1
ccggccgggatcctctcctggctaccccacactcgccgctctggctcttcgaggaccgccacctgctcccgctcgacgcgcccgccgtcttcgaggaggtccagcggccacgctccgggaattctcacacttcaagcaagccagctgaacagatcaggcacagatggcagtttcatctgtccctggacgaagatggcacagacaactccagcttgttcaaggagaagctgacacacgctcttcgctacttcaaggagtccaccgatcaacatctgctggtccaagtctgggcaccagtcaagaatggagaccgctatgtgctcactacttcaggacagcctttcgtgcttgaccaccagagcattggcctacttcagtacagggctgtatccatgacctacatgttttcagttgatgcggaaaatgttggagacctgggcctacctgggcgtgtctataagcaaaaggtgcccgagtggacaccgaatgtgcagtactatagcagtggtgagtaccaacgacttaaccatgcgatcagctacaacgtccatggtacagtcgctctgcctgtttttgatccttccgctcactcgtgtatcgctgttgttgaacttataatgacatcaaagaagataaactatgcctgcgaggtcgataaagtctgcaaagcacttgaggcggtaaatcttaaaagcactgaaatacatgaccatccaaatgtccagatatgcaatgaaggccgtcaagctgcgctggtcgaaatactggagatcttgaccgtagtatgtgaagagcacaagcttcctttggcacagacctgggttccttgcaagtatagaagtgtcttggcgcatggtggtggtttaaaaaagagctgcttaagttttgatggaagttgcatgggggaggtctgcatgtcaactagtgatgtggcgtttcatgtgattgatgctcatatgtgggggtttagagatgcctgtgtcgagcatcacctacag

SEQ ID NO: 1480 - DNA, 209 bp, Zea mays
  Clone ID: PAT_MRT4577_167956C.1
aggccggcagcgagaagaagcaccacttcttgggctgattcgatgctaccgcatcgtcagtccctccccgtgtgctacgcgtgcagtgagatgagtgatatcgagcgcccgacgtgttgtgcgcgcgtacgtatgtatgcgctcgagtgatgcacgaataagcgtggctacgtaatctatggtatgtatacaggtgtagtatgcatgtg

SEQ ID NO: 1481 - DNA, 384 bp, Zea mays
  UNSURE (1)..(384): unsure at all n locations
  Clone ID: PAT_MRT4577_168108C.1
  unsure (1)..(384): unsure at all n locations
ctgtctgctcctccccctcttaccaagacctattcgggttagggttacttagggttttgtggaggggcgatggccgccgctgatgtgcagcaccggtgcttccacggcgggcttgcctgggccagcaactacgagtgcgtggagaatgccttcgcctactacggtgagatcctagactacaaggtcatcaccgaccgggagacggggaggattagcggcttcagcttcggtaccttctgctgcgagaactacatgctcgacgctatcgagaacatgaacggcaaggagctcgacggccgtaacatcanccgtaaccaggcccagtcccgtggcggtggcggcggcagcggtggctacggccgcggccgcagcggcggcggctat

SEQ ID NO: 1482 - DNA, 339 bp, Zea mays
  Clone ID: PAT_MRT4577_168134C.1
atcaatgctgtgctcaaaaaagtgggagcctaatgctcacaagataatggaacatcggatgaagtattacaggttgagaaaagagatggatgaaaacatatcccatcgtgatccgcttcgtcaacgttcacatgcgcaggctgcttacgacaaggccaatacgaatgaacaatcgtcaagtcgctcatcaggaggtgcatcttccataagctttcctggacggatgcctcctggcggttttcctagaaggattcccagttgaggtttcccctggggttgcatgccttgaggtttccctggtggtgttcccggtaatgttcatatgagtaaaatgctgaa

SEQ ID NO: 1483 - DNA, 746 bp, Zea mays
  Clone ID: PAT_MRT4577_168216C.1
gccggccgggttggagcatcgatccctaccgaataatattctgcagtagtttcttgagctcctgtaggtagaaagaaacgatgtcgggagtgtgggtgttcgaggacgggatcgtgcggcgtgcggacagcgagccgcccagcggcgccggcgccggcgggtcgcggccgaacaaggtgctggtgcacgtgccgagcggggaggtggtgacgtcgtacgaagtgctggagcggcggctccgcgagctcggctgggagcgctacctctacgacccctgcctgctgcagttccaccagcgctccaccgtgcacctcatcaccgtaccccgtgacttctcccgcctcaagctcgtccacatgtacgacgtcgtcgtcaagacccgaaacgtcttcgaggtccgtgacgccgcccctgcctgatggtcttcgtggcgacgcaagctgctgctgtgtgcctattagcttcgtgcaagctcgtcggaccggctgcgcgttcgtgtggctgcttcttgcatgctgtcctactttgtctgccgccgaataaatgtacgcgagagcgccgccgccgtcgccgtcgccgtatgcttcttatatatccggatttgagggtgcgttctttgactctttagtattagtcactttctagaataccaaatgggttgaggatttctaggaactaatatttagttcctagagtttagacacgggtgactaaagaaatcaaacgttccatattgcttctctcta

SEQ ID NO: 1484 - DNA, 964 bp, Zea mays
  Clone ID: PAT_MRT4577_168274C.1
aattcggcacgaggggcgggttcgcatccggcgagccgatactgtgccagtgcggccgcgcggcggcggagcaaccacgcgcgcagaccgccgtcgccacctcctccctccctccgctccccggcgtgcgtccgatccaccaggaatcgaaggctcccacacgccccaacgcgatgctgcgcaacttcccgcaggcccggaggctcctcaggcggatggggttcgagaaggaggacgcctacttctggaagcagatgggcaaggccatgctctgcacgtacacgctcttcggcgtcgtctggctctggaacgagacgtcgccgctcgggtggtggacgctcaagccgcgccccaaggaagaaagagagatggcacacctctatgagcgcaggaagttcccgtaccctggcgatgatgaggcggtcgaggagtttgtaaagagcggaggtgctcttggaaccacaattggacccaggggattcgctgacgccaatatggattctgaaaacatgcagaagcagctgcagtctaagaagttcgagcaggaagcacagaaactgtggattcggatgaggaatgaggtcgtacaggagctccaggagaaggggtttgatatcgagtgaatttgaaacctgcagtatggtcggcgctgaggatgttaaaacttaaaaccacttgccatctaaattggagaactgtataacttaggaataaaagagtttgtagctatctttttaactaactatctggtgctgcattcttggtgctgctagattgtaccgaaaataaattttgatgtcttgtggagaaccgaggatctcatttgaatatttgatcctcttttaatgtttcttattgcctgatcatcaaattactcatgttttgatgttggtgcatgcaacctatatgtgcagcattgaggatgcgttggtacttggcatatatgctagtccatgattatttc

SEQ ID NO: 1485 - DNA, 387 bp, Zea mays
  Clone ID: PAT_MRT4577_168364C.1
gcacgattctactcctccgtccgcgtaacttttggtttcggctatgtcggggcgcggcaagggcggcaaggggctgggcaagggcggcgccaagcgccaccacaaggtgctgcgcgacaacatccagggcatcacgaagcctgcgatccgtaggctggccatgacgggcggcgtcaagcagcatatctgggctcatctacaaggagacccgcggcgtgctcaagatcttcctcgagaacgatattcgcgacaccgtcacctacaccgagcacgcccgccgcaagaccgtgaccgtcatggatgtctgttacacgctcaagcgccaaggccgcacgctctacagctttagcggctacgcccccttcccttatgatgctttgatgtgac

SEQ ID NO: 1486 - DNA, 600 bp, Zea mays
  UNSURE (1)..(600): unsure at all n locations
  Clone ID: PAT_MRT4577_168366C.1
  unsure (1)..(600): unsure at all n locations
gccggccgggccgggtcacacacaggctcaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcgctcaagcgccagggccgcaccctctatggcttcggcggctaggctaggccggccgcgcctcgctgtcgtcgctgcggttctattgtttttgcaattcgcaagctgtggctgggtggcgaaaatgctggttactgtagcactagatcaagcatgttgtgcgtgtctgaagaaatgccaattgtgacttgctgtttgttcaaacatgctccatttcatcactaaaaaaanaaaaaaaaaaggccccta

SEQ ID NO: 1487 - DNA, 791 bp, Zea mays
  Clone ID: PAT_MRT4577_168368C.1
ggcgattgggttcctcgaggccggccggggtctcatctcttccatacgaccataccctacctccaaattcccaattctcaacctctcctccgagttcgagtgaccatgtcggggcgcggaaagggcgggaaggggctgggcaagggcggcgcgaagcgtcaccgcaaggtcctccgcgacaacatccagggcattacgaagccggcgatccggaggctggcgagaaggggtggcgtgaagcgcatctcggggctcatctacgaggagacccgcggcgtgctcaagatcttcctcgagaacgtcattcgcgacgctgtcacctacacggagcacgcccgccgcaagaccgtcaccgccatggacgtcgtctacgcgctcaagcggcagggccgcaccctctacggatttggcggctgaggggtcaggggtgtcccccagctgctgctggtcgttgcagaagtcttgggtcgcggtcacgaaatggagtgaggcgagagtattcttgcccatgtgcttagtttcgtaggcttatcactctagactctagtgccttggtccagtagtagcatacgacttgtactgcatttccttgttctgaacctctaaatatgatgagatgtggattcacttgatctcacaaacaaccagttaattcggatcaaatttgtactgactttctcgatcatcccagtttttcatctaaaagagcatttgccaaaaaaaaaaaaaaaaaatttgcggccgcaaattttttttttttttttttgaacactaaacgaactgtcacaccc

SEQ ID NO: 1488 - DNA, 565 bp, Zea mays
  Clone ID: PAT_MRT4577_168369C.1
atctcgccacaccgccgccacaaccaccaccagcaacacacacacagcagcccagccaatctcgccggagaaagaagagtcgacgatgtcgggccgcggcaagggagggaaggggctgggcaagggaggcgccaagcgccaccggaaggtgctgcgcgacaacatccagggcatcaccaagccggccatccgccgtctggctcgccggggcggcgtgaagcgcatctcggggctcgtctacgaggagacccgcggcgtgctcaagatcttcctcgagaacgtcatccgcgacgccgtcacctacaccgagcacgcccgctgcaagaccgtcaccgccatggatgtcgtctacgccctcaagcgccagggccgcaccctctacggattcggcggctaggtcacgccggtcctgtcgaatccacctcgagccgccagattcgtagctagctagccatggtttgttcagtgttcatggtcttcggtgtaatggaatggccgcatctcgctgctgtctgttgtttcggtgtatcgctagcgtggaatggaaatctcagcattttatctg

SEQ ID NO: 1489 - DNA, 615 bp, Zea mays
  Clone ID: PAT_MRT4577_168371C.1
aattcctccatcagtacccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtcaccgccatggacgtcgtctacgcccttaagcgccagggccgcaccctctatggcttcggcggctaggtctgccgcggccgcgcctcgcctcgccgttggtgcggttctggtgttgctgcagttcgcaagttgtttgtggggggtgaaaaaatgctagctactgtagaactgcagtgccgtacgcagcacatggtgtgtttgtctgaagaattgttgtcaatgctggcttgctctggactcaaacatgctccattttgtgttgcaaaaaaaaaaaaaaaaaaggccccta

SEQ ID NO: 1490 - DNA, 696 bp, Zea mays
  UNSURE (1)..(696): unsure at all n locations
  Clone ID: PAT_MRT4577_168372C.1
  unsure (1)..(696): unsure at all n locations
ccgggagtcgcccacaaaaacccagtaactcgcatcttcctccgtgatccaagttctagcagcgcagcgctcggtttcggcaatgtcggggcgcggcaaaggcggcaagggtctgggcaagggcggcgccaagcgccaccgcaaggtcctgcgcgacaacatccagggcatcaccaagccggcgatccggaggctggctaggaggggcggcgtcaagcgcatctccgggctcatctacgaggagacccgcggtgtgctcaagatctttctggagaacgtcattcgtgacgccgtcacctacaccgagcacgcccgtcgcaagaccgtcaccgccatggatgtcgtctacgcgctcaagcgccagggccgcaccctctacggcttcggcggctaggtcgcttcctcatctggtggcgaactgcatgtggtgtcggcgattatcgtgttgtgtgcctaatctagtgtagtccgttctctctatcgtcgcgtgttctgtggtgtcttgtagtccatttcctgcaataccaacttgccattatcaatggaaaaccctcgttttcatcctcaacgtgtctagttctgattntgttttgttctggtttagggttcgtatgagatgtacatagggctgctgttgctttggtgtttgattgccatttttatattgccagagagctgcagttctctgtattatgc

SEQ ID NO: 1491 - DNA, 633 bp, Zea mays
  Clone ID: PAT_MRT4577_168374C.1
gccggccgtcccggggcacaaatcctcttcctcgagttctcctcaaccaaattcaaggtcacagcggcgaacctctcggctatcatgtctggccgcggcaagggcgggaagggtctgggcaagggcggcgccaagcgccaccgcaaggtgctgcgcgacaacatccagggcatcaccaagccggcgattcgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtcaccgccatggacgttgtctacgcgctcaagcgtcagggccgcaccctctacggtttcggcggctaggtcgccctctctcccggtggcgaattacgtggtggcgatggcggtcgtgttgtgttcttggtctagtgttgtctgtgttgtctttatcggtgctgttttctgtggtggttgtgctgcatcgttctagtttctagttcatgtgctgtaatatctcgctgctgtaatcaatggaatggcctcgtttccaggctcaagatatatcgtccttttgaaaaaaaaaaaaaaaaaaggccccta

SEQ ID NO: 1492 - DNA, 617 bp, Zea mays
  Clone ID: PAT_MRT4577_168375C.1
taccctcgaggccggccggggatagcacaaatccacttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgcgctcaagcgtcagggccgcaccctctacggtttcggcggctaggtcgccctctctcccggtggcgaattacgtggtggcgatggcggtcgtgttgtgttcttggtctagtgttgtctgtgttgtctttatcggtgctgttttctgtggtggttgtgctgcatcgttctagtttctagttcatgtgctgtaatatctcgctgctgtaatcaatggaatggcctcgtttccaggctaaaaaaaaaaaaaaaaaagcggcc

SEQ ID NO: 1493 - DNA, 621 bp, Zea mays
  Clone ID: PAT_MRT4577_168378C.1
cctgccggatcgcacaaatcctcttcctcgagttgtcctaaccaattaaagttacagagcgaaactctcggcgatcatgtctggccgcggcaagggcgggaagggtctgggcaagggcggcgccaagcgccaccgcaaggtgctgcgcgacaacatccagggcatcaccaagccggcgatccgcaggttggcgaggaggggcggcgtcaagcgcatctccgggctcatctacgaggagacccgcggcgtgctcaagatcttccttgagaacgtcatccgcgacgccgtcacctacaccgagcacgcccgccgcaagactgtcaccgccatggacgttgtttacgcgctcaagcgccagggccgcaccctctacggtttcggcggttaggtcgccccctctcccggtggcgaattacgtggtggcggtggcggtcgtgttgtgttcttggtctagtgtagtctgtgttgtctttatcggtgctgttttctgtggtggttgtactgcatcgttctagtttctagtccatgtgctgtaatatctcgctgctgtaatcaatggaatgtcctcgtttcaagcctcatgacatatcgctcttctgtaaatctgcaagaattccgtgc

SEQ ID NO: 1494 - DNA, 644 bp, Zea mays
  Clone ID: PAT_MRT4577_168396C.1
ccggccgggaaaaaaaaaaaaatcctcttctcccccagctccccagcaccagtccccaattatttggcctccgtcagagaggggagaaagacccgttcgaggcggcggcgatgtcggggcgcggcaagggcggcaagggtctgggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatacgcgacgccgtcacctacaccgagcacgcgcgccgcaagaccgtcaccgccatggatgtcgtctacgcgctcaagcgccagggccgcaccctctacggcttcggaggctaggcgcctcttcgtagctggggaatgcttagggtgatacgtctctgtcgctgtgggtcgtagtgttgctgcgttcctggatgtaatccatttttttttctgcaatgaagagatgctggcaagcatactacctgcatatgttgcgcctgggtgattgttctccttagaaatggtagtaacagtgaatcttgttcacgaactaaaaaaaaaaaaaaaaaagcggcc

SEQ ID NO: 1495 - DNA, 630 bp, Zea mays
  Clone ID: PAT_MRT4577_168398C.1
gccggccgggttccggaccgccgccgacttctgattctaccaccacccgcctcctctcgagttcgatctgtttgctcccccagacatgtcgggccgcggcaagggaggcaagggcctgggtaagggcggcgcgaaacgacaccgcaaggtgctccgcgacaacatccagggcatcacgaagccggccatccggaggctggcgcgcaggggcggcgtgaagcgcatctccgggctcatctacgaggagacccgcggcgtgctcaagatctttctcgagaacgtcatccgcgacgccgtcacctacacggagcacgcccggcgcaagaccgtcacagccatggacgtcgtctacgcgctcaagcgccagggccgcaccctttacggcttcggcggctagggcgataggctaggccatgctcgacccgcccccactctctccctctggcgtcgtcactggttccttgacccctgtgcgggtcggtcggtggtgctagggtcaacagttgtctggtgtctgtggcttctccggctatccgttctttggtgtgaaatggaattccaagcgtgtgaatgggaatggatcttaattttgcactgatggcacaaaaaaaaaaaaaaaaaaggccccta

SEQ ID NO: 1496 - DNA, 541 bp, Zea mays
  Clone ID: PAT_MRT4577_168399C.1
actatctcttcacccaccaaaccccgctccaaaatccccaaatcccctctcttccgaagctactcagccatgtcggggcgcggcaagggcggcaaggggctcggcaagggcggcgccaagcgccaccgcaaggtcctgcgcgacaacatccagggcatcaccaagccggcgatccggaggctggcccggaggggcggcgtgaagcgcatctcggggctcatctacgaggagacccgcggcgtgctcaagatcttcctcgagaacgtcatccgcgacgccgtcacctacaccgagcacgcccgccggaagaccgtcaccgccatggacgtcgtctacgcgctcaagcgccagggacgcaccctgtacggattcggcggctgaggagccgcggcgcttgctggccggccgtggcgcacaagccctggctcgcggtcaagaaagtggaggagaggagaaagctgtagttgatctgggttccatgccttctatgattagtagtaatatctgtagtagcagtagctggttgttcaatggttgcttc

SEQ ID NO: 1497 - DNA, 603 bp, Zea mays
  Clone ID: PAT_MRT4577_168402C.1
gccggccgggccgggatccaactcaccacaggctcaccccaccaacagcaagcgaaaatctcccgatcccctctggtctccgcggcgaagatgtcggggcgcggcaagggcgggaagggcctgggcaagggcggcgcgaagcgccaccggaaggtgctccgcgataacatccaggggatcacgaagccggcgatccggcggctggcgcgcaggggcggcgtgaagcgcatctccgggctcatctacgaggagagccgcggcgtcctcaagatcttcctggagaacgtgatccgcgacgccgtcacttacaccgagcacgcgcgccgcaagaccgtcacagccatggacgtcgtctacgcgctcaagcgccagggccgcaccctctatggcttcggcggctaggctaggccggccgcgcctcgctgtcgtcgctgcggttctattgtttttgcaattcgcaagtagtggctcggtggcgaaaatgctggttactgtggcactagatcaagcatgttgtgcgtgtctgaagaaatgccaattgtgacttgctgtttgttcaaacatgctccacatttcaacaaaaaaaaaaaaaaaaaagcggcc

SEQ ID NO: 1498 - DNA, 611 bp, Zea mays
  Clone ID: PAT_MRT4577_168403C.1
ctaaagtctaccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggcgcgcaggggcggcgtgaagcgcatctccgggctcatctacgaggagacccgcggcgtgctcaagatctttctcgagaacgtcatccgcgacgccgtcacctacacggagcacgcccggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaaatcgtgtgaatgggaatggatctctgttggattgttcaattaaaaaaaaaaaaaaaaaaaactcgaggagtcttctag

SEQ ID NO: 1499 - DNA, 1440 bp, Zea mays
  Clone ID: PAT_MRT4577_168407C.1
ggccgcttttttttttttttttttacaagcagattctccacaaaatccaaccatatgtgtgctttggcataatttaatatcatcgacatgtttttaacaaaatcctctccaagatccataccaagcacgaagccttcatggaaatagcaaaacagagataccttaaagggtttcaggtacaagaaattgacaactagatcagacactatgagggacgcccgacgtctagaagcggagtttggtaaagaaccacctgttcttgccggtcttgaacctctcctcgaggcgcgccttggcggccttgcaggcttcgaccttcttgtcccgggtggagagcgcgtcgggcccgcccgatgcgacgtccttaaagtcgacgtcgagggtgtagcgggtgggcatgaggtgcgtgaagttgacgagcttgatgaagcacttgacgcgggacttcttggccgtcttcttggcggagtccttgcggatcaccttcttggggtacttggcgaggcccgcgacgaggcagtgcccgtagggacgatcacgggtgccctcctcgaaaacgcgcacgatcacggccttccggccggcgaaccggccctggaggaggataacggccttgccgggcttgaggaacttcaccatctttgctctttggacggtggtagcgatgctgcgccgccggcccacgcgtccgcccacgcgtccgcccacgcgtccgacccaatctcccctacaccagaaaaattcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggacgcaccctctacggcttcggaggctaggctaggcgcctcttcatagtcggggactggttaggggacatgtctctgtgtgatgctttctgtggtattattgctgcaatagccgtgtaatccatcgcttctgcaatgaagcgctcggaagcatgctacgtatgttgtgtctgtgggtgattgtatttctggtagtaacagtgattgttcctgaattttggataatacaagctcattcgcagtagtttctgttgtaatcctgtcttatcgtttgagaggagtattgctttgggcagcctttgctgtgcatttttatgcattaggataaaaaaatttggtcgacttacgaaaaatttgcgcagcagacatgcgctagatc

SEQ ID NO: 1500 - DNA, 605 bp, Zea mays
  Clone ID: PAT_MRT4577_168408C.1
cattgggaccctcgaggccggccgggaccgccgccgacttctgattctaccaccacccgcctcctctcgagttcgatctgtttgctcccccagacatgtcgggccgcggcaagggaggcaagggcctgggtaagggcggcgcgaaacgacaccgcaaggtgctccgcgacaacatccagggcatcacgaagccggccatccggaggctggcgcgcaggggcggcgtgaagcgcatctccgggctcatctacgaggagacccgcggcgtgctcaagatctttctcgagaacgtcatccgcgacgccgtcacctacacggagcacgcacggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaatcgtgtgagaaaaaaaaaaaaaaaaaagcggcc

SEQ ID NO: 1501 - DNA, 691 bp, Zea mays
  Clone ID: PAT_MRT4577_168409C.1
gcccacgcgtccgcccacgcgtccgcacaaatccagtaactcgcatcttcctgcgtcatccaagttctagcagcgcagcgctcggtttcgacaatgtcggggcgcggcaagggcggcaagggtctgggcaagggcggcgccaagcgccaccgcaaggtcctgcgcgacaacatccagggcatcaccaagccggcgatccggaggctggctaggaggggcggcgtcaagcgcatctccgggctcatctacgaggagacccgcggtgtgctcaagatctttctggagaacgtcattcgtgacgccgtcacctacactgagcacgcccgccgcaagaccgtcaccgccatggatgtcgtctacgcgctcaagcgacagggccgcaccctctacggcttcggcggctaggtcgcttcctcatctggtggcgaactgcatgtgtgtcggtggtggtcgtgttgtgtgtctaatctagtgtagtccgttctctctgttgtcgctgtgttgtgtggtgtcttgtagttcatttcctgcaataccaacttgccattatcaatggaaaaccctcgttttcatcctcaacgtgtcaagttctgattttgttttgttctggtttagggttcgtatgagatctacatagggcttctgttgctttggtatttgattgcaaattttattttgcccggagagctgc

SEQ ID NO: 1502 - DNA, 786 bp, Zea mays
  Clone ID: PAT_MRT4577_168430C.1
ctcgagccggccgggatacttacctggacggggtcgacgtgggatcaagaagccccgtggcctagatcagtggcctgcattgcacttggctggtgcgctggtctaccatctccccaagtgggagagtggacgtcataatttgtggcagagggggtacgcgttcgcgcggcccctgctcaacagcaacccgcacaagccctcttcctcgattttcctcctccgtccgcgtagttctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggaaacccgcggcgtgctcaagatcttcctcgagaacgtcatccgcgacgccgtcacctacaccgagcacgcccgccgcaagactgtcaccgccatggatgtcgtctacgcgctcaagcgccagggccggacgctctacggcttcgggcggctaggccgcctccccttctgatgctttgatatgacggccgtggtcggttgtgtgtctagttggccggtctactgtagtttgttctgtatcttcgtttcgaaggtgttccagtttctagcccatttggtgtaatattttcacagctattatcaatggaaagccctcggttctatcctcattgttctggatcaagataatccgtttgataaaaaaaaaaaaaaaaaagcggcc

SEQ ID NO: 1503 - DNA, 875 bp, Zea mays
  Clone ID: PAT_MRT4577_168431C.1
ccccgcgtccgcccacgcgtccgcccacgcgtccgcccacgcgtccgggctcaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcgctcaagcgccagggccgcaccctctacggcttcggcggctaggctatgccggtcgcgctcgcgcctcgctgtcgtcgctgcggttcttgtttctgcaattcgcaaggtgtggcttgacggggaaaatgctggttaatgtagcactagatcaagcatgttgtgcgtgtctgaagaaatgccaattgtgacttgctgtttgttcaaacatgttccgtttcttcacatatcaacacccgtcgtccctgcgtgtgttacaaatgtagttaacttagtcatgatgtgtcttgcgcgcattccatctctgtccaatatgcttaatgtatttctgtactaggtaatccattacctctgtttcattttatttcaatgacgaactagcttattggatttcgtatgtccaaagtaaaatttcgcttacagggcctcattggagcacgtgaacggtatcccccccaccactgtttgtacactttcttgtggaattaaactgtttctgtg

SEQ ID NO: 1504 - DNA, 720 bp, Zea mays
  UNSURE (1)..(720): unsure at all n locations
  Clone ID: PAT_MRT4577_168432C.1
  unsure (1)..(720): unsure at all n locations
ttgggtccctcgaggccggccggggtcagtcaccccacacaaatccagtaactcgcatcttcctgcgtcatccaagttctagcagcgcagcgctcggtttcggcaatgtcggggcgcggcaagggcggcaagggtctgggcaagggcggcgccaagcgccaccgcaaggtcctgcgcgacaacatccagggcatcaccaagccggcgatccggaggttggctaggaggggcggcgtcaagcgcatctccgggctcatctacgaggagacccgcggtgtgctcaagatctttctggagaacgtcattcgtgacgccgtcacctacaccgagcacgcccgccgcaagaccgtcaccgccatggatgtcgtctacgcgctcaaacgacagggccgcaccctctacggcttcggcggctaggtcgcttcctcatctggtggcgaactgcatgtgttgtcgccggtggttgtgttgtgtgcctaatttagtctagtccgttctctctatcgtcgctgtgttctgtggtgtcttgtagtccatttcctgcaataccaacttgccattatcaatgaaaaaccctcgttttcatcctcaacgtgtctagttctgattttgttttggtctggtttagggttcgactgagatgtacctagggctgctngctgtttttggtgtttgattgcaatttttattttgccgaaaaaaaaaaaaaaaaaagcggcc

SEQ ID NO: 1505 - DNA, 649 bp, Zea mays
  UNSURE (1)..(649): unsure at all n locations
  Clone ID: PAT_MRT4577_168433C.1
  unsure (1)..(649): unsure at all n locations
gactagttctagatcgcacaaatcctcttnctcgagttctcctcaaccaaattcaaggtcacagcggcgaacctctcggcgatcatgtctggccgcggcaagggcgggaagggtctgggcaagggcggcgccaagcgccaccgcaaggtgctgcgcgacaacatccagggcatcaccaagccggcgattcgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtcaccgccatggacgtcgtctacgcgctcaagcgccagggccgcaccctctacggtttcggcggctaggtcggcccctctctccgtggtgaattacgtggttgcggtggacggtggtggtcgtgttgtgtgcttggtctagtatgtgctgtctttatcggtgctgctttctgtggtagttgtgctgcatcgttccagtttctagtccatgtgctgtaatatctcgctgctgtaatcaatggaatggcttcgtttccagcctcatgatatatcgcccttttgtatcctgctgaggaacctgcaagaagtctgtgcactacgc

SEQ ID NO: 1506 - DNA, 732 bp, Zea mays
  Clone ID: PAT_MRT4577_168436C.1
cattgggtacctcgaggccggccgggatccaattcacaggctcaccacaccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacactgagcacgctcgccgtaagaccgtcaccgccatggacgtcgtctacgcgcttaagcgccagggccgtaccctctacggcttcggcggctaggcctgccgccccgcgcctcgccgtcgctgcggttctggtgttgctgcagttcgcaagttgtttgtgtgggggaaatttgctagatactgtagaactgcagtgcggtatgctgcacatggtgtgtttgtctgaagaaatgttgtcattgctggcttgctctggactcaaacatgctccattttgtgttcactgtgctttcgtttggacaaagcgatccatttcactcttttttgctgaattcagttcagttaaaaactagtcatgatatgcactacgcacattgcatcaaaaaaaaaaaaaaaaaaactcgagggggggggccg

SEQ ID NO: 1507 - DNA, 501 bp, Zea mays
  Clone ID: PAT_MRT4577_168438C.1
aagagatcgtcagccatgtctggccgcggcaagggaggcaaggggctcggcaagggcggcgccaagcgccaccggaaggtgctgcgcgacaacatccagggcatcaccaagccggccatccgccgtctggctcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctaggccgagggcccagccagctcgcgacgccgccgtccggcagagtagtggtatctatctagttgctgtctagggttcgtggttctccttgtatgtcgctggtgtttgtctgctcccgtcttgtgagctgatgttgtactggaagaaatttggaatggaaattgcagtagcttaccc

SEQ ID NO: 1508 - DNA, 890 bp, Zea mays
  Clone ID: PAT_MRT4577_168439C.1
cgattcattaatgcagctggcacgacaggtttcccgactggaaagcgggcagtgagcgcaacgcaattaatgtgagttagctcactcattaggcaccccaggctttacactttatgcttccggctcgtatgttgtgtggcaaaaacccagtaactcgcatcttcctccgtgatccaagttctagcagcgcagcgctcggtttcggcaatgtcggggcgcggcaagggcggcaagggtctgggcaagggcggcgccaagcgccaccgcaaggtcctgcgcgacaacatccagggcatcaccaagccggcgatccggaggctggctaggaggggcggcgtcaagcgcatctccgggctcatctacgaggagacccgcggtgtgctcaagatctttctggagaacgtcatccgtgacgccgtcacctacaccgagcacgcccgccgcaagaccgtcaccgccatggatgtcgtctacgcgctcaagcgacagggccgcaccctctacggcttcggcggctaggtcgcttcctcatctggtggcgaactgcatctgtgtcggcggtggtcgtgttgtgtgcctaatctagtgtagtccgttctctatatcgtcgctgtgttctgtggtgtcttgtatcccatttcctgcaataccaacttgccattatcaatggaaaaccctcgttttcatcctcgacgtgtctagttctgattttgttttgttctcgtttattgttcgtatgagatgtacatagggctgctgttgctttggtgtttgattgcaatttttattttgcccagagagctgcagttctctgtgttatggaaaaaagttctgtgattggttggaaaaaaaaaaaaaaaaaaaaaaaaaaaaaaaaaaaaaaaaaaaaa

SEQ ID NO: 1509 - DNA, 828 bp, Zea mays
  Clone ID: PAT_MRT4577_168441C.1
cctcgagggcctggcccgggaaaaaaaaaaaaaaaaaaaaaaaaaaaaaaaaaaaaaaaaatccaattcacaggctcaccacaccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcccttaagcgccagggccgcaccctctatggcttcggcggctaggcctgccgcggccgcgcctcgcctcgccgtcgctgcggttctggtgttgctgcagttcgcaagttgtttgtgtgggcggaaaaaatgctagatactgtagaactgcagtgcggtatgctgcacatgctgtgtttgtctgaagaaatgttgtcaatgctggcttgctctggactcaaacatgctccattctgtgttcactgtgctttcgtttggacaaagcgagccatttcagtcgttttcgctgaatttcagttcagctaaaaactagccatgatatgcactacgcacattgcatctctggacagtatgctcattgcatacctactggatatatgtcattaccttatcctccatgtaaaaaaaaaaaaaaaaaaaaaaagcggac

SEQ ID NO: 1510 - DNA, 822 bp, Zea mays
  Clone ID: PAT_MRT4577_168442C.1
ggaacattcgtactaaatatagtaaagaaatcaaaataatctttagatcaatctaagatttcgattcccagtaaaaaaaaaagaaatataatagaaaaatatgggacaaaaaataaatccactcggtttcagacttggtacaacccaaaatcaccattccttttggttcgcacaaccaaaaaattattctgaaggtctacaggaaccgccgccgacttctgattctaccaccacccgcctcctctcgagttcgatctgtttgctcccccagacatgtcgggccgcggcaagggaggcaagggcctgggtaagggcggcgcgaaacgacaccgcaaggtgctccgcgacaacatccagggcatcacgaagccggccatccggaggctggcgcgcaggggcggcgtgaagcgcatctccgggctcatctacgaggagacccgcggcgtgctcaagatctttctcgagaacgtcatccgcgacgccgtcacctacacggagcacgcacggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaatcgtgtgggaatggatctctgttcgattgttcaattggcctaaaaaaaaaaaaaaaaaaggcccctagggcc

SEQ ID NO: 1511 - DNA, 595 bp, Zea mays
  Clone ID: PAT_MRT4577_168443C.1
atcgattcatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgtcgcaagactgtgaccgccatggacgttgtctacgctctcaagcgccagggccgcaccctctacggtttcggcggctgagaggcgctaccgccgctggtggccgtggcaaaagtcttgggtcgcggtcaagaaatcgagagtattctggatgacgtgcttagtttcgtagtattattatcactagtgcttattgttagcggttgttgggttcgaccactctaagccactgtcaaacagtaatatgagtaccgcatttccgtgtttcgaacttctaatatatcataatcttatgg

SEQ ID NO: 1512 - DNA, 685 bp, Zea mays
  Clone ID: PAT_MRT4577_168464C.1
actcctaagggcgattggtatcctcgaggccggccgggatcttctcccccagctccccagcaccagtccccaattatttggcctccgtcagagaggggagaaagacccgttcgaggcggcggcgatgtcggggcgcggcaagggcggcaagggtctgggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggacgtcgtctacgcgctcaagcgccagggccgcaccctctacggattcggaggctaggcgcctcttcgtagctggggaatgcttagggggatacacgtctctgtcgctgtgggccatagtgttgctgcgttcctggatgtaatccatttatttttctgcaatgaagagatgctggcaagcatgctacctgcatatgtcagaaatggtagtaacagtgaatctttgttcacgaaccaacatgttttcgtgcttttggttgttcctatttcggtttactgcccagtgcgtcagtttacaggcggtgac

SEQ ID NO: 1513 - DNA, 610 bp, Zea mays
  Clone ID: PAT_MRT4577_168467C.1
cagcgaaaacgactgaaatggttcgttttgtccaaacgaaagcacagtgaacacagaatggagcatgtttgagtccagagcaagccagcattgacaacatttcttcagacaaacacagcatgtgcagcataccgcactgcagttctacagtatctagcatttttccgcccacacaaacaacttgcgaactgcagcaacaccagaaccgcagcgacggcgaagcgcggcgcggcaggcctagccgccgaagccgtagagggtgcggccctggcgcttaagcgcgtagacgacgtccatggcggtgacggtcttacggcgcgcgtgctcggtgtaggtgacggcgtcgcggatgacgttctccaggaagatcttgagcacgccgcgggtctcctcgtagatgagccccgagatgcgcttcacgccgccccgccgcgccagcctccggatcgccggcttcgtgatcccctggatgttgtcgcgcagcaccttccggtgacgcttcgcgccgcccttgcccaggcccttgccgcccttgccgcgccccgacatcttcgccgcggagacgagaggattggggaatttttgcttgttggttggtgtggtgagccct

SEQ ID NO: 1514 - DNA, 657 bp, Zea mays
  Clone ID: PAT_MRT4577_168470C.1
gatcggcccaccggccaggcactcgggcgagcgcacaaaagctcttcctcgagtcctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtcaccgccatggacgttgtctacgcgcccaagcgccagggccgcaccctctacggtttcggcggctaggtcggcccatctcccggtggcgaattacgtggtggcggtggacggtggtggtcgtgttgtgtgtttggtctagtgtagtctgtgttgtctttatcggtgctgttttctgtggtggttgtactgcatcgttctagtttctagtccatgtgctgtaatatctcgctgctgtaatcaatggaatgtcctcgtttcaagcctcatgacatatcgctcttttgtaaacctgaaagaattccgtgcactacgc

SEQ ID NO: 1515 - DNA, 745 bp, Zea mays
  Clone ID: PAT_MRT4577_168471C.1
ttgggaccctcgaggccggccgggactcgtctcatctcttccatacgaccataccctacctccaaattcccaattgtcaacctctcctcagagttcgagtgaccatgtcggggcgcggaaagggcgggaaggggctgggcaagggcggcgcgaagcgtcaccgcaaggtcctccgcgacaacatccagggcattacgaagccggcgatccggaggctggcgagaaggggcggcgtgaagcgcatctcggggctcatctacgaggagacccgcggcgtgctcaagatcttcctcgagaatgtcattcgcgacgctgtcacctacacggagcacgcccgccgtaagaccgtcaccgccatggacgtcgtctacgcgctcaagcggcagggccgcaccctctacggatttggcggctgaggggtcaggggtgtcccccagcttctgctggtcgtggcagaagtcttgggtcgcggtcacgaaatggagtgaggcgagagtattcttgcccatgtgcttagtttcgtaggcttatcactctagactctagtgccttggtccagtagtagcatacgacttgtactgcatttacttgttctgaacctctaaatatgatgaaatgtggattcacttgatctcacagacaaccagttaattcggatcaaattttgtactggctttctcgatcatcccagttcgtgttgctcctgatatttgccagtttttcatctaaaagaacatttgccgaa

SEQ ID NO: 1516 - DNA, 699 bp, Zea mays
  Clone ID: PAT_MRT4577_168474C.1
aaaaaaaaaaaaaaaaaaaaaaaaaaaaaaaatccaatccatcagtacccaatctcccctacaccagaaaaatcaccagttcttcggtccgcgtcagagaggccgcggcgatgtctgggcgcggcaagggcggcaagggtctgggaaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggaggctaggctagacgcctcttcatagtcggggactggttaggggacatgtctctgtgtgatgctttctgtggtagtattgctgcaatagctgtgtaatccatcgcttctgcaatgaagcgctttgagacatgctacgtatgttgtgtctgtgggtgattgtatttctggtagtaaccgtgattcttcctgaattttggataatacaagctcattcgcagtagtttctgatgtaatcatgtcttatcgtttgagagatgaaaaaaaaaaaaaaaaaaggccccta

SEQ ID NO: 1517 - DNA, 1094 bp, Zea mays
  Clone ID: PAT_MRT4577_168475C.1
agactgatgatcagggcaataggcgggtaccagcatagacgctgcgactaagcagcatccgtggtggtagggttagcagcagcatcaatggtaatgctgagcggcttccctcggcccatggtgaacccttttgtgccatccggcatgcgggggcccgggggcggcttcggcacagctggatgctccgacgggggagtgccaataggatggtggccatctcggctgttgtggccataatgctgaccacggcctctgcctctacctccacggcctctccctctcccctgctgcctcattccacccttgtcatgggtgccatcttcggcctggtgatcgaaatgtgtttctgagatttgggcggtaacatctgttccaaagtctcgtggatgatcagttgtgtcagggccatcttcatctgcagcatactcctcatccccaccttttcttccttgacctaacccatgtttcagacatccaagcggacgcgtgggcggacgcgtgggcggacgcgtgggcggacgcgtgggcgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgccagggccgcacgctctacggcttcggcggctaggccgcctccccttctgatgctttgatgtgacggccgtggtcggttgtgtgtctagttggccggtctactgtagtttgttctgtatcttcgtttcgaggtgttccagtttctagcccatttggtgtaatattttcactgctattatcaatggaaagccctcggttctatccccaaaaaaaaaaaaaaaaaaaaaaaaaaaaaaaaaaaggaaaaaaaaaaaaaaaaaagcggcc

SEQ ID NO: 1518 - DNA, 1022 bp, Zea mays
  Clone ID: PAT_MRT4577_168476C.1
taattctcttgattagtttgctcggctgaagaaatcaggacgcgtgcctggtgtcgctgctcagctgcatgtacttgtacaaccgttcctccctgcagctgctgccccttctctctttttgtttaccttggattgatggattgttaaaaaaaaaaaaaaaaaaaaaaaaaatccaatccatcagtacccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggaggctaggctaggcgcctcttcgtagtcggggactggttaggggacatgtctctgtgtgatgctttctgaggtagtattgctgcaatagctgtgtaatccatcgcttctgcaatgaagcgctttgaagcatgctacgtatgttgtgtctgtgggtgattgtatttctggtagtaacagtgattcttcctgaattttggataatacaagctcattcgcagtagtttctgatgtaatcatgtcttatcgtttgagagatgaattgcttttggcagcctttgctggtattctcatgctttttttatgcattaggatattagaggtctgttgagttcgcaattatttagttttttctatcttttatttaaatttggtcgacttagcttacgtaaaatttgagcagcagacaggccctagatgcatcaattgcgtgaataatgatctttcttccaaaaaaaaaaaaaaaaaa

SEQ ID NO: 1519 - DNA, 1037 bp, Zea mays
  Clone ID: PAT_MRT4577_168477C.1
cacggattcgcttgtccacctgacgaaccgcggcaaaagcgccaaaacccatcccaccatccaaacccgatttgacgtctccaacgcactcatcccccgaaattcctcgcctcgcgcccaaagcacgactcaaaaatttccccatctccccccgcgcactctcccaaatcctcccctttaaacccacctcaaatcctctcctacgccgcaccgaattcgagacctccaattccctcgtagcagcagcaccagtagagtctccttcctctccggcggcgatgtctgggcgcggcaagggcggcaaggggctgggcaagggcggcgccaagcggcaccgcaaggtgctccgcgacaacatccaagggatcacgaagccggcgatccggaggcttgcgaggaggggcggcgtgaagcgcatctccgggctcatctacgaggagacccgcggcgtgctcaagatcttcctcgagaacgtcatccgcgacgccgtcacctacactgagcacgcccgtcgaaaaaccgtcaccgccatggacgtcgtctacgccctcaagcgccagggccgcaccctgtacgggttcggcggctaagcgcgccctgtccatctgggggtgggcctggtactggtggcgcttctccgggctcatctacgaggagacccgcggcgtgctcaagatcttcctcgagaacgtcatccgcgacgccgtcacctacactgagcacgcccgtcgaaaaaccgtcaccgccatggacgtcgtctacgccctcaagcgccagggccgcaccctgtacgggttcggcggctaagcgcgccctgtccatctgggggtgggcctggtactggtggcgcttctcctttgggttccctgttctgtgctttccattctgtgggaaggtaccggattcctagatctatgtttcgatccggtgtttggtggtccatgtgatgtcgtgtagtagtacaaagagttccaactcctagttgtatcttagttgtttcctttgcagaaatgaaatgataactacgattgcctagc

SEQ ID NO: 1520 - DNA, 740 bp, Zea mays
  Clone ID: PAT_MRT4577_168479C.1
cattgggaccctcgaggccggccgggaaccatcttctcccccagctccccagcaccagtccccaattatttggcctccgtcagagaggggagaaagacccgttcgaggcggcggcgatgtcggggcgcggcaagggcggcaagggtctaggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatacgcgacgccgtcacctacaccgagcacgcgcgccgcaagaccgtcaccgccatggatgtcgtctacgcgctcaagcgccagggccgcaccctctacggcttcggaggctaggcgcctcttcgtagctggggaatgcttagggtgatacgtctctgtcgctgtgggtcgtagtgttgctgcgttcctggatgtaatccattttttttttctgcaatgaagagatgctggcaagcatactacctgcatatgttgcgcctgggtgattgttctccttagaaatggtagtaacagtgaatcttgttcacgaaccaacatgtttttgtgcttttggttgttcttttttcagtttactgcccagtgcgtcagtttaaaggcggtgataatttgacacccaattcgcaaaaaaaaaaaaaaaaagcggcc

SEQ ID NO: 1521 - DNA, 728 bp, Zea mays
  Clone ID: PAT_MRT4577_168497C.1
gcccccttccttagcctgggatttcggttcaacaggctgaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttgcaattcgcaagttgtggctgggtggcgaaaatgctggttactgtaccactagatcaagcatgttgtgcgtgtctgaagaaatgccaattgtgacttgctgtttgttcaaacatgctccacatttcaacacccgtcgtccctgcgatgtagttaatttagccatgatatgtcctgcgcgcatcccatctctgtccaatatgtttaatgcatttctatactgggtaatccattacctctgtttcattttatttcgatgaggaactagtttattgg

SEQ ID NO: 1522 - DNA, 745 bp, Zea mays
  Clone ID: PAT_MRT4577_168498C.1
aaaaaaaaaaaaaaatccaatccatcagtacccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggagggtaggctaggcgcctcttcatagtcggggactggttaggggacatgtctctttgtgatgctttctgtggtagtattgctgcaatagctgtgtaatccatcccttctgcaatgaagctatgttgtgtctgtgggtgattgtatttctggtagtaacagtgattcttcctgaattttggataatacaagctcattcgcagtagtttctgttgtaatcctgtcttatcgtttgagagatgaaatgctttgggcagcctttgctgtaatctcatgtttttttaatccattagggtattagaggtctgttcagttcgcaattatttagttattttctatcctttatgc

SEQ ID NO: 1523 - DNA, 864 bp, Zea mays
  Clone ID: PAT_MRT4577_168501C.1
cattgggtacctcgaggccggccgggactaactgtcatgtagtgtagtggtatgcctctcttaccggagactgtagatgccaagttcgaatcccttgcttttaaaaaaaaaaaaattaaaacaagcgccactaatctcgccttccgaggaaactcaccagcccaccacagacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgcaccctctacggcttcggcggctaggctgatgggctcctcgcgatgttctccccttctgcagatgcgacgttttctggccgtgcccacaagtcttgcggtcaagaaagtttcaggaactcttgttagttcatctctggctgtggtaggtttatctgaatcgtgagactagtaggtttatctgaatcgcgaggctagcaggtttacctgaatcatgaagcagtgatgaaattatgtgagcatcggatgttggaaatcgagcttgtaatgcaatttgttactcttgatgcaaatgaatggtctggtcgttacttctgtagttacgattttaaactggtgattgttgcgtttctcatgcaactgaatcgtgtcagcaaaagttgctttgcac

SEQ ID NO: 1524 - DNA, 981 bp, Zea mays
  UNSURE (1)..(981): unsure at all n locations
  Clone ID: PAT_MRT4577_168502C.1
  unsure (1)..(981): unsure at all n locations
cattgggtacctcgaggccgggccgggatcgcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtgttgtgttcttggtctagttagtctgtgttgtctttatcggtgctgttttctgtggtggttgtactgcatcgttctagtttctagtccatgtgctgtaatatctcgctgctgtaatcaatggaatgtcctcgtttcaagccccaaaaaaaaaaaaaaaaaaaaaaaaatccactcgccctcccacacagaaaaccctagccgccgccaccgaagcggcctcccaggtaagcaggagcgtccaccccgccgccgtcatgaagcgcaatccccgcgtcacgagctcccgccggaagtgccgcaaggcgcactttacggccccgtcctccgtccgccgcgttctcatgtccgccgggctgtcgacggagctccgccacaagtacaacgtgcgctccatcccgatccgcaaggaccacnaggtgcaggtcgtgcgcggcacctacaaaggccgcgaggggaagggggggcaggtctaccgccgccgctgggtcatccacctcgagcggntcacccccnataaggtgaacg

SEQ ID NO: 1525 - DNA, 2110 bp, Zea mays
  UNSURE (1)..(2110): unsure at all n locations
  Clone ID: PAT_MRT4577_168504C.1
  unsure (1)..(2110): unsure at all n locations
actcctggtaccctcgaggccggccgggccgggacgttatcgcgcacatctcctgatcctcgttcctctccgccccgcttgcgccgcgcctccgcccccgtctcctgtgagatcagctccggcggcacgcggatatgactacttcaaggcgtcttgctgacaggaagagtgcaaagttccagaagaacatcacaaagaggggttctgtgcctgagaccacggtgaaaaagagcaatgactaccctgttggacctatagttcttggattcttcatttttgtggtcattggatcatccttgttccagataatcaggacagcgacaagcggtgggctggcctgaattcactgagctaaaaccagaaatttatctgtccgtgagctgggaggcagtatctgtgttgtgtagcaaacttgttcatggatatgtagtgcgaatgtcactactgttctgtttgcagtatcaaaagagtttaaactgatgttgtaaccatgcaaaggctgaaaattttaaagagtatgggagaaaccttaatctaaaaaaaaaaaaaaaaaagaagccaactaaagaatcccgcgatccatcgagtttttgaacgcaagttgcgcccgaagccttctggcggatcgcggccggccgggccgggacgttatcgcgcacatctcctgatcctcgttcctctccgccccgcttgcgccgcgcctccgcccccgtctcctgtgagatcagctccggcggcacgcggatatgactacttcaaggcgtcttgctgacaggaagagtgcaaagttccagaagaacatcacaaagaggggttctgtgcctgagaccacggtgaaaaagagcaatgactaccctgttggacctatagttcttggattcttcatttttgtggtcattggatcatccttgttccagataatcaggacagcgacaagcggtgggctggcctgaattcactgagctaaaaccagaaatttatctgtccgtgagctgggaggcagtatctgtgttgtgtagcaaacttgttcatggatatgtagtgcgaatgtcactactgttctgtttgcagtatcaaaagagtttaaactgatgttgtaaccatgcaaaggctgaaaattttaaagagtatgggagaaaccttaatctaaagaagagtggctctgcaaaaaaaaaaaaaaaaaaggcgcctacggcccnngaaaaaaaaaaaaaaacgcaaaaaaaacaaaaaaaaaaaaaaaaaaaagtacacatcatctcttccaaatcccaccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtaacctacacggagcacgcccgccgcaagaccgtcaccgccatggacgtcgtctacgccctcaagcgccagggtcgcaccctctacggattcggcggctgagaggcgctaccgccgctggtggccgtggcaaaagtcttgggtcgcggtcaagaaatcgagagtattctggatgacgtgcttagtttcgtagtattattatcactagtgcttattgttagcggttgttgggttcgaccactctaagccactgtcaaacagtaatatatgagtaccgcatttccgtgtttcgaacttctaatatatcataatctttaggggagaagatgccacattatacaactcactcatacggcgcccatatatacccccctaaatttcgccccccgcgccccttgttttccccccccccctcctttatttccccccctttccnatttccccccaccccccccttttcccgtcttcccccgttgattcaaaacaacacaactttcaacttgtttccgtttccgctttccctcgttttacacacccccttccctttaatatattttcccccccacacccttcccacatatttataatac

SEQ ID NO: 1526 - DNA, 726 bp, Zea mays
  Clone ID: PAT_MRT4577_168609C.1
cggacgcgtgggagcagctggaagacgcctggaagaagccggcgcctgctccggcctcagcgagaaagatacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttattcgacttcccccctgtaccgtgtggaaataaacctattataagcatcgtgttgaaactcatgatatgcatgagcagctagtgaaaagtttgaatcctagatgaattgaaacacactattatatgattgctaaataaaaaaaaaaaaaaaagggcggcccggacgcgggg

SEQ ID NO: 1527 - DNA, 483 bp, Zea mays
  Clone ID: PAT_MRT4577_168644C.1
gaactagcaacacacaaagcacaatagagcaccaacaatggcaggcaaaacattgtgcctccttatgctcctagggctttctgcaagtagctgctactgcgaccattgtcccgcaaagctcgcaagctcctatagcttacgttgttcccccgtacctctcaccagcggagtctacaggatagtagaaaacccaattcttacaaccctacaggatccaacaggcaatggcaggtgagcatcttacctttatcacccttgctcctacaacaatcatgagccctattacaacagttaccttgggtgcatctattggcacaaaacatcatggcacaacaactacaacaacttgtgctagcaaaccgtgctgactactctcaccaacagcagcttcttccattcaaccaactaggttcattgaactctgcttcttatctgcaacaacaacaactaccatgcagccagctacctgctgcctacccccag

SEQ ID NO: 1528 - DNA, 144 bp, Zea mays
  Clone ID: PAT_MRT4577_168736C.1
acagaacacaagaattacttaatctaacattacccaaactggcattattacaatgttagccgctgatgaccaccatgggaacaggtatctaggttcaagcaggcgcctctgctggctggcaagggggagcacacacaaacacac

SEQ ID NO: 1529 - DNA, 2907 bp, Zea mays
  Clone ID: PAT_MRT4577_168744C.1
aagagtgactcagtgacagtagtgttcgggcccgatcgactgctcctagaagcctcggccgcgcctctatctcatctccttcctcctgttgagcccgccggcctcccacagcttactacaaaaaccctaaccccttcccttatcctctgctccctctccacggttccacgaacgttggcgcgcaagctcgtggtgtgagcggtcactgtctcccatcccatggctccggcgctgagcgggactctgggcgcgtcgtcggtggcggcgctgcggccctgcgcggggaggagggcgccgtccgccgcgagctcggttgcgccgcgcgggagcggggtggtgaggtgctccagagggctcaggtgggacgcccacagaagcagggggaggttgctcagggtgaggtgcgatgcggccgtcgcggagaagcccgccgaggaggaggcggctggggagaagttcgagtaccaggcggaggtgagccgcttaatggacttgatcgtccatagtctgtacagtcataaggaggtatttctccgggagcttgttagcaatgcgagtgatgcgctggataagctgaggttcctcggcgtcactgattcttctttgcttgctgatggcggcgagctagaaataagaattaagcctgaccttgatgctggaacgattactatcactgacactggtgttggtatgactaaagatgagctcaaggactgccttggtaccattgctcagagtggcacctcaaaatttctgaaggccctcaaggaaaacaaagaccttggggcggacaatggtctaattggtcagtttggtgttggattttactcagcttttcttgttgcagagaaggttgtggtgtccaccaagagcccaaaatcagataaacagtatgtgtgggaagctgtggctgacagtagctcttatgtcataaaggaagagactgatcctgagaaaatgcttactcgtggaactcagattaccctgtttctaagacctgatgataagtacgagtttgcggacccttcaaggattcaaggcttagtaaaaaattactctcagtttgtgtctttccccatatacacatggcaggagaaatcaagaactgttgaggttgaagaggatgaagagccgaaagaagttgaagaggcaacgaagggtgagaaaaagaagaagactattacagagaaatattgggattgggaactagccaatgagacaaaacccatatggatgagaaatccaaaggaaattgagaacaccgaatacaatgagttctataagaagacattcaatgagtttttggaccctcttgcccacactcacttcacaactgagggtgaggtggaattcaggagtgttctttatgttccaggcatggcgcctcttagtaatgaggagataatgaaccccaagaccaaaaatatccggctatatgttaaaagagtcttcatctctgatgactttgatggtgaactgttttccaagatacttgagctttgtgaaaggtgtggtggattcaaatgaccttcccctcaatgtttctcgggagattcttcaagaaagtcgaattgtaagaattatgcgcaagcgacttgtcagaaagacctttgatatgattgaagagattgcggaaaaggaagataaggaggactataagaagttttgggagagctttggcaagtttgtcaagcttggttgcatcgaggtacacagggaatcacaagcgccttgctccattgttgcgcttccactcttctaaaaacgagggagatttgataagtcttgatcaatatgtagagagcatgcctgaaagtcaaaaggcaatctactacatcgctacagatagtctccagagtgcaaagactgctcctttcctggaaaagctggtccagaaagatattgaagttctctaccttattgagccgatagatgaggttgccattcagaacttgcagacctacaaagagaagaaatttgtggatatcagcaaagaggatctggaattgggtgatgaagaagaagagactaaagaaaccaaacaggagttcactctcctatgtgattgggttaaacaacagcttggcgacaaggttgcgaaggtccaaatatcaaagcgtttaagttcatctccatgtgttctcgtatctggcaagttcggttggtccgccaatatggaaaggctcatgaaggctcaaacacttggtgacacatcaagtttggaattcatgaggggaagaaggatcttcgaaatcaaccctgaccacccaattatcaaggatttgagcgctgcttgcaaaaatgagcccgaaagcacagaagccaggagggctgttgagctcctatacgaggctgctttaatctcgagtggatatactccggagagtccagcggagttgggtggcaagatctatgagatgatggcgattgccctcggcgggagatggggaaggtccgacatggaggaggccgaagcgtcgacgggtgaggccagcgcagaggcagactcatctgaaggcaccgtagcagaggtgattgagccctcggaagttagacccgagagcgatccgtggagggaccagtgagttctcccacgggcatcctttgttagaactccatatttagcagtgccggggaaaaaaactaagccatgggcaagaacatatttggtcacagttgcttctatatgggttcttgccgtggcaatttttttgtaggcttagactttgccggccaccagaatcttattgaggaggtagtggccttagaaaagaataataaagcatgaagactgatgattacatagcgaaattgtgctgtccctctcaataatatttataatgaaaagaacttatttctgcaacttaataaaaaaaaatttttgattcaaaagcccccccccacccc

SEQ ID NO: 1530 - DNA, 340 bp, Zea mays
  Clone ID: PAT_MRT4577_168951C.1
agcgcatcccggagcgcgtggtgcacgcgcgtggtgtctccgacaagggcttcttcgagtgcacccacgacgtgacgtcgctgacgtgcgcctacttactgctcgcgcccggcgtgcggacgcccgtgatcgtgcgcttttcgacggtgatccacgagcggaggtcccatggagacatatccgcgacccgcgcgggttcgtcgtgaagatgtacacccgcgagggcaactgtgacctgctgggcaacaactttcccggcttcttgatccgcgacgggatcaagttacgctacgtgatccactcgaacaagcccaacccgtggtcgtagtgcatgagtact

SEQ ID NO: 1531 - DNA, 155 bp, Zea mays
  Clone ID: PAT_MRT4577_169249C.1
aagggaacggagatcaatttttcccaacacaacccgagttactgtcggcaagacccagacctttacatttattttaccccgaaaaaagaaagggaaatcaatcggaccacgcgcaaaggcacattatattggcacatacattgcttacacaacca

SEQ ID NO: 1532 - DNA, 2148 bp, Zea mays
  Clone ID: PAT_MRT4577_169250C.1
cacgcgagagcgaaacggaacaccattgttggaaataaaataaaagaacaccacatcgacatcctctcacctccctcgcactccattggatttgggggagctcgggggggcgcgggccactgatgatccccggaacgagcaccgatccgtggcgaggaaactccaccgggtagccggcccgggagcgcggggcacggcgatggcgggcgccggggcagcggccaatggcggcaggaacaagtacgcggttctcgatcggagcgaggagcgacagacggacgctaggacggagcggcggaggaggccgttggcgcccgagagcgagagggggagaagggagcggttcgtgtacgcctgcgcggtcttcgcctccctcaacgccgtcctgctcggctacgatgttggcgtaatgagtggcgcgatcatctacatgcagaaagacctccacataaccgagtttcagcaagaaatcctagtaggctgtctgagcgtggtctcactcttgggaagcctatcaggggggcgaacatctgacgcaattggcagaaaatggacaatgggcctcggtgcaattgtgttccagataggcgcgaccatcatgacgtttgctccatcattcactgtgcttatgatagggaggctccttgctggggttggcattggctttggtgccatggtatctggagtgtacattgctgagatctcccccgcaggtgcccgagggacgctcacatcccttcctgagatctgcatcaattttggggatccttcttggctatgtttccaattatgccttctcaggcctttctgagcacatcaattggaggattatgcctggtgtcggtatcctcccatcagtcttcattggctttgcgcttttcgtgatcccggagtcccctaggtggttgatgatggagaagagagtttcagaagcaagggcagtgctgctgcagattagcgagtctgaagctgaagctgaagaacggctggctgagatcgaggaagccgcaggtctgatgaaatcaatgaaatctgaggacaaagaagtgtggagggaacttttgaacccgtctcccgccgtccgtcggatgctgtacgctggttgcggtattcagttgttccaacagatcacaggaattgatgctactgtctattacagcccaacaattttcaaagatgctggcatcaagtctgatcaggagcttctcgctgcaactgttgctgtgggtttcactaagacagtgttcatcttggttgcaattttcctaattgatagagttggacggaagccacttctttatgtgagcaccattggcatgaccatctgcttatttctcttgggggttgcacttacactgcaaaaccatgcggtggggcttatgtctccacgtgttggtatcgacctagcaattttcgcagtttgtggcaacgtggcattcttttcaattggcatgggaccaatatgttgggtcttgtcctcagaggtatttcctttaagattacgagctcaagggtcagcgcttggtcaagtaggtggtagagtgagcagtggtttggtttccatgtcattcctttctatggcccgtgctatatcagtggcaggaatgttcttcgtctttgctgcaatatccactatctctgtactgtttgtgtacttttgtgtgccagaaacaaaagggaaaacactggagcagatcgaaatgatgtttgaaagtggggacgaatggggaggaggtgaaattgagcttgaggatacacagcatttaataccgagtatcaagaagtctgtgcctcttggttgatatttgtagcatcaataaaattcttattagctccatgtttcaatgacgagccaaccaaaccagctggattctgaactttggtttcgagtgatctggccacactgagccacgaccgatctgataaaagataagcttgatagacataggtgcaacgtagaagattaattgtgatgttagttcaaaatgtcaatgattttactgggaggcggtctgtaatgtatgatcttacatctcttgtaccttcttacatctctcgtacctcccagcggaagaatatactcgcagaaaagttttctactgtgcatttttttataaccctaaaatgagtattagatgctatttggag

SEQ ID NO: 1533 - DNA, 653 bp, Zea mays
  Clone ID: PAT_MRT4577_169326C.1
ggcgtcttcacttgttctggtcttctcggagcccctgatgaagaggttgagattttggcctcaggcttatcttggcctgacattcaactggggagctttactagggtgggctgctattaaggaaagcatagaccctgcaatcatccttccattgtatacagctggtatttgttggacgctggtgtatgatactatatatgcgcatcaggtgtttcgctatccctactttcatattaatccttgatgaagtggccatttcatgttgtcgcggtggtcttatacttgcatatctccatgcatctcaggacaaagaagatgacctgaaagtaggtgtcaagtccacagcattaagatttggagatttgaccaaatactggatcagtggctttggcgcggcatgcttcggcagcttagcactcagtggttacaatgctgaccttggttggtgtttagtgtgatgcttgagcgaagaatggtattgtttttacttgatattgactccagacctgaaatcatgttggacagggtggccctactatccattcgtagcagctgcagctgcccagttagcgtggcaggtttcgaccgtggatctgtctagccgctcagattgcaacaaggagtttggtgttcaacaagtggattggagcttt

SEQ ID NO: 1534 - DNA, 158 bp, Zea mays
  Clone ID: PAT_MRT4577_16940C.1
cgcgtacgatcgctagactccaaggtcatcactctccgggagacggggaggtcccacggcttctacttcattaccttctcctccgagaactccaaagacgacgcgatctataacatgaacggcaaggacctccccggccgtaacatcaccgttaacca

SEQ ID NO: 1535 - DNA, 403 bp, Zea mays
  UNSURE (1)..(403): unsure at all n locations
  Clone ID: PAT_MRT4577_169506C.1
  unsure (1)..(403): unsure at all n locations
ggggcgggggtgcaggtgctgctacggcgaccattttcccgcattgctcacaagctcctatagcttcccttcttcccccatacctctcaccagtggtgtcttcggtntgtgaaaacccatttattcaaccccacaggatccaacaggcattgggggggggggtcttacctttatcacccttgttcctccaacantcatcagccctattacagcagtttcctttggtgcgtttnttggctcanatcatcggggcgcatcttctgctacaacttgtgctggcttaccttgctgccttctctctgcgtcttcggtttcttccattcgaccagcttgctgcgttggtctgtggttgttgtttgcggcggcggcgtctgctcttcgtcctgttgggtggtggctaccc

SEQ ID NO: 1536 - DNA, 197 bp, Zea mays
  Clone ID: PAT_MRT4577_16960C.1
tagtgaagccgccgccgctgtagtgtccatagccaccgcaggagactgaaatggggggctttatcaagacacacaagaccaatgcgtacttcaagcgtttccaggtgaagttcaagataaggcgcgcttgcataacggtctacagggtcagtataatgctgattaaccaagacgaacacaagtacttatgacccaca

SEQ ID NO: 1537 - DNA, 2358 bp, Zea mays
  Clone ID: PAT_MRT4577_169639C.1
gccggcccggtctgtagctccgagatcatgaagcgcgagtaccaaaacgccggcgggagcgacggctacatgagtctcctccaaggacaagtcgatggcggcagcggcggcgggggcaggggagcaggaggaggaggtggacgagctgctggcggcgctcgggtacaaggtgcgttcgtcggatatggcggacgtcgcgcagaagctagagcagctcgagatggccatggggatgggcggcgcctgccccaccgctgatgacgggttcgtctcgcacctcgccacggacaccgtgcactacaatccctccgacctgtcgtcctgggtcgagagcatgctgtccgagctcaacgcgcccccgccgccgctcccgcccgcgacgccggcaccaaggctcgcgtccacctcgtccaccgtcacaagtggcaccgccgccggtgccggctacttcgacctcccgcccgccgtcgactcgtccagcagtacctacgctctgaagccgatcccctcgccggcggtggcggcgtcggccgacccgtccccggactcggcgcgggagcccaagcggatgcgaactggcggcggcagcacgtcgtcgtcctcttcctcgtcgtcatccatggacggcggccgcactaggagctccgtggtcgaagctgccccgccggcgacgcaggcggccaacgggcccgcggtgccggtggtggtggtggacacgcaggaggccggtatccggctggtgcacgcgctgcttgcgtgcgcggaggccgtgcagcaggagaacttctctgcggcggacgcgctggtgaagcagatccccgtgctggcctcgtcgcagggcggcgccatgcgcaaggtcgccgcctacttcggcgaggcgctcgcccggcgcgtgtatcgcctccgcccggcaccggacggctccctcctcgacgccgccttcgccgacctcctgcacgcgcacttctacgagtcctgcccctacctcaagttcgcccacttcaccgcgaaccaggccatcctcgaggctttcgccgggtgccgccgcgtccacgtcgtcgacttcggcatcaagcaggggatgcagtggccggctctcctccaggccctcgccctccgccccggtggccccccgtcgttccgtctcaccggcgtaggcccgccgcagcccgacgagaccgacgccctgcagcaggtgggctggaagcttgcccagttcgcgcacaccatccgcgtcgacttccagtaccgtggcctcgtcgccgccacgctcgctgacctggagccgttcatgctgcgaccggagggcggcggcgacacggacgacgagcccgaggtgatcgccgtaaactcggtgtgcgagctgcaccggctgctcgcgcagcccggtacactcgacaaggtcctgggcaccgtgcgcgcggtgcggccgaggatcgtgacggtggtggagcaggaggccaaccacaactccggcacattcctcgaccgcttcacggagtcgctgcactactactccaccatgttcgactccctcgagggcgccggctccggctccggctccggccagcccaccgacgcctccccgccggccggcacggaccaggtgatgtccgaggtgtacctcggccggcagatctgcaacatcgtggcgtgcgagggcgccgagcgcacggagcgccacgagacgctggtccagtggcgcggccgcctcggcgggtccgggttcgagcccgtgcacctgggctccaacgcctacaagcaggcaagcacgctgctagccctcttcgccggcggcgacgggtacagggtggaggagaaggacgggtgcctgaccctgggatggcatacgcgcccgctcatcgccacctcggcgtggcgcgtcgccgctccgtgacgtccccaccgccccccgtacctcgccggcacagcacagcacaaaagcacagtggaagctaagacgtcagtgaacgctgctgaactgcagatagcgactgtggggccacaacggtcctcgccggagcgacgagatggacacttggagtccgaccggatcggcctgtgttcgttcctgtttccggtcccccccttctctcttccccgttgttccttcaacccgtcaactatggtagcccgtagccctactgctacgtttaaatgtgtattactattacgtgtaattcctcccagcgctgatatccaataaggacgaaccggatttcgttagctcgaatgagaattttgtatacagtgcgtccgatcctaaaaaaaaaaaaaaaaaagcggccgcttttttttttttttttttaggcacacacaagtattcaaattgacagaaatataatttaagtaacaaag

SEQ ID NO: 1538 - DNA, 2806 bp, Zea mays
  Clone ID: PAT_MRT4577_169640C.1
cgcagctccccacttctcatcgccccctttttttaatttgtggccatctttggggtggtgggcggaggatttctaactggatggtgaagtttgtctggcgaaaaggacggctgcgacgaacccgtccatcgatccaacgctgtgcgcgcgttgggggagggacctgccaggccccacctgcagcgacagactattgatagatgccttcctctctgatcacctgatggctgatgccttcgcggccgtcttcgcctgccgctgctactactagttgccttcctcgcttccccgtctcgccccagccgcttcccccctcccctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatggcggcggcggcgggagcaggggaacaggaggaggaggacgtggatgagctgctggccgcgctcgggtacaaggtgcgttcgtcggatatggcggacgtcgcgcagaagctggagcagctcgagatggccatggggatgggcggcgtgggcggcgccggcgctaccgctgatgacgggttcgtgtcgcacctcgccacggacaccgtgcactacaatccctccgacctgtcgtcctgggtcgagagcatgctgtccgagctcaacgcgcccccagcgccgctcccgcccgcgacgccggccccaaggctcgcgtccacatcgtccaccgtcacaagtggcgccgccgccggtgctggctacttcgatctcccgccccgccgtggactcgtccagcagtacctacgctctgaagccgatcccctccgccggtggcggcgccgtcggccgacccgtccacggactcggcgcgggagcccaagcggatgaggactggcggcggcagcacgtcgtcctcctcttcctcgtcgtcatccatggatggcggtcgcactaaggagctcccgtggtcgaaactgcgccgccggcgacgcaagcatccgcggcggccaacgggcccgcggtgccagtggtggtggtggacacgcaggaggccgggatccggctcgtgcacgcgctgctggcgtgcgcggaggccgtgcagcaggagaacttctctgcggcggaggcgctggtcaagcagatccccatgctggcctcgtcgcagggcggtgccatgcgcaaggtcgccgcctacttcggcgaggcgcttgcccgccgcgtgtatcgcttccgcccgccaccggacagctccctcctcgacgccgccttcgccgacctcttgcacgcgcacttctacgagtcctgcccctacctgaagttcgcccacttcaccgcgaaccaggccatcctcgaggccttcgccggctgccgccgcgtccacgtcgtcgacttcggcatcaagcaggggatgcagtggccggctcttctccaggccctcgccctccgccctggcggccccccgtcgttccggctcaccggcgtcgggccgccgcagcccgacgagaccgacgccttgcagcaggtgggctggaaacttgcccagttcgcgcacaccatccgcgtggacttccagtaccgtggcctcgtcgcggccacgctcgccgacctggagccgttcatgctgcaaccggagggcgatgacacggatgacgagcccgaggtgatcgccgtgaactccgtgttcgagctgcaccggcttcttgcgcagcccggtgccctcgagaaggtcctgggcacggtgcgcgcggtgcggccgaggatcgtgaccgtggtcgagcaggaggccaaccacaactccggcacgttcctcgaccgcttcaccgagtcgctgcactactactccaccatgttcgattctctcgagggcgccggcgccggctccggccagtccaccgacgcctccccggccgcggccggcggcacggaccaggtcatgtcggaggtgtacctcggccggcagatctgcaacgtggtggcgtgcgagggcgcggagcgcacggagcgccacgagacgctgggccagtggcgcagccgcctcggcggctccgggttcgcgcccgtgcacctgggctccaatgcctacaagcaggcgagcacgctgctggcgctcttcgccggcggcgacgggtacagggtggaggagaaggacgggtgcctgaccctggggtggcatacgcgcccgctcatcgccacctcggcgtggcgcgtcgccgccgccgccgctccgtgatcagggaggggtggttggggcttctggacgccgatcaaggcacacgtacgtcccctggcatggcgcaccctccctcgagctcgccggcacgggtgaagctagacgtcattgagcgctgaatcgcagttagcgaccgggccaaggttctcgccggcgtgatgagatggaacactttgactcccgcggccggatcggcctgtgttcgttcttgtttccgatctcccttctctttcccgttgcttcgatcccgtcaagtatggtagaccgtagcctattgttatgtttaaatgtcaattattatgtgtaattcctccaagcgccgatatccaataaggacgaaccggattttcgtttaaaaaaaaaaaaaaaaaaaaaaaaaaaaaaaaaaaaaaaaaaaaaaaaaaagggcggccgccgactagtgagctcgtcgacccgggaattaattccggaccggtacctgaggcg

SEQ ID NO: 1539 - DNA, 410 bp, Zea mays
  UNSURE (1)..(410): unsure at all n locations
  Clone ID: PAT_MRT4577_169652C.1
  unsure (1)..(410): unsure at all n locations
acgcttgagaccaagtagcaacatacaaagcacaatactcgtccaacaatggcagccaaaatatttggcctacttatgctccttggtctttctgcatgcgctgattcagcgaccatcttcccgcaatgctcgcaagctactatagctttcattatttccccgaacctatcaccagccgcgtctaccgtatgtgaaaacccaattcttcaacactacaagatccaacaggcaatcgcagctggcatctcacctttatcacccttgctccttcaacaatcatcagccctattacaacaattaccttttgagcatttattggcacaaaacatcatggcacatcaactacaacaacgtgtgctagcaaacctagctgnctactctgagcatcagcaggttcattcattcaacca

SEQ ID NO: 1540 - DNA, 1113 bp, Zea mays
  Clone ID: PAT_MRT4577_169869C.1
cattgcgccccgcgcgccggccggccggtcgattcccccactccactcgccgcccgcggctgggctgcgctgcgcatcgacgacggacgacgacacaatcacccccaccccccgtccaatcagcagcggacgagggacgaccacggccccccgtctgccgcacgcgcgcccgctctgccagctgctgctactactgctaaacctcgcccaccagtcgcgtgaggaaatagcaacctgctgagctcgctcgttcgctcgctcgcctgccttcttccctgggcaagctagctagctaggatcgaggaggagctctgcccggccatgcagcgtggggatccgctggtggtgggccgcatcatcggcgacgtggtggaccccttcgtgcgccgggttccgctccgcgtcgcctacgccgcgcgcgaggtctccaacggctgcgagctcaggccctccgccatcgccgaccagccgcgcgtcgaggtcggcggacccgacatgcgcaccttctacaccctcgtgatggtagatcctgatgcgccgagccccagcgatcccaacctcagggagtacctgcactggctggtcactgatattccggcgacgactggagtatcttttgggaccgaggtcgtgtgctacgagagcccacggccggtgctggggatccaccgggtcgtgtttctgctcttccagcagctcggccggcagacggtgtacgccccggggtggcggcagaacttcagcacccgcgacttcgccgagctctacaacctcggcttgccggtcgccgccgtctacttcaactgccagagggagtccggaaccggtgggagaagaatgtgatctcgacccggccgggtggaaattaataagatgacgggtaatcgggtatatgtatatatttatatatatatgtatatgtacgtgtatttgatctggtggcctttggttatatttgggtggggtgtatttgatatattatctgtggcagattggcgcattctctggcgcatatttgatagctacatgtatctatttatacagatataaagcgagcaataatatgcatatgagagggttcagccacatcagtcattactctctccttttccc

SEQ ID NO: 1541 - DNA, 286 bp, Zea mays
  Clone ID: PAT_MRT4577_169904C.1
ctggcttctcctccccctcttatcaagtcctcctcgggttagggttccttagggttttgtggaggggcgatggcggcggctgatgtggagtaccgttgcttcgtcggcggacttgcctgggccaccagcaacgagtcgctggagaatgccttcgcctcctacggcgagatcctgaactccaaggagatgaccgaccggtagacggggaggtcccgtggcttcggcttacgtaccttctactacgagaactgcatgctagacgctgtggataacatgaacgggaagg

SEQ ID NO: 1542 - DNA, 389 bp, Zea mays
  Clone ID: PAT_MRT4577_169911C.1
ctaacaacatacaaagcacaatttcgttccaacaatagctgccaaaatatttgggctgcttattctcctagctatttctgcaagtgctgctactgctaccatattccctcaatactcacaagctcctataacttaccttcttcccccgtacctatcaccaactgtgtcttcagtatgtgaaaacccaattcttcaaccctacacgatccaacatgcaatcacagctgacatcttacctttatcacccttgttcctccaacaatcatcagccctattacatcatttaccttttgtgcatttattgtcacaaaacatcatgtcacaacaactacaacaacttgtgctagcaaaccttgcttcctactcttatcaacatcattttcttccat

SEQ ID NO: 1543 - DNA, 203 bp, Zea mays
  Clone ID: PAT_MRT4577_170000C.1
cattgcgaccacagacagtgcgcgctctaagggcttttttttttgagataacaaggaggagaggaggagattgccgtcactatcacctgggtgaaggctaggcaaatcttctacaggcggggcaaccccaccgtcgaggtggacgtgggccttaacgaccgcaggtaccccaggggggccgtacccagcggcgcattcactgg

SEQ ID NO: 1544 - DNA, 1995 bp, Zea mays
  Clone ID: PAT_MRT4577_17005C.1
atgaaacacgtacaattcttcttgattaattgaaacacaaacattttacaagcgttttgtaccgccgacaacttcaataacgtatttgacttgggattactcacacagtactgctactatttgttttctcttaattcactagccatttcggctaaccagatcatcaaagaaaaacaatggaaattaaatcagcgagcgatgatgcaagctacgcgcatcactagaacgacgtagtggtaatcgatcgattaatgcctagttaatttaattaaagactgcacatatatactaggcgccaattaatgatctgttcgtgcgtatgtgttttgaactgcacggaagctaggacgtacggtcgatcaggaggtggtgacgaacggtttgtacactttgaggtcagagacgatcccggcaacggagcctgcggcggaggcgacggtgatgacgaggcaggcgacgctgagcagctgcaggcacacccaccgcgtgctccacctgggcaccttcttctgcacgatgtacatctccacggggaagtagacggtgagcggccagaaccccagcgcgcccaggagcccgaccacgtcgttgaagaagggcagcagcatggacaccaccgtcgtggccaccacgaacgccgtccgccacgtcagccggaacaggctgagcttgtagcaccggccgccggcggtcccgagcgggagcgggacgtcgacctcgcccgtgatgtagcgggacttgggccacctctggcgcgcccacttctcgacgaaggcgaacaggggctggcagtagacctggtaggcgccgacgaggtgcacggcgatggcggcgttggcgacgtcgaggagccagaagggctcgtagaagccgaagcccgtgaggaggttcccgggggcgttgtccccgaacgcggcgtaccccatgcacccgcacagcatgtagaagaacgtggtgacggccacgctgacgacggtggcgcgccgcatgaccttggactcggacggcggcggcgcgcggatggtgtcctggatctcgatgaggatgagggagtaggagtaggcgaaggcgatgtcgccgaacgcctgcaggctgcgccacatcttgtcgaccggggtgaccgcgccgacgctgatccccgtcaggctgccctgcacgcccttgttggacaccacctgcgcgatgcccaggcccaggccgatggtggagtaggtgaaggacatgacggcggcgaggatggagagccacgatatctggtcgaagtccgggatctgcgagaagaaaatctgcacgacgccgaagatgatcatgtagggcgtgctggagatgttgcaggggtccccgtgcccctccacgtggaagcagttcgccctctggatcgccagcatgctaatagaggcggcaatggtgtagcctatggcgactccgacgatgttggcgtactgcaggaagccgcagaaccagaccttgacgccactgagattggcgttaaccgcgtccatgtacgtgtagttgcgcttgccggtgcaggcgtcgccggagcggtagcagtcggcgagtagggccgatgtgtagtaggtgacgaaggagaagagcagcatgacggtggggcctgccacccagccgagctgcgcgatggcccacgcgagcgacagcaccccggaccctatcacggccgtgataatgtgcgcgctcgccgtccacatcgtccctgtgcgcttgaggcgaccgtcgtcgtcaaagcactttgaggcggccgccgcgtgatgaccgaactccacggagctcacctccatggccgccggccgggtagcagtgcttggcggcgggccggcacacacccttctccctcccgcagtagcttggtctgcacagcaccaccagtgacaaatacacagcacacgaacaactgtgaggcttcgctgcagttagagcacgcacacagagagagccggatatatattgtaggagatatttcacacactagttagtgat

SEQ ID NO: 1545 - DNA, 431 bp, Zea mays
  UNSURE (1)..(431): unsure at all n locations
  Clone ID: PAT_MRT4577_170168C.1
  unsure (1)..(431): unsure at all n locations
ggcggaccgaccactccctccacaaccgccttcagcactctacggtcgagggtcctcgagtnnccaagatcagtggctcgagtcgggagacagcaggagggtcccgcggctttcggctttcgtcaaccttctccacgtgaggagggcgatgacggaaccgccatcgagggcantgaacggcaagagagcctggactggccgcaacaaatcaccgtcaaccgagggcccagtctccgcgtgcggcacgtggagggcggcggctggtcgggtaccggtggtgagccgtggagggcggcggctacgtgcggtgtgcgggcgccgtgatggcaggtggcggctacgggcggtgtgcggcggctaccggtggacggcgggagcttaccgtggtggtggcggctgtacttgcggtggcataccgtggcggcgggcta

SEQ ID NO: 1546 - DNA, 413 bp, Zea mays
  Clone ID: PAT_MRT4577_1701C.1
aaaaaaacccccgcttttccattatataaaggctgggccccatttataacagcatggccccccccccccgcctgaaaaatcctaacaattggcccgggggggtttcatttaccccaaacccgggggggggggggtcacctacgagcagactccccccaacagggggccaacaaaataaacagggtagggtcgatggctgaaaaccgacaaacaagcaattttgcttcgagcgaccgcccccccccagttccaaaagaacgagaagaatgaccggttcaggggttaccccttcacgtccccgcccttgagggggaccgggggcaccccgttcaccctggccttggggggcacgtcctccccgtaaagcatgccccccttgttccgggggatcggggctgccccctttttttccg

SEQ ID NO: 1547 - DNA, 2098 bp, Zea mays
  Clone ID: PAT_MRT4577_170411C.1
ctgctccggtcgctgctgaacgccgatctgattggcttccacacttttgattatgccagacacttcttgtcgtgctgcagcaggatgctcgggctcaagtatgagtcgcagaggggctacattgctctggagtactatggccggacagttactatcaagatcttgcctgtgggagtagacttggagcgggtgcggtcaggcctcaacgattcggtagctggggccaaggccgccgagctggtgaaaccgttctgtcagcagaaccgtctgctgttgcttggtgttgatgacatggatatcttcaaaggaattagcttgaagcttttggcgtttgagcagctcctaatgcagcatccggagtggcggggaagggtggtgcttgttcagatcgccaatccagcaagggggcggggaaaggatgtgagggaggtacaggaagagagcgatgcaatggtgaggcgcatcaacgacgcgttcgggcagccaggttaccagccggtgatactgatcgaccagcctctgcagttctatgagaggatggcttactatgtcgtcgcggagtgctgtttggtcactgcagtgagggacgggatgaacctgatcccatacgagtacgtaattgctcgacaagggaatgagaggatagatagtattctaggccttggtccggcttcaaggaagaagagcatgcttgtcgtgtcagagttcatcggctgctcgccctccctgagcggcgctatccgtgtgaacccttggaacatcgattcagtagccgacgcaatggactacgcgctggagatgccggaaggggagaaggtgttgagacatgagaaacaccacagatacgtgagcacgcacgacgtcgggtactgggcgaacagcttcctgcaagatcttgagcggatttgcctcgaccataacaggaggcgttgctggggcatagggtttgggctgaagttcagggttgtggccctcgacccaaacttcaagaagcttgcggtggagcacttggtcttggcctaccggaggacgaagaagcgtgtcattctcttagactacgatgggacgctgatgccgcagacttcgctcggtaagagtcctacctcaaggacgatagacatgttgaacagcctttgccgcgacaggaacaacatggtcttccttgtgagcgcaaagagccggatgactctgaacgaatggttcttaccatgtgagagccttggactagcagctgaacacggctgcttcctcaggctgagaagagacgcagaatgggagacatgcgttccggtgatagactgcagctggaagcagatcgcagagcctgtgatgaagacctataccgagactacggacgggtcgactattgaggacaaggagactgccatcgtgtggtgctacgaggacgccgatccagatttcggatcctgccaggccaaggagctccacgaccatctggagagcgtgcttgcaaacgagccggtctcagtgaaagctggacccaacctcgtcgaggtgaagccacagggcgtaagcaagggcctggtggcgaagcggatcctgtcgacgacgcaggagcggggcgacgccgacgacgacctgccggacttcgtgctgtgcgtgggcgacgaccggtccgacgaggacatgttcgaggtgatcgcggcggcggccgccgcgaggggcgtgtcctccctgcaggcggaggcggaggtgttcgcgtgcactgtggggcgcaagcccagcaaggccaagtactacctggacgaccccgcggacatcgtgcgcctcgtccagggcctcgccagcgtctccgacgacgaccagacgcacgccccaccgccgcccctccctcggtggcgacgacgacggacaccgtgccgaggtgaaccgtgtcggcgtgcgcggggtgcggttagctctaggtggcatgagaccttgtggttgtggtggaagaactagtggaagggaccgtcgctcgcgactgttggcaggtggtgtacaaaatgctctaggaatgttgtggtctgggaatgtccttgttcgtgctgcctaaaaaaaaaaaaaaaaaaaaatccgcagggaaggccgcggtacc

SEQ ID NO: 1548 - DNA, 2276 bp, Zea mays
  Clone ID: PAT_MRT4577_17042C.1
tcgagccggaaaaaaagtgcctccccccgatccgcttcccccttccacccgccgatcgccctccgctcgctccaccgcggcgggcgatcgctcatctccccctaacctcccccgctcgcgattcccgaggcgaggtgccacccaccgcagatttcttccgacggacggttggctcgctcaccccctacttcgctgatcggatcgcgtgctgcccgaggtagaggtgatgataaggcatagttgtttgacttagcctgccttagctatttcttgaagctaagggaaataataattggtgttatggcatttagaaatatggtttgcactccccaagtcattaatcttacatcagactcagagagagggcaagctcaaggaggcaatggtagtgagatatctgagcaaggtgcacaacatgctgtcagagttgtaggaaatgcaatgaacattggtctctctggtgtgcgaagttactatgatatgagcataaatcatcaccatcagtctgttcataacccacccccgaatttaggtgttgattctggttttgtcttcgcatcaaatatgtacaatccctgcatgtcatcaacatcaatgaacagacatgtttctcatgctcagagctttggatcagggaatcaagtgttgcctcaaaaccaagtcccaggaactatggatgagagtagcagaaatgacagtattggtgaaagtgctagagagcatattaaaaggaaaaatgctgcagttgctggaagctatcattttgttaatggatttgcaagctcaagctcatcttctcatgcacctcaaaatcctatgcttgggccttgggacccttcttttgaatcaactgtttcttctaatgttgcaccattcaacccatcagaatatcatggacacaacaacagttggccgtccttagaaggatcttccataacaggaagtaatggattcaactcaatggttgttcatccagactcagtacagcgtgggaactatacatttccacccactcatattagccattcatggatgtcccatgctacaaatggtattgctgatggagttccccagtgggaatatgccaatgcaactgctaatattcaaggcagatttgcccattcaggagccacagaaatcgcaaatgttggttttcatgaatatcagaatggcccttcaactatttgtcggggaccagtaccttatttccaccagcatgcgatgcatggcatgcaagctcttgatcctactcaaatgcaagttccttatcaacaatgccacagtaatggtttcttgcatggtggtattaattaccctggaaaccgtctccaattaggtccacgaaatccagttctcttcaccagttctgaacgtgcttttgggcctccacagcatccgttcctggcaaatccagttaaccaccgcaacataaggattctaccacccgagcatgctacaataatggatttttcgagattgtatgaagtgtcaaatactgtagatgagcatagagatatgcgtctagatatagacagcatgacgtatgaggagcttttagcattagaagagcagattggagatgtcaatactggtctgacaaaaagtcacattgtagataaattgaggactagcctatatgttccaggaatatcgagcatgtctgatcagccatctaaatcttctctagagaatgatgcttgcataatatgccaggaggagtaccaggctagagactgcgttggcacccttgactgcggtcacaggtaccacgcggagtgcgtgaagcagtggctgatggtgaagaacttgtgccccatctgcaagacgacagcattgtctgccaacagaagacaaggacagtgagcgggaatggagaagcctgttggttatttgctttgacaaacgttcagctcaattttgtatataaagaagtggtagacaatggcgctacctgtatttgttgttcactttgttgtgactgggagtactcagcttcctgaaactgtacagccataacatttgttatttttcttcaaatgtagaatgttttaaatcgctcagtaaaccgtacagccataacatttgttatttgtcttcaaatggagaatgttttaaatcaatcagatcgccaccaatccttgtaactactggcttggctgaaactagtcgcacatggatcgtcctgtacattttttaggagttgacgactattagctttgataaaactagtcgcacatggatcctcctgtacaaaaaaaaaaaaaaaaaaaaaaaaa

SEQ ID NO: 1549 - DNA, 2264 bp, Zea mays
  Clone ID: PAT_MRT4577_17046C.1
cattgggtacctcgagaagggccgggccccgatccgcttccccctttggccgccgatcgccctccgctcgctccaccgcggcgggcgatcgctcatctccccctaacctcccccgctcgcgattcccgaggcgaggtgccacccaccgcagatttcttccgacggacggttggctcgctcaccccctacttcgctgatcggatcgcgtgctgcccgaggtggaactttataattttgttgcgtgttttcataatgaaattagggaatgcctatggtggaaaaaatgtagaggtgatgataaggcatagttgtttgacttagcctgccttagctatttcttgaagctaagggaaataataattggtgttatggcatttagaaatatggtttgcactccccaagtcattaatcttacatcagactcagagagagggcaagctcaaggaggcaatggtagtgagatatctgagcaaggtgcacaacatgctgtcagagttgtaggaaatgcaatgaacattggtctctctggtgtgcgaagttactatgatatgagcataaatcatcaccatcagtctgttcataacccacccccgaatttaggtgttgattctggttttgtcttcgcatcaaatatgtacaatccctgcatgtcatcaacatcaatgaacagacatgtttctcatgctcagagctttggatcagggaatcaagtgttgcctcaaaaccaagtcccaggaactatggatgagagtagcagaaatgacagtattggtgaaagtgctagagagcatattaaaaggaaaattgctgcagttgctggaagctatcattttgttaatggatttgcaagctcaagctcatcttctcatgcacctcaaaatcctatgcttgggccttgggacccttcttttgaatcaactgtttcttctaatgttgcaccattcaacccatcagaatatcatggacacaacaacagttggccgtccttagaaggatcttccataacaggaagtaatggattcaactcaatggttgttcatccagactcagtacagcgtgggaactatacatttccacccactcatattagccattcatggatgtcccatgctacaaatggtattgctgatggagttccccagtgggaatatgccaatgcaactgctaatattcaaggcagatttgcccattcaggagccacagaaatcgcaaatgttggttttcatgaatatcagaatggcccttcaactatttgtcggggaccagtaccttatttccaccagcatgcgatgcatggcatgcaagctcttgatcctactcaaatgcaagttccttatcaacaatgccacagtaatggtttcttgcatggtggtattaattaccctggaaaccgtctccaattaggtccacgaaatccagttctcttcaccagttctgaacgtgcttttgggcctccacagcatccgttcctggcaaatccagttaaccaccgcaacataaggattctaccacccgagcagcatgctacaataatggatttttcgagattgtatgaagtgtcaaatactgtagatgagcatagagatatgcgtctagatatagacagcatgacgtatgaggagcttttagcattagaagagcagattggagatgtcaatactggtctgacaaaaagtcacattgtagataaattgaggactagcctatatgttccaggaatatcgagcatgtctgatcagccatctaaatcttctctagagaatgatgcttgcataatatgccaggaggagtaccaggctagagactgcgttggcacccttgactgcggtcacaaggtacacgcggagtgcgtgaagcagtggctgatggtgaagaacttgtgccccatctgcaagacgacagcatttgtctgccaacagaagccaaggaaaatgagcaggaatgaaataagcctgttacttatttgcttcgacaaacgttcagctcaattttgtacataagatgtggtagacaatggtgctacctgtatttgttaactttgttgtgaccgggagtacccagcttcctaaaactgtacagccataacatttattatttttcttcaaatgtagaatattttaaatccgctcagttcgcccctccaatgtgtatgatatggcgaaccagggagacaaagcttccgtaatggcatctttaggcagccttgtatctattaactttgctgaaactaatagaacatggatccctcctgtacatttttttag

SEQ ID NO: 1550 - DNA, 1297 bp, Zea mays
  Clone ID: PAT_MRT4577_170642C.1
cattgggtacctcgaggccggccgggccttcacttctctgcttccgacctcgtagcgaatcggaccggggggctagggttccggtgcgcctctgcaatcggacgcgaggctaggctgggcatggagggaaccgctgcggcccggaagaggtcccggccggagacggcgaacggggctgccgccgccgggaagcgctccaaagacacggagtcatttcaaactggtctatcaagcaaatcgaagccttgcaccaagtttttcagtacgattgggtgcccgtttggcgagggatgtcattttctgcactttgtccctggtggttacccggcagttgcaaaaatgctgaatctaagtagctctgctgtatctgcgccatcaagaactcatgtggatcatgccgctcttaccggtgcctctcatccagcttctacggtcaagacacgcatgtgcaccaagtacaacactacagaaggctgcaagttcggtgataagtgccatttcgctcatagcgaaagagagcttgcgaagccagcctacatgtctcaagaaggacctcctatgggtggtcgatatggacgagctgaacctatgcaaccagctgccatgggccctccagcaggaaactttggtgcctcggcgactgccaagatcagtgtggacgcctctctggccggtggcataatcggcaagggtggggtcaacactaagcagataagtagaattacaggcgtcaagctctccatccgcgaccacgagtctaaccccaacctaaagaacatcgagctggaaggcaattttgaccagatcaagcaagccagcgacttggtgcgtgatctcatcgcaaccatcagcgcaagcatgccagcgaaaaatccatctgctgccgcggcaccagcaggaggaggccgaggcggtggtccagggggcaagagcagcaactacaagacgaagctgtgcgagaacttcttgaagggtgcctgtacttttggtgaccggtgccacttcgcccatggcgagacggagcagcggagaggtgctgcatgagagtcgaggtgctctaggcaatgagatgccatgtgctctctccttttgctactgtgaattttcgccttgcagcgctaggcggttggactgttgtgttgtgttgcgacgtcaatggattaaactctagatttcagctttctttttttaacatataagttcgagaaaacgttaaactgtcgtgcagcttgcattttgttggtcggtaagctagcaggctgctagcccatgacaaacctgtgtgacaaaaaaaaaa

SEQ ID NO: 1551 - DNA, 1857 bp, Zea mays
  Clone ID: PAT_MRT4577_170683C.1
ctcgcaacgggccggggtatgagaaacgtactcgcatttagtctattgcacaaaggaatagctgatctagacatgcaattagttgttggtttagtcagtcagtcaagccagtcaaatcaaacctgaaccccgcttaagcgcaagtgagactgtgagagagaaagagcaaagggaagtcatcgtaggtattttgagaacattccatgcatacttgcctggctcgcatttgcctgcgagatcaccaatcaaacaagccacccgtgctgcctgctaccctgctacgctgcacaatcatcctgcggaatttagtaacggcaagttattccaaagttccgatccccaagttgtttattctccaatagtttgtcggtttgtgtgcttcagattcctcccgctctcgcgcaagtggtacactgtgtttccagctaccattttctccactaactaattttattttcagtgtctctcgtttctttatttgcgcgtcaagtttcagccattccttgctcaaaggaaaagtttgagccattccctgggaaggtaggtgagggtactggacaaatccgaaatgcaaatgggcatatgcatgctacatataaccgtaggcttgctactgccagagactcgggtacatggtatcgggttacagtccaaacaggaaattctaaggccgatggaagataaggatatgggtacagtcacccggtcctgccatgacgcgaaagcttatagaaatcaggtggcataaatactgtgcagggctaaaggttggtgggtcgaatggaccaggccatcaggttatcgagaaagctctcatctcttctatttctaggctagcctaggtctggaccagttaggcacgcaagtatcaatcgattcataagaggaggaggccattgagggagccaagtagaaggcagtcacggcaaacaacgcttgttgtaaagctggtgagcaactttgtcaagcctcaagagctcatggaagatggcagtgctccaagacggtctactccacccacccgcagaagcagatctgctgagttccacaatttttcagaaaggaggagaagggataagatcaacgagaagctgaaagcattacaggagcttcttccaaactgcaacaagaccgacaaagtttcgatgctagacgaagcaatcgactacctaaaatcccttcagctacagcttcagatgctggtcatggggaagggaatgtcaccagtggttcctcttgagctgcagcaatacatgcattacatcacggctgaccctgcccagttgcctccgttgcgcccctccggccagcagcaccgacaatttcagataactcaagccaatcctcagcgacaatctaacgtcgagtcggatttcttgagccagatgcagaacttgcactcttctgagccgcctcagaactttctcaggccaccgaaattgcaactttatacaccggaacagaggggtggcctacccagcacgagccacaacactggatggatttctgggagttcctcgtataacttcatggagtgatgtgctcctaatgacaaaatttgacacggcaggcgtgcagccttgtactgggaagagatcgttcagtttgggacctgcagcatggttcacctgagagaattccatgaatgtgtagtactagttaactagctagctagttgtgttattaaataaaacgttgtgattgtgatgctgctcattttgctatctgaatcttaccgtccaattctcctccatgttcatgcaaaggctgacaggtggcgtctgtatttatctgtgcagcagtatgctactatttgttagattgatctcatctagttcggttaaagggccgaacctt

SEQ ID NO: 1552 - DNA, 291 bp, Zea mays
  Clone ID: PAT_MRT4577_170759C.1
ggcagcaccaagaagcacgattttttgcttaggattaacttataacaaatcctgtcaggagtaacagcatccatcgatccacagtgcatgctggttgatgcatgggtctgctggagccgaggatgaacacagcactaacaactgacacagagcgaccttgcaatcaaaaacacagatgggcaacaacaaacgagacgaacgaaaataaaccctttggactagggtaaacattacagtagcgaacatgatcacttggccgaacgggccacaccgtttagttcattcatattc

SEQ ID NO: 1553 - DNA, 1822 bp, Zea mays
  Clone ID: PAT_MRT4577_170773C.1
gccggccgggccgggaacagctgggtcccactactcctgtccccacttggcattgtaaccaagctgccgcagcccgcagcggccaccaatgcggagcggccgcctgcgtcccttcacctatccgaatggggcttatcgccaccatccaatcgaagctctggaacctcctccactcccagcttccgccgacgctcgcttcagctgctgctttccttcccatccttcaacaggtgcaatttgcatttcccatggagctcactgattaataacgtgtgagctgaacttgcttttctgtggacaatttggaacttcagtactagtttccgataggattcagggagaaatgatctcttttaacaatttattttggagctcccttcagccttctttcaagttttacagaaagtgcctgacaaactgcccatattttgcactgaccatgcattcaactacaaagcccttgggttcatctatgccggtaaagagggcgcatttgaagccacatgccgcagacatcaagaggaacccccatgtacatgagctttacaaattggtttaccgacttccggagaaccttagctggctgttggcaccaccagaaattcctaaaagacctgcctcaaagaagaaaaaacaaaaagacgaaatagtggccggtaacagctttggtgtgatcttggagtgggagggagttgttgtggatgatgatgatccagacttggagccccgggtttggtatgttctatcactagaagaggggaagtctttccctccagatgcattgctgaagaaaatcgagggaatgagaactgaccaggctattgcagaagtcttatgttggtcagaagatccagcagaaatccaaaggttggcaacacacaaggaggttatatatcaaaaacttcaaggtggatactaccagctgcgaccacatgtgcttgatttcttgaacacccttgtgggttttgacattccaatagcaattgcagctcctcgctcaaggaagagccttgaagaagggatcaaaactgttggtctgcaaggctacttcgatgctatagttgcattggaggacttctgcttagggaaacctgatggtgagatgtttgaagtcgcagcggagcaacttggtctggaaccagatgcctgtgttgtgtttggtaactcaaacttgacgacggaatctgcacataacgctgggatgaggtgtgtggcagttgcaggccgacaccctgcctatgagctccaatcagcaaaccatgttgtgagatggcttgatcagctctctattgttgacttgcagaggcttgctaatggtgaagttattggtcgcaggggtagagaatctgacatggatatggaaattgtgattgaggaatgatgatgtttctgcaaaaatgacgcactaatatattgttgtgcttataatctgatacacctaagtaatgcattacattttgtaaacaggccaagcagtgcaagttccggactaaggatactccggagtttgcattaccttcctggtttgcttgtgatgaattggaattcgcctaaaactcttttagtcattagagttggaagtgaagaaactcccacccgtaacttgtgtatgtacagtatatatatgtattacctattcttcgctacatctttgaaggtgtatctgttgggattttcgggaggggctcaatttaaatgcggttaaatggcctttgggttttacggggtcacgagtgaggggagaagggaagggaagggaagggaagggaagggatggaggttgattcaaataataatgtctattaaatttgattatgctaaa

SEQ ID NO: 1554 - DNA, 1178 bp, Zea mays
  Clone ID: PAT_MRT4577_170837C.1
cctcgaggccggccgggacctctcccgttcacctcccactgccgtttacctcacgctctctcgtggtcgttgcttcctggcggcggcgccgccctcttcgtcgggccattcaccggcgacgagcattcatctggaggagagcatcacactcatctaactgatattaggatgagtctatgtacaatagcacgccgactatgtctttcaaaaccatcctctgtgaatcgtctttcagtaatttgggctcatctatacagcaccgaggctgcaaaggacacgggtgctaagaagtacaagtaccctgatgtatacgacccatacgggcctatgtcgctaccgtcagagaaagttgtggatctagctgaccgcatcgctgctctccctcctgaggagatcaaacagattgctccagcccttctattcagactgaaccaagagccgccacaggctatctccggccagggtttcagttttggtgctcagggtggtgcgggggtcggtgccggaaaggctgaggaaaagaaagctgagaagacagtcttcgatgtcaagttggagaaattcgatgctgctgcaaagatcaagattatcaaggagatcaggacctttacggatttggggctgaaggaggcaaaggagctagtggagaaggccccagtcattctgaagcaatcgctcacaaaggacgaagcagaagcaatcatagggaagataaaggcagctggcggtgttgctgtcatggagtgaacgaagggatgaccatctcgacacaacacacttttatttcctatttttgttgccatgatcaagcatttgaattgcacattgcagtgcctttatgctgatggagaaaatagtttacatctacgttggtaaccaaggcgagagggaaactagagatttagttgctatgatgatattcatgacttgttctagaataagcagttctttgggctctacacaacttatttggtggagtgaatggatgttgccatcagggccaataccatgaatcttatgttcttgttgtatctgctatgagttataaacacttcgcagttgcttaggtaccctgatatattctctatgtcagttacattgcagtgtaaaaaaagttctgttgttgtagatctggtatggttggatttagtttccagtaacaaaaactttgattcacg

SEQ ID NO: 1555 - DNA, 1361 bp, Zea mays
  UNSURE (1)..(1361): unsure at all n locations
  Clone ID: PAT_MRT4577_171218C.1
  unsure (1)..(1361): unsure at all n locations
cacgcacctagggttttcgcgccgccgccgcagccgcacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtcagctagcaagtgacgctgtgatgcttttattaagattttgatgagtggtgacgttaagagaacattggcagtactgtgttgtaccccaagattgcttgcagcattgctatgctcagtatcgcaccatttaacttattatatgtgttatgttgcaatgattgaggtctaaaaaaaaaaaaaaaaaagcggccgcgagcggcggcgtcctcctcgtccttcgttgacggcgtcgcggtggcgttcgactccgccgacccngtcagatggtgatggtgtcaggcggcgggggtaacgcgtgggcgaaggagatgaccctccgccgcaggatagccagcatattcaacaagacgcaggaacacttccctactctgaaggactacaacgattatctggaagaagttgaggatatgactttcaacctgatcgaagggatagatgtcgaggagattgaagcaaaaattgcaagataccaacaggaaaatgcggagcagatatacttgtccagagctaaaagggcggaagatcttgcggcagcacttaaagcaagcaggatgaaccctgtaaaggccgaggccaatgatacggctgctgggagttctcagggtattagtggcggggcaggagttcagggccagtatgcacctgccgctgttcttgggggagtggctcagccccgccccacaggtatggcgccccaactaatcggcagtgggtcggatcctctgcaaggagacgacgaggagaccaggagactacgcgcagagcgagcagcacgggctggcggatggactgctgaattgagcaagagaagagcgcttgaggaggcgtttagcgccatattcatctaggattagatcaaaaggcaacacatggcctggaggaaagccggcatacttaaaatggctgtcaaactacaaagcgttggatgatctgtgtcgtgattatctttgggacatggaattctcacaaattgtggtgaagcaccctttgtgtgcctttggttgcaaaagcatgctttttgtccaaaaaaaaaaaaaaaaaaaaaaaaaaaaaaaaaaaaaaaaaaaaaaagaaaaaaaaaaa

SEQ ID NO: 1556 - DNA, 1986 bp, Zea mays
  Clone ID: PAT_MRT4577_171286C.1
ccgggaaaaaaagacttgaacacggccagcgtctcatcggctgggcgtggtctactgcacgcacacttaccaccagccaccgcaagtgaatcgctagtcggaagaccatgtcctcagaggccagcagcgtcgtcgtcgccgacgagaatggagcggcggagacggtcggcgtcggacggtacgtggaaatggagaaggaccaagactcgagcgcagccaagtcgcggctctccggcctgctctggcacggcggctccgcctacgacgcttggttcagctgcgcgtccaaccaggtggctcaggtgctcctgaccctgccctactcgttctcgcaactggggatgctgagcggcatactgttccagctcctgtacgggctgatgggcagctggacggcgtacctcatcagcgttctctacgtggagtaccgggccaggaaggagagggagaaggcggacttcaggaaccatgtcatccagtggttcgaggtgctggacgggctgctcgggaggcactggaggaacgtcggcctggccttcaactgcacgttcctgctcttcggctcggtcatccagctcatcgcctgcgcaagcaacatctactacatcaacgacaagctggacaagcggacgtggacgtacatcttcggcgcctgctgcgccacgacggtgttcatcccgtcgttccacaactaccggatctggtcgttcctgggcctcgtcatgaccacctacacggcgtggtacctcgccgtcgcgtccctcatccatggccaggttgatggcgtgaagcactccgggccgaccaagatggtgctctacttcaccggggccacaaacattctctacactttcggagggcacgctgttaccgtggagatcatgcacgcgatgtggcggccgcagaagttcaaggcgatctacctgatggcgacgctgtacgtgctgacgctgacgctgccgtcggcggccagcgtgtactgggcgttcggcgaccagctgctgacccgctccaacgcgctggcgctgctcccgcgcacggcgttccgcgacgccgccgtcgtgctcatgctcgcccaccagttcatcaccttcggcttcgcctgcacgccgctctacttcgtctgggagaagctcgtcggcctgcacgactgccgcagcctctgcaggcgcgccgccgcgcgcctccccgtcgtcgtccccatctggttcctcgccatcatcttccccttcttcgggcccatcaactccgccgtcggctccctcctcgtcagcttcaccgtctacatcatcccggcgctggcgcacatgatcacgttccggtccgcaacagcccgtgagaacgcgatggagccgccgccgcggctgctggggcgttggacgggcgcgtacatgatcaacgcgttcgtggtggcgtgggtgctggtggtcggcttcggcttcggcggctgggcgagcatgacaaacttcgtccgccagatcgacaccttcggcctcttcaccaagtgctaccagtgcccgccgccaccgcccctgccgttccccggcggcggcctcggcaacatcacgatgccattcaacggcgacgggctccctcctaccccggctccttcgccggcgcattacttcttccgccaccaccggcatcacagccaccaccgcgggctctgatgagagacgatgaaatgaacccggcttaccaccagtagtgcgtgcgtggcacactgctgctttagtttgagctgatcccttagttaagtctagcttaattagcacctgcatgcagcatcttcgttctctcctctagcttgctggtgtcgaacgcatgctttcccggtttcagtgactttagagaccctgcctgagcctgacacgaggggagtatcgctgtatcagtactagcatgcagtctcttgtgttccgggctgtgtcctggcgtggagctcaaagaaggggaatccatttctacaaaaaaaaaaaaaaaaaa

SEQ ID NO: 1557 - DNA, 1163 bp, Zea mays
  Clone ID: PAT_MRT4577_171287C.1
tcgaggccggccgggccggggacttttgttttgttttatatatgggctccccgtctacttgcatccaaaagaactcctggggaaagaaacagagataaggagaaagacgggtttcttttatcgtcgcctgtcggacgtgctctgctgcagagtcttgcttcacccgtccggcacctcactctctggcctgctgtatatatccacctccctccggcctccatttcttctcgacttgaacacggccagcgtctcatcggctgggcgtggtctacactgcacgcacacttaccaccagccaccgcaagtgaatcactagccggaagacaggccaaccccactgctagtgctaggaatctaggagcgagaacgagagaccatgtcctcagaggccagcagcgtcgtcgtcgccgacgagaatggagcggcggagacggtcggcgtcgggcggtacgtggaaatggagaaggaccaagagtcgagcgcagccaagtcgcggctctccggcctgctctggcacggcggctccgcctacgacgcttggttcagctgcgcgtccaaccaggtggctcaggtgctcctgaccctgccctactcgttctcgcaactggggatgctgagcggcatactgttccagctcctgtacgggcttatgggcagctggacggcgtacctcatcagcgttctctacgtggagtaccgggccaggaaggagagggagaaggcggacttcaggaaccatgtcatccagtggttcgaggtgctggacgggctgctcgggaggcactggaggaacgtcggcctggccttcaactgcacgttcctgctcttcggctcggtcatccagctcatcgcctgcgcaagcaacatctactacatcaacgacaagctggacaagcggacgtggacgtacatcttcggagcctgctgcgccacgacggtgttcatcccgtcgttccacaactaccggatctggtcgttcctgggcctcgtcatgaccacctacacggcgtggtacctcgccgtcgcgtccctcatccatggccaggttgatggcgtgaagcactccgggccgaccaagatggtgctctacttcaccggggccacaaacattctctacactttcggagggcacgctgttaccgtggagatcatgcacgcgatgt

SEQ ID NO: 1558 - DNA, 127 bp, Zea mays
  Clone ID: PAT_MRT4577_171300C.1
aaacacacgaataatcatgaattattattgaactgggccccgttctactggatgatcaacaatgatatcccgaatacttcttaattgagaccttccaaggtgatcctatacgccctgggggcttaac

SEQ ID NO: 1559 - DNA, 937 bp, Zea mays
  Clone ID: PAT_MRT4577_171309C.1
gtagagcagagagctagtcgctcgcgcgggcaatccaaacctttccctattcttgcaaggtctcggaaacggaaaggcccctgctccgctgcgcgtttgcgagtttgggaagaatccttgcctgccggagggggggaaacgggcgagatggggcgagggcgcagcgagataaagaggatcgacaaccccacgcagcgccagtccaccttctacaagcgcagggacggcctcttcaagaaggcccgggagctcgccgtcctctgcgacgccgacctcctcctcctcctcttctccgcctccggcaagctctaccagtacctcgcgcccaccgtcccctctgtcaaggagttcgtcgagaggtacgaggcttcgacgcacaccaaagtttggtccgacatccgccaggagaggcgccgcgagctggagaaggtggccaagatgtgcgacctcttggagaaggaactgaggttcatgacggtggacgacggggagcggtacacggtgccgtcgctggcggcgctggagcacaacctggaggcggccgtgcgcaaggtgcgctccgagaaggaccgcaagatcggcggcgagatgagctacctcgagaacatgatcaggggacgccacgaggagcgctacgggttgtgcaacaagctcgcgcatgctcaggcatcgaacaacgagggaggagggagggtcgaccccaccaagcagcggcctggaactcaaactgggtctcaactgacgctggctggctggaaagctcgaggactatgctctgttccttgggtactgtacttctgtaggttttggttgagttgggttgttggtcagcagttgtcccttagatcaaacaagtctcgagtttgatgtgttaatgtactccattattcaggtgggatcaagtacctttgctgctccgattgaagtatattgtttt

SEQ ID NO: 1560 - DNA, 2054 bp, Zea mays
  Clone ID: PAT_MRT4577_171418C.1
ctggccggggcaagtctaatcgagcagctttgtactttgaccgcgctgacattctctatccatttcgttctggacgctgcttgcttccacagctccaccatcatcatcgcgtaatcctgcaggtgcagctaccgcctatcggcatcctatcgccgcttcgcttcgagacggaaggctgtcccgcgaggggtggagccgagaggagttcgccgtccgagaaggtctgtcttcgggatctccctttggcggcgcagttgttttgatgggaactcagtaaccgctcgagaggaaaggagcggatgctcaactgtagcaggaagatgggtagatccgcgagtgttcttcaagtccttctggtttccgcaaccatcgttgttgctcagacccaatgggctagtggtgtatggggcatgtactgcgaggacttgacagcgagtgcagaaaggccgcacagggcctcggtaacagatttcggcgccgtcggagatggtgcgactcttaacacgaaggcgtttcagaatgcgctcttccacctcgactcattcgcgaagaagggcggggcgcagctgttcgtgcctgctgggaggtggttgactgggagttttagcctgatcagccatctcacgctatcgctggacaaggacgcagtgattcttggatcaccagactcctctgactggccagtgattgatgctcttccatcctatgggcgcggtagagaactccccggcaaaagacatcaaagtctaatatttggatccaatcttaccgatgtgataataaccggtgccaatggcaccgtcgatggccagggtgcggtttggtgggactggtttcacaaccacacattgaactatactagaccaccgctcgttgagctgatgtactctaccagagttgttatttccaacctgaccttcataaattcgccgttctggaatatccatcctgtgtactgcagccaggttctggtccagcatctcacaatcctagcacctatcagttcaccaaacaccgacggcatcgatccagactcatctacaaacgtctgcatcgaagactgctacgtcagaaacggcgacgacatagtcgtcatcaagagcgggtgggacgagtacggcatctccttcgcccaccccagctccaacatcagcatccgcaacatcacaggacagacaaggaacagcgccgggctcgcctttggaagcgagatgtcaggcggcatatcggacgtccgagcggagggggtccggatcgtcaactcggtgcacggtatccgcatcaagacggccccggggcgcggagggtacgtgaagaacgtgtatgtagctgacgtcagcttcgacaatgtttccatagccatcaggatcactggaaactatggtgaacaccctgacgatggctacgacaggaacgcgcttcccaccataagcaacataaccatcaaggatgtcgtgggtgtcaaaattggtgttgcaggaatgctgcagggcattccgggggatagcttcagtggcatctgcttgtcaaatgtttctctaagtgtcaggtctactgatccatggaattgttcacttgtcgaagggtattcgagctctgtgtcacctgaggtgtgcgagcaactgagagccactcctgggcccggacagatgtgctatggcggtaactatccggcagctgcggcacaaccgcagccgccgcagaagtcaggtgctagccggctggtaagtcctttcctctcgataagttggtttctacgtaggtaaccttgagcatagtatctacttatcatcccccccccccccctgttcccacttcccagcagcttggtaattgtagtttatggagttcagtaccatgtacttttgttccaaaaactatttgctggggcatgtaggtactgattattcttactcagaaatggaatggatttgtttgacttgaacagttctgttgaaacacgtcaggttctgggctggcttgtccttgtaagatacgggtaccggcatagaacttggtttctcctcgcaaacgaacttccagggttattcaac

SEQ ID NO: 1561 - DNA, 1705 bp, Zea mays
  Clone ID: PAT_MRT4577_171422C.1
cccacaaaaaaaaaaaaaaagaccgaccgaagccccccgtcccccaccaaccaaaaaaagcccgcacgagacgagagacgagacccagacgtctcgccctcggcttcttcctcccctccctgaccgctgccgcgacctctcggcgaaaccctaacctaccttagaccccgccgccgccgccgccgccgccaagggagagagagacttgcacatcaaagggcgtccgatggggaagaagaagaagcgcgtcgataaggtcttctgctactactgcgaccgcgagttcgacgacgagaagatcctcgtccagcaccagaaggccaagcacttcaagtgccacgtatgccacaagaagctctccaccgcctctggcatggccatacacgtcctccaggtccacaaggagtccgtgaccaaggttcctaatgcaaagcctgatagggagtcaacggagatagagatatttggaatgcagggaattcctgcgcatgtattggctgctcattatggagaagaggaagacccttcaacaaaggtacccaaagtagaagtgcctcaggtaaggcctgttattatgcctaattcgctaggcatggcatttcctccgcgaccagcttatggtgtggcacctccaatctataatcctgcactcaatcctttgatggcccggcctccaatttggcctgctgcaccagcgcaagcttggtatccgcaacaagcagcatatccacaacaatcagctgtttcagttcctcccatagttgctgggctcccaccacaacagccactattcccaattcagaatgtgcctactcctatgacatcagcagctgctaatgtacttcaaacatcgtttcctatggcccctccaggagtaccttcacctgttgcccctcatgtttcccagcctttgtttcctgttaacacttcagctgtcaatggagctgtaaattccccatttttagcatctgttgcacctggaaccattccagcaagctcttcagcagcagtcggtgttgcaggaattggatatggaaccaataaccaaggcactagagaacccagcagttggatcttcacctgcagtatccaataataaggcgtctggtgcccaaccagctacgaatgaggtatatctggtgtgggatgatgaagcaatgtcaatggaggaaagaaggttgtcgttgccaaagtatcaggtgcatgatgaaactagccagatgaactctgttgacgcagcaattgatcgaagaatatcagaaagtcggctggcaggacgcatggccctatgaagaagctgggctttgctcggtagattatcccccttgcatttcaccgaaggactctgcctgcgcttgtatctcgctgtgcagcagtcggccctcttcatttagttagcgaatggagttgctgcagttaagaggaatgtgttgtttctgacttgtttgagtgtcgagcctttgttcttctatgtttccagcatcgacaagaaaatgaattagtagcacttaggagttattttggtccaactgtcgcctcattgggaatatattgatgaacacctcaatccctgcccgattgtaacctggtcatgtgctattgccaattgaagcctaatgctgtgcattggcttgaaagcaacttaaaaatgttacggattataatatttaaaaaaaaagaagggcggccgccgaagagagagctc

SEQ ID NO: 1562 - DNA, 1513 bp, Zea mays
  Clone ID: PAT_MRT4577_171541C.1
gttttcatcctccttgaagcgaaaacgatcgagcttgtatcgcaggcatttcggtacactacgttctccggctgtgtagagcttctgcggagatgggtgccgagttgggagaagcgggtgtccctgcccgggacatggtggacgcgctggaaggcgtgcgctccatcctgctgaaaccgtcggagcgcctcgacgacaagcgcttcacgaggatcgccggcgccgacttcgacgacgccggcctcggcctcgccgggttgctcggctcgctcgcgtccacggggttccaggcctccaacctcggcgacgccatcgacgtcgtcaaccagatgttggactggaggttgtcccacgagaagccaagcgacgactgcgctgaagctgaactcgatcctgcgtacagagaatccgtcaagtgcaagatattcctggggttcacttcgaaccttgtgtcttccggtgttcgggagatcatccggtttcttgttcagcatcgcatggtggacgttattgttacgactgctgggggtatagaggaggacctcatcaaatgccttgcgccaacctacagaggcgacttcactctgcccggagcgctgctgcggtccagaggacttaaccggataggaaacctgctggtgcccaatgacaactactgcaagttcgagcactggatcatgccgatcctcgacaagatgctgctggaacagtccacccaaaatgtttggacgccgtccaaggtgattgctcgccttggcaaggaaataaatgacgaaagctcctacctttattgggcgtacaagaacaacatccctgtgttctgcccagcattgactgacggatcaattggggacatgctgttctgtcactcggttcacagtccaggtcttgttgtcgacattgtacaagatgtacggctgatgaacgcggaaaccatccacgcaagcccaaggaagacagggattatactccttggcggaggccttccgaagcatcatatatgcaacgccaatatgctgcgcgacggagctgactatgcggtgtatgtcaacacagctcaggagttcgatggcagtgattccggggcgcggcctgacgaagcggtttcatggggaaagatcaagagctcagcgagaactgtgaaggtgcattgtgatgcgacgattgcctttccacttcttgtggctgcaacatttgcacgcaaggttcacggcactaaatcaacaaactgaatcggaggcagtgaaattaaaatatggcgctctataactagctgaaactttcctcatatgatggttgagcttgaagcatgaacttttatttgcttgaagggtgtctatctcttagctcgtttactatttatacattactgtaacatatgtatgatatatattcatttgaaaccatttgggttattatcatacaataaaacttgtgtgtacgagaacatttgtgaccctctcttcaaattctcaaaattgttgctctaaaaaaaaaaaaaaaaaaaggtgac

SEQ ID NO: 1563 - DNA, 346 bp, Zea mays
  Clone ID: PAT_MRT4577_171547C.1
gggttcgtgaggttctccggggttcaggtttcgcgagtgacgcggatcgagatggccgcttccggtgtggagtaccgctgcttcgtatgcggcctcccctgggccacggacgaccactccctccacaacgcctgcagcacctacggcgaggtcctagagtccaagatcatcctcgatcgggagacgcataggttccgcggcttcgggttacgcaccttctccacggccgaggcgatgccgaacgccatacagggcatgaaccgcacggagctggaccgtcgaagcatcaccgtccaccagggccactcccattgaccacgtggaggcggagatcctggccgtttct

SEQ ID NO: 1564 - DNA, 311 bp, Zea mays
  Clone ID: PAT_MRT4577_171659C.1
ctcagggttgggacttaatagatcatgtcgggcaaacaggctcgagcttccaagcaatatgagaaggcagcccagtacattgactaccacacttcgttcagtgaagatgagaagaagcatccaagacatctgcaattcagcggcaacctatacactgctgcctgcaatctgaagttgaccgattacaaggaaactgcaaatctttgcacaaacgttctggaactacacagcagcatgtcaatgctcactacaggaaggtgcaagcttacattcagcttactgacctagatctagcataggccgatatcaaa

SEQ ID NO: 1565 - DNA, 1169 bp, Zea mays
  Clone ID: PAT_MRT4577_171718C.1
ccggccggggggatcgagtccgcctacgtctcccgtcgttcacctcccggctcccagtcccactgcctctctcgctctctcgtggcttcctggcggcgactgggcgagcgccgccgccctcttcgtcgggcccgcccttcaccggcgacgtgcatccctccggagaagaatattgcgctcacataactgaataactgatattaggatgagtctctgtacaatagcacgacggctatgtctttcaaaaccatcctctggcagtcgtctttcagcaatttgggctcatctatacagcactgaggctgcaaaggacatgggtgctaagaagtacaagtaccccgatgtatacgacccctacgggcctatgccgccgccttcggagaaagtcgtggaactagctgatcgcatcgctgctctccctcccgaggagatcaaacagattgctccagcccttctcctcagactgaaccaggagccgccacaggcggtatctggccagggtttcggtttcggtgcccaggtcggctctggggcaggttctggaaaggctgagaagaaagccgagaagacagtcttcgacgtcaggttggagaagttcgacgctgctgcgaagatcaagatcatcaaggagatcaggacgtttacggatctggggctgaaggaggccaaggagctggtggagaaggccccagtcgttctgaagcaatcgctcacaaaggaggaagcggaagcgatcatagcaaagataaaggcagctggcggtgttgctgtgatggagtgaatgatagatgatcatctagacatcacgccttcttttttgtttcatatttttgttgccatgttcaggtatttgagattgcacattgcagtgcctctgtgcagatggaggaaatagactagttcacagctacgttggtaacaagggagagatggagagtagagattagttgctatgatgatagtcatgacttgttctagaataagcagttctttgggctctacacagcttttctggtggagtgaatgtatgtggccatcagggccaacgatatgaatcttgtgctcttgttgtatctgctatgagttataaacacttcgcagttgcttcattaaatgctaaaaaaaaaaaaaaaaaaaggaaggccgcccggcccagtcagtcccggtcc

SEQ ID NO: 1566 - DNA, 354 bp, Zea mays
  Clone ID: PAT_MRT4577_171748C.1
cgcgtatagaacctctaaaatgttcctaactcgccagtctgaggagcacctggagctcatggacgcctgcggagccggtagcaaggggaagaagggtgcggccgggcgcacggcagacggccccagtaagaaatccgtgactcggtccgataaggtcgggctgcagttccccgttggccggatcgggcgctacctgaagaatggccggtacgcgcagcgcgtgggcactggcgcccccgggtacctagacccgtcctggagtacctcgccaccaaggttatgaagttagcagggaacgcctggcacgacaactagaagactctcatgattctgcgccacgtgcttctggggatc

SEQ ID NO: 1567 - DNA, 1924 bp, Zea mays
  UNSURE (1)..(1924): unsure at all n locations
  Clone ID: PAT_MRT4577_171760C.1
  unsure (1)..(1924): unsure at all n locations
cattgggtacctcgaggccgggccgggcttccccctatttcaccgaccattttccccattttacagcggcgaatatctctcatctcccccgtcctctttgctgcaacacctcctacccacccgacagaaatatcctaagcgctgacccgaatacccgattcgctcctcgtccggtcgattcctgctcctaatcgctcgaatcgagtccttgccccgtgttccgtgccacaatctgggcgcttggctcccgcgagccggggttcttgggcctgggcggaggccatggacaagccggtggcgccgggcattatcaaggaggagctcatggagcagcagccgccgatgcaggacggtgtgggtggcggcggggatgcgccgcgcccgatggaggggctgcacgaggtgggtcccccgcctttcctcaccaagacgttcgacctggtggaggacccggccaccgacgccgtcctctcctggaattcggcacgcaacagcttcatcgtctgggacccgcacgtcttcgccgacgggctgctcccgcgcctcttcaagcacagtaacttctccagcttcgtgcgccagctcaacacctatggcttcagaaaggttgatcctgacaggtgggagtttgcaaatgaaggtttcctcagaggtcaaaggcacctgctgaagatgataaagagaaggaagccaccatcagctgtggcaccattgcgacagcaacgtgcccctgcttcttgcctggaggttggtgagtttggatttgaggaggagattgataggctgaagcgtgacaagaacattttaatcacagaagtagtaaaactaaggcaggagcagcaaagtactaaagatcatgtgagagccatggaggaaaggctacgagtggctgaacagaagcaggtacagatgatggggttcttggcaagagcaatgcggaacccagagttcttccagcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccggaatgatgatggatctggcagacaagttgactggtggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtgacaagcatcttttttttttgttgtactccattttcatcatcattgtacatcaaattgctgaattatgaacagattnnggataatttggccgact

SEQ ID NO: 1568 - DNA, 2395 bp, Zea mays
  Clone ID: PAT_MRT4577_171761C.1
cgcgagcggcagccctttgccttgtttggatactctagtattccccctaattcacatgtgttgagatatattggggtgtaaattagtttaatttatactctaataaacctcaacacacgtggattgcggtgaatactagagtatccaaataaggcctaaggggtattaaccccctcccccccaaaaaaagtcctgggaatctatttactgatttcacttatataggtgtagtgtaactgtgtaaggaaacattttagcgtcggaaaacaagattttgaagcaattaagtgattttgtattttgtgctctttgaggttgtggaaaacaagactcgaagtggttgaagtgattctgaccagacctactgcattatgttttgagcatatctggtcgtgtagtgggtttatggcagtagggattcagtgctatcgttttcactcattagcgcatttgattgtaaacaaatacatccttgaaagtgtttatgatacattctccggtgaacctcatcttcaggtgaggcaaagagaggggagattaactctcccagcaaatttataatcctgacatggtttcttgaacttttttattgtagctagatggaacaagatactggatgaagtaccaagaatcagattgttttgttctagaagactctactgaccaccttcacatgctatagtatattgctggcctatcattatccctgttattgcagatataaatatacaaaagctgaaatttacagagaacctcatccaagcgaacataatgccttatgactgacctgctgatgaccatttctggtctattgcaacctgcagggcttcagaaaggttgatcctgacaggtgggagtttgcaaatgaaggtttcctcagaggtcaaaggcacctgctgaagatgataaagagaaggaagccaccatcagctgtggcaccattgcgacagcaacgtgcccctgcttcttgcctggaggttggtgagtttggatttgaggaggagattgataggctgaagcgtgacaagaacattttaatcacagaagtagtaaaactaaggcaggagcagcaaagtactaaagatcatgtgagagccatggaggaaaggctacgagtggctgaacagaagcaggtacagatgatggggttcttggcaagagcaatgcggaacccagagttcttccagcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccggtacttttcaaattcaattcaatgacacaaacctgttaaaatctggtaacattttcattccatttcttttatattgctggattagccaggaatgatgatggatctggcagacaaggtttgacgacccatccttctaaccatatccattatgtttgcgcagttgcatcttcagatttgccctcatcttttcttccccatctcccaactcctcccttctgaaacattctaaattgctccttatccagttgactgggtggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtgacaagcatctcgtttttttgttgtactccattttcatcatcattgtacatcaaattgctgaattatgaacagatccctaaataattttggtggactggcgtcttggcatttggcg

SEQ ID NO: 1569 - DNA, 337 bp, Zea mays
  Clone ID: PAT_MRT4577_171806C.1
gacgcaacactctagactgagtcgtagtacgcgttcgggattctctaatgccacatggtggatccgcggatggtgaagctcagtcaaaagttcgataccctccacatccttcgcgcgatactggactcttccacgggaacgttcatcattgccggccgcgacggcacggaggatgggaatcgcgcgatctccactgggtatacggatttggtcccgttcgggcgcgtgttcatggctaaccctgacctgccacggacgttccagctagacgctcaccttaacacgtactacagagacacgttttacatccctgatccggttattggatccctgacga

SEQ ID NO: 1570 - DNA, 360 bp, Zea mays
  Clone ID: PAT_MRT4577_17197C.1
atcaacatataaagcacaatagtgtaccaacaatggcagccaaaatatttctgcctccttatgctccttgggctttctggaagtgctgctacggcgaccattttaccgaaatgctcgcaagctcctataactgtccttgtttccccgtacctctcaaaagcagggtgtttcgtatatgaaaacccaattctttaaccctaccagatccaacaggcaatcacaggtggcatgctacatttatcaccctttgtccctccacaatgatcagccctaatacatcaggtacctttggagcatttattgggcaaaaaaatcagggggcaaaaaactacaacaactttgggtttaaaaaacttgggt

SEQ ID NO: 1571 - DNA, 552 bp, Zea mays
  Clone ID: PAT_MRT4577_172100C.1
cgcacatatcatactataccatattttgggaagcacggtcaccaccgccaaggaagccaggatgctagcattgatcgctctcctagctctttgggcaagcgccactagggcgacccagattccagggcactagacagcagacatgccattggggaccatgaacccatgcatgcagctctgcatgatgcaacaggggcttgccagctagatggcgaagccacacctgacgctgcagcaactgtgggacttaccgatacaaaccatgccagagatgacgccacaaatgatgacgcctaacatgaagacaccatagatgatgccaaccatgacgacaccaacgaccatgactaacacgacgacgtaaatgaagatgccgcaatgtcactgcaacaccgtctcgcagattatgctgcaacagcagtgaccattcatgctcaacccaaaggccatgaccaatccacccatgttctacacagcaaccattcagcagaggctggatacaacatgcaaccaacctacatgaactccaataaggagatgacaagccatcgc

SEQ ID NO: 1572 - DNA, 491 bp, Zea mays
  Clone ID: PAT_MRT4577_172115C.1
ataattcaagaaactgacaaaccatctgcggattgaaaaatcaaggtcgaaagcaactttttgcatacatcaccataaagccgtgggggtgttttttggtcacatgctcatcgaacctacagatgcaccacgaccaaagcacacactcgggtgctttatcacaagctctgcacactcggagcccagttgcacggaaaagagacacctgctcactgtccagcaaaccattgtttgttgctcacaaaacctcactgggacataacacgcactgtttacccactgaacttggccatcatctttccaatgataggggcccccttatgattagttcggggcttaccaataacaccaggatggttcatcacattttgtaaagcccacatgacctctgggtcactgaatgctgccataaggccagggtcattcaggattttactaatataaacattaccgggcaacaccaccaggggaaacctacgagcatgccaccc

SEQ ID NO: 1573 - DNA, 416 bp, Zea mays
  Clone ID: PAT_MRT4577_172179C.1
ttcgtttttattttccgtgctatggatggactccgggtgaccatgcgactgcgggacgctcccctacacgagttccttccagaatggaacatccaggtcatggtaagtgaatcacgtgctgagacgggagccaaccaggaagatgccctcgcgcgaatcgaaaagctctaagaagtaaacgcgaagctgggctacctggagagcatgctaggtatatcgcaccctgaattgtcagagatgcaagaccgagccattttggaagctgctatagcaatgaccaaccagagggatcaagtgttcgcagaaataatgcgccctatggctggaacaccacaggaactggggcattaagtgactattatccgccaagttgctcagaaagtagtcgccaaagtgggcaagactatcaggtacaa

SEQ ID NO: 1574 - DNA, 1112 bp, Zea mays
  Clone ID: PAT_MRT4577_172255C.1
cccttccgttccgtccgtccacttgccgttgccgaccacaacccgctcccggaggacggcgggatgagggggcaagccaacggagtggaggaccgccggcagcggggcgacgaccacgaggcggacaacgacggcgaggaggcggaggaagaggagggcgacgacgagggccgccaccggggccagggcccgccgcagcagcggcgccaccaggcccagaggccgaactccggcccgcagcagcagcagcagccgcgcccgccgccgccgctcgccaggaacgtcggctacgtcggcaagcatcgcctctccgccgccatcgcccgcctcgaccaggagctccagtccctccaggaggagctggacgagcttgagaccatggaatctgcgtccgcggcgtgccaggagtaagcagattttgagtgtgtagcgttgtgttttccacatcatcatcatcatcacgtgctgtttcttctcgttgttgatgtatggctgcccttgtgaacgaaacagagtggtcacgagtacggaagggaagcctgacccgcttcttcctgtcaccagtggcccggagaactcgtcttgggacaggtggttccagcgggtgcgttcccgcagcaacaaatggtgggcatcgaaaggccctgacttctcgtagctcctgcaaataaagcagagaccatcctcatcagtcgtgtgcagattagaatgaaacacgttgagatgtatcgtccattggtgtcctggggaaacagaacaggcggcggcggcggcggcgagtgcggtgtggctctcgcaacgcctgatagtttttttttttttttgagagaatcattgtgtacgtagtaatccctaacgaggccgaacatagatgcatccacataggcctggttgttgtgtttcctagagattctgactcactaggtcggattcctgatggtcatgcgatctcgctgttctttcttcaaacgtgaagaatcacattgtctttgaaaagtttcagaaaaaaaggagaatcagattgaacgttgtttaaaaaaaataaaataaaaaaaaaaataaaaaaaaaacaattagaaaataattataataaaaattaaaattaaaaatgg

SEQ ID NO: 1575 - DNA, 1120 bp, Zea mays
  UNSURE (1)..(1120): unsure at all n locations
  Clone ID: PAT_MRT4577_172258C.1
  unsure (1)..(1120): unsure at all n locations
gtcggggtcgccatcaccgtcgcaccgcgcgctgctcccagcctccctttcccttccctggctgcttggctgggttagttgattgactcccagtaaaacgggcagcactgcacggcacgacagaacccactcggncactcccgcctctctctactatacccagctactcgcacgcagatccacccacccacccatcgttccttccgttccgtccgtccacttgccgttgccgaccacaacccgctcccggaggacggcgggatgagggggcaagccaacggagtggaggaccgccggcagcggggcgacgaccacgaggcggacaacgacggcgaggaggcggaggaagaggagggcgacgacgagggccgccaccggggccagggcccgccgcagcagcggcgccaccaggcccagaggccgaactccggcccgcagcagcagcagcagccgcgcccgccgccgccgctcgccaggaacgtcggctacgtcggcaagcatcgcctctccgccgccatcgcccgcctcgaccaggagctccagtccctccaggaggagctggacgagcttgagaccatggaatctgcgtccgcggcgtgccaggaagtggtcacgagtacggaagggaagcctgacccgcttcttcctgtcaccagtggcccggagaactcgtcttgggacaggtggttccagcgggtgcgctcccgcagcaacaaatggtgggcatcgaaaggccctgacttctcgtagctcctgcaaacaaagcggagaccatcctcaccagtcgtgtgcagattagaatgaaacacgttgagatgtatcgtccattggtgtcctggggaaacagaacaggcggcggcggcggcgagtgcggtgtggctctcgcaacgcttgatagtttttttttttttgagagaatcattgtgtatgtagtaatccctaacgaggccgaacatcgatgcatccacatcaaggcctggttgttgtgtttcctagagattctgactcactaggtcggattcctgatggtcatgcgatctcgctgttctttcttcaaacgtgaagaataacattgtctttgaaaagtttcaaaaaaaggagaatcagattgaacgttgtt

SEQ ID NO: 1576 - DNA, 1004 bp, Zea mays
  Clone ID: PAT_MRT4577_172365C.1
cctcgagggccccggccgggcgagtgccctagtaaccctagccgcctgaggccgacgccaaatctctcctgaccgcaacggggaactcgacccccgcctccgccaccgccaccgcgccggtcgccgacccactcagatgaacacgtctccgtccagatacagtgaacgcagggagcccactggatgtctcaaagagggccaggatgatggaaccaggtgctccctattttggggctatgggaagcagcgccagcggtgccggcggcggcttctaccagccctttaacagcaacctagctggtgcagggtctagcaccggtatccaaagcttcccatgtgtccggctgcgaggccttccctttgattgcaacgacattgacgtctgcaagttctttgtggggctggacatagtggactgcctcctggtcaacaagaacgggcgcttcaccggcgaggctttcgtggtcttcccaacatccatgcaggcagagtttgcgctgcatcgcgacaggcagaatatggggcggaggtatgtcgaggtgttcaggtgcaagaagcacgagtactactgcgcaatagccaatgaggtgaaccagggcggttatttcgagccggagtaccgtcgctccccgcctcctccgaggcctaggaagccgtctgaagataagggcagcatggagtacacagaggttctgaagctccgcgggcttccctactctgccaccactgaggacatcatcaagttcttcctggagtacgagctggcagaggagaacgtgcatatcgcctaccgcaccgatgggaaggccacgggtgaagccttcgttgagtttccgacagctgaagtcgcgaagacggccatgtgcaaggataagatgaccattgggacgaggtacgtggagctgttcccgtcgaccccagaggaggccagcagggcgaaatcccgaggcaggcattgaagaaacgtgttccagtgatcttctgtatgcatgcatgcggccctc

SEQ ID NO: 1577 - DNA, 1548 bp, Zea mays
  Clone ID: PAT_MRT4577_172366C.1
cattgggtccctcgaggccggccggggtgccctagtaaccctagccgcctgaggccgacgccaactctctcctgaccgcaacggggaactcgccccccgcctccgccaccgcgccggtcgccgacccactcagatgaacacgtctccgtccagatacagggcaatgatgggaggctgggggggttcggatgggtacgagggatcaaagaggacgcgaatgatgatggaatcgaatccctacttcgcagtgaacgcagggagcccactggatgtctcaaagagggccaggatgatggaaccaggtgctccctattttggggctatgggaagcagcgccagcggtgccggcggcggcttctaccagccctttaacagcaacctagctggtgcagggtctagcaccggtatccaaagcttcccatgtgtccggctgcgaggcctcccctttgattgcaacgacattgacgtctgcaagttctttgtggggctggacatagtggactgcctcctggttaacaagaacgggcgcttcaccggcgaggcttttgtggtcttcccaacagccatgcaggcagagtttgcgctgcatcgcgacaggcagaacatggggcggaggtatgtcgaggtgttcaggtgcaagaagcacgagtactactgtgcaatagccaatgaggtgaaccagggcggttatttcgagccggagtaccgccgctccccgcctcctccgaggcctaggaagccgtctgaagataagggcagcatggagtacacagaggttctgaagctccgcgggcttccctactctgccaccactgaggacatcatcaagttcttcctggagtacgagctgacagaggagaatgtgcatatcgccatccgctcagatgggaaagctaccggtgaagcctttgttgagttcccaacagctgaagttgccaagacggccatgtgcaaggataagatgactatcgggacgaggtatgtggagctgttcccgtctaccccagaggaggcgagcagggcgagaacccgaggcaggcattgaagaaacgaatggcttggctcaatgatctctggttgcatgtggctgcaatcgactgtagttttcacttcgcatgcttatctgtatcgcttttagattgtgttagttgtgtgtatttgacttcttatatgcgaactgaactgtaacaactttcctttgttggccggccgcacatgtacggcataatcatttatggattttgctacgtttgagttgtatgcatgcatgcggccgcgttcgagctcagttttcattttgcatgcttgcctctgtgtgtcgctgttaggtggtgttaacctgagctgtcatgtttcgctactgatcgtgcagtgatttgttatatctgaagttttgaactgaattgtaacagttgtcttctgttggatgcacttgtatggcatatcgtttctataaaaacacgaaggttgcttctttcgttgatgttggggacgtgatggaatttaagtgttgcagtgaaatgcttggtgagctcactttgcccccat

SEQ ID NO: 1578 - DNA, 2008 bp, Zea mays
  Clone ID: PAT_MRT4577_172368C.1
taaattttatgtgtatctatgctaaaatattagatttatcatataagttggatgttttaggaacatccctcagtgccatgttgattatttggtggaatttgttttgtttccgcaatatcagggtagggtatttcttaaataagtttacccctgttataattatgtccctaggttgtggttctcggagtagttctgttataactctttgtgctaggttgtgatgctcgaaatagttttgtccttgtgcctgaattctagctatcatgtctaaaactcgtgatcaagcagaagttagtttcatgatatcaacttttaattcagcttcattacacagctcaaatttcatttacgggataaggttccacctccagattaagctctaaatttgttcatgcatgcttgtgtactggatgtaaaacgatcaaacaacccaagttggaagcatgccatttaaatgttcagagaaaatttctaggcgtagctaaaaactgattctgcctatttgttgcaaataattgctttattgagactcaaatttcatggttatgtgcagcttgcttagtattgcatattatccttcgtatcagctctattatgtcttttctgcacaattatatttatatttgggttattatttgaatttgggattgagagatggggggttattctccttttcttttctctttttgggactggattatctgaaggacgcgcggccctgctagcctcctgcggacgccgccgactccctcccgaccgcactgctgaactccaccgctcactccgcccccgcccccgcgtcgcccgccggggcgaccgccgctgtacgccagctgctcagatctcgtcgggccccttcgccggcgaccatcacctgttagggcaatgatgggaggctggggggtttcggatgggtacgagggatcaaagaggacacgaatgatgatggaatcgaatccctacttcgcagtgaacgcagggagtccattggatgtctcaaagaggtctaggattgttgaaccaggcccgccctattttggggccatgggcagcaacactggtggtgccagtggtggcttctaccagcccttcaacagcagcaacttagctggtgcaggggctagcactggcatccaaaactttccaggtgtacggctgcgaggtctcccttttgattgcaatgacattgatatctgcaagttctttgtgggactggacatagtggactgcctcctggttaacaagaatggccgcttcactggtgaggcttttgtggtcttcccaacagctatgcaaacagaatttgctctgcatcgtaacaggcagaacatgggccggaggtatgttgaggtgttcagatgtaagaagcaggagtactacagtgcaatagccaacgaggtgagccagggtggttactttgagtcggagtatcgccgctcctcacctcctccgaggccccctaagaagactgctgaagacaagggcagcatggagtacactgaggtgctgaagctccgtgggcttccctactctgcgaccactgaggacatcatcaagttcttcctggagtatgagctgacagaggagaatgtgcatattgcgatccgctcagatgggaaagctaccggtgaagcctttgttgagttcccaacagctgaagttgccaagacggcgatgtgcaaggataagatgactatcgggacgaggtatgtggagctgttcccgtctaccccagaggaggcgagcagggcgagaacccgaggcaggcattgaagaaacgaatggcttggctgaatgatctctggttgcatgtggctgcaatcgactgtagttttcacttcgcatgcttatctgtatcgcttttagattgtgttagttgtgtgtatttgacttcttatatgcgaactgaactgtaacaactttcctttgttggccggccgcacatgtacggcataatcatttatggattttgcctcgtttgagtttcaaaaaaaaaaaaaaaaaaaaa

SEQ ID NO: 1579 - DNA, 634 bp, Zea mays
  Clone ID: PAT_MRT4577_172423C.1
cattgggtacctcgaggccggccggggagcttatcaattatcatcgccatccgcacctctctccatctccctgctcctccgcctccttcttgatccaagcaagccagggatcgccatgccatgactcgcgaggagcaccactgtctgaatcaaatgcctacgccgccaccgtccaagacctacccgcacgacgctgcatgccgcccgtaataatggcttcttcggcatcaagaaccgcccctgcaaggctgcgaaggcccctacctcaaacagtgcatagcatgggcatgccaaatgcctgctttgttgagcatagacatattccacgtcaaaaagctcgaacatattgtgccttcctccctgaactgcgatattccccctgagaaccgcactgagcaccagctgattgtatatatcataggatggagttgtgatgccttcttacttcagatgacaacactaaggatgatcttatgactcccccctgcatgtatactcttgtgaccctcatctaggaaggtgttgaaagtggccaggatcttgctgcgactgtacagcctgctatgacggatcagcagatctgcgcgctgaaggatgtgttcccaagtaacttccctgccttggaatactgtat

SEQ ID NO: 1580 - DNA, 2884 bp, Zea mays
  Clone ID: PAT_MRT4577_172472C.1
ggttctgtcaaatctccgttgtctggactgcacacagccacacacataagaatggtgacgatactgtatggagtacatactaacagctagtacaaaggtttcccgctggcacgtcgtcgttgtcgttgtcgtgacaaagaaatctgatggcataccaggaattttctcaagaaggggccaattccctgtatgccactggaaaatatactcattccttgtatgccactggccccacatgtcatagacaccaaaaaatatacctatatgccactcagtggcacacaagggatgagtataaaatctgatggcataccaggaattttctcaagaagaagctgggttggtgccgtgcgtgggcttggctgcttgatctgctgtgtgctgtgcgctcctaggcgggcaatgaatgaagccccagccatacgcccgtccaggaggggaaggcgaaggaggcggacttgaaaagcgtcacctcaacctcgtgaccgcgcagcagcagcagcggcggcggcaggcccatggagcctgctcactgctgccaaagcgcctggcgcggcatcgcgtactttccatgtagctgccatgtttggcgcgcgggctaagctgtggtggcgttcttggagtcggatgtgatttttgactcctggccacaagcaagcaccccaacgcactaacggtccgtaggagtggctcctcctgttacagtattactgtgccaaatactcctcgtgtttgttgtttgcttcaatggaggcctaaaggtgctgccgtcttcacagatactcaggcagtaaaagtccccttctctctccctctccaggaggagtcaatgccctccggtttaacattggcgcgcgaggaggcgtcacatttgcgtcctgtggccgtcacatggatgaagccccgccatttacttcctcgtatttaccttgggctgtagatttgagattctgctttatttaaccgctcgctgctacaccgtccgtggtacccgttgtcaactcactgtcactggcttttgtcctggcgctccctcccttcgccatgcccatgcacgtcccagcgttttcagattttcggtcagactaaaatattctccttgtttcaccgtcatccaggcctagacttcggaggaggcccgagcgagcaggctttcctgctgtccaggaccaagcggccgttcactccgtcgcagtggatggagctggagcaccaggctctcatatacaagtatctcaatgccaaggcccccataccttccagcctgctcgtttccatcagcaagagcttcaggtcatccaacagaggtatgcatgcatgttctcaaccacaagactaaaaaggaggttctctacttcaaagctgttatgctagcacctgcaataaataaaccaaacgagaagagagagaaagtacatatattattttgcacaaatgaataaagaataaccaaaccattatatatgccataaagattgaccactgtattgcctttttgagtataaatgtaatcagagcttgacagactctctaacgcagtgagctggaggcctctttaccaaggctacgcaaacgcagactccgacccagaacctgggaggtgccggcggacagacggaaagaagtggcggtgctccaaggaggcgatgcctgatcacaagtactgcgagcgccacatcaataggaaccgccaccgttcaagaaagcctgtggaaaaccaacctagaaaggccaccaaggaggtgactaccgctgctgctggctcgttgccgtgtgccgggccacaaggtagcttgaagaaggcaaaagttaatgactccaagccaggcactggcagctattggacagatagcttaaacaggtaaataccaccagagtcatctccttgttttagcatcatatctgaataataaaatcccaacttaatacttgtgaatcctattataagagcatcgacgatgcttcattttcaagtactaatctggaacagtattagtatgttatggttctaaataatgttagttgccacttagcattcataataataattctcatttccacgcgaccgtacatattttcaggacaatgctgagcagagagaaggcaaacaaaccgacggacgacgagtctttgctgcttagttcgacgaagaacagtcagcccaccttgtccctgctcactcaactgaagcagcagaacaaaccagataagttaggtcccacaccggaaaatgagccgaactcggacacgatgttgaaagcctggggtggcagccaccacaagagcatttcctccacacagcgccatgacgctgaatccctccaatcagtcctccaaaatttcagcctagcccagaatgacaggttggagtcagaaaagaacagatattctgattccgtgctagtctcatcggctttctattctgcagacggtccacaaacaacctgccttacacctaacatgacacaagtgcagcaggactgcatatcaagctcctgggagatgcctcaaggtggacctctaggcgagatcttaacgaactccaagattagtgaggacttaagcaagtgtggatctaggtcatatggttggctattgaatcttgaccatgcaccatgattcctcaatccatggagagcttgacatagatatctcaccacggatgcaaacaatgagtcaggaaaaaagaaggtccaaatgaccgtactgtttaccccatgcatgctcgttatctacatgtgtacttctatttttgtagtattcagctgttgaattatcagttcttctgaatctggctgtatcttaaacaaattctagtttccgtcaaatgatatcttgcttgcaaaaaaaaaaaaaaaaagggccctagggccgcggccgctct

SEQ ID NO: 1581 - DNA, 278 bp, Zea mays
  Clone ID: PAT_MRT4577_172520C.1
atcgagaagtttaagatatttatttcttacatcttgtgggtgaaccttaaagctatcgatagactcgaagaggctgaggcacttaagatggaaattattccaaaccccaaggaagttgatggtgtgaaagtcctttaactctaaaccgcatctggtgcatctattcggttctttgacaaagcgatcggtattaatgttttctgttcaaggtttttcccattgaatgctacatttgattctgttgcgttggcagtctgatctttacaccattgattata

SEQ ID NO: 1582 - DNA, 289 bp, Zea mays
  Clone ID: PAT_MRT4577_172773C.1
gttggcttcgcctccccctccggttcgtgttcgggttcgtgaggttctccggggttcggtttcgtgggtggacggatcgagatggcggcgtcggatgttgaggaccgctgcgtcgtcggcggcctcgcctgggccacggacgaccactccctccacgacgccttcagcacctacggcgaggtcctcgaggccaggatcatcctcgatcggtggacgcacaggtcccgcagcgtcgagcttcggcagcttctccactgaggaggcgctgctgtacgtcatcgatggcatg

SEQ ID NO: 1583 - DNA, 1851 bp, Zea mays
  Clone ID: PAT_MRT4577_173322C.1
ccattgggtacctcgaggccggccgggatcccaactatcccgatcccgtcgaccctgccacatacagcctcgtttgagctctagactcgagagaggcggatagggagaggcagcaccgcagggagcagtgacagagaggccgagcgagagagagagatggacgtggagaggaaggtggtggaggcggacgacgacggccgcgtcagaacagggacggtgtggacggcgacgacgcacgccatcaccgccgtgataggctccggcgtgctggcgctgccctggagcgtggcgcagatgggctgggtcctcggccccgtcgccctcgtcggctgcgcctacatcacctactacaccgccgtcctcctgtccgactgctaccgcacgccggaccccgtccacggcaaacggaaccgcacctacatggacgtcgtccgctcatgcctcgggcctagagatgtggtggtgtgtggactcgcacagtacgcgatcctctgggggacaatggtgggctacaccatcaccactgccacgagcatcatggccgtcgcgcgcacggactgccgccaccacaggggccacgacgcggcctgcgcctcgtcggggacggtgtacatggtggcgttcggcgtcgtcgaggtggtcctgtcccagttcccgagcctggagaagctcacgatcatctccgtggtcgctgccgtcatgtcgtgcacctactccttcgtcgggctgttcctgagcgccgccaagctcgcgtcgaaccacggggcgcgcggcagcctcctcggcgtcaagatcgccgcgggcgtctccgcgtcgaccaagacgtggcactcactgcaggcactcggcaacgttgccttcgcgtacacctactccatgcttctcatagaaatccaggacactgtgaaggcaccgccatcagagaacgtgacgatgaagagggccagcttctacggcatcagcgtgacgaccatcttctacgtctcgctcgggtgcatcggctacgcggccttcggcaacgccgcgccggggaacgtgcttaccggcttcgacgagccgttctggctcgtcgacgtcgccaacatcgccgtggtcgtccacttggttggggcatatcaggtgtacgcgcagccgatcttcgcgtgctacgagaagtggctggggtcccggtggccggactcggccttcttccaccacgagtacgcggtgcgcctgcccggctgcgcggtgcggttcacgatgtgcaagctggtgctgcgcacggcgttcgtggccgccacgacggtggtgtcgctgatgctgcccttcttcaacgccgtgctcgggctgctgggcgccatcgccttctggccgctgacggtgtacttcccggtgaccatgtacatcgcgcaggccaaggtggcgccaggcagccgcaagtgggtggcgctgcaggcgctcaacgtgggcgcgctcctggtttcgctgctcgccgccgtgggctccgtggccgacatggtgcagcgcctgggccatgtcaccatctttcagacgcagctctaaaaaaagtattcagatcttatgcttggggacgcgcttgcagaggcatgcatcatacatatgcttgtgccgtatattcacctgtgatcttagtacattggttttggaagaacaactaaaaatggagcatgtaagtcattccacctagatttcgtgcattgcaagagtgctttttggggtgaaatagcagacagtgcacactccatgacacatttgaagcccagctaagcgttgggctgaattaatgattatgtttcttcaagggaaaaatagcacatcacatttttactctttaaaaaaaaaaaaaaaaaa

SEQ ID NO: 1584 - DNA, 2626 bp, Zea mays
  Clone ID: PAT_MRT4577_17336C.1
ggggttctgcgtggccatttcgcaacaactccctccatcgtcttgaggcgtgcgcagccatggctgtcctcggcaccgcggcggttgaggtgctcatcccggtagcggcattggttggcatcgctttcgcgttgttgcagtggtatgtggtggccagagtccccgtgccttcgcacgccggcgaggacggcggtggaggaggcaataagaacgtgagggaggaggaggagcatgtggaggaggacggcatggactaccttctcgtggaggcccggtgcgccgagatccagcgcgccatctccgtcggcgccacgtcgttcctgctaaccgagtacaagtacctggccgtgttcacggcggcgttcgcggtggtgatcttcgtgttcctgggttcggcgcagcggttcagcgcgcgccctgggccgtgcgcgtacgacccgtcgcgggagtgccggccggcgctggcgaacgcggccttcagcgcggtggcgttcctgctgggcgcggcgacgtccgtgctgtccgggtacctcggcatgcgcgtggcgacgttcgcgaacgcgcggacggcgctggaggcccgccacggcgtggggcgcgccttcgccgccgcgttccggtcgggcgccgccatggggttcctcctcgcctccagcgcgctgctcgtgctctacgccgccgtcaacctcttcggcctctactacggcgacgactggggcgggctctacgagtccatcaccggatacggcctcggcgggtcctccgtcgcgctgttcggtcgcgtgggcggcggcatctacaccaaggccgctgacgtcggcgccgacctcgtcgggaaggtcgagcgcaacatccccgaggacgaccctcgcaaccccgcggtgatcgccgacaacgtgggggacaacgtcggcgacatcgccgggatggggtcggacctgttcgggtcgtacgcggagtcgtcctgcgcggcgctcttcgtggcttccatctcctccttcggggcggagcacaacctcacggcgatgatgtacccgctgctcatcagcgccgtgggcctgctcgtgtgcgcgatcaccactgtcgtcgccaccgacgtcaccgaggtgaagggttccgacgaggttgggccggcgctcaagcggcagatcctcatctccaccgtgcttatgaccgccggcatcgccgccgtcaccttcctcggcctgccgcccagcttcaccctcttcgacttcggcaacgacaagcacgtcaagaactggcacctattcatctgcgtgtcggccggtctgtgggcggggctcgtgatcggctacgtcaccgagtacttcacgagcaacgcgtacggcccggtccgggcggtggcgcggtcgtgcaggacgggcgctgcgaccaacgtcatcttcggcctcgccctcgggtacaagtcggtgatcgtgcccatcttggccatcgcggcggccatctacgccagcttcccgctggcggccatctacggcatcgcgctggcggcgctggggatgctgagcaccatcgccacggggctcgccatcgacgcctacgggcccatcagcgacaacgccggcggcatcgcggagatggccggcatgccgcaccgggtccgggagcggacggacgcgctcgacgccgcgggcaacaccacggccgccatcggcaaaggcttcgccatcggctccgcggcgctggtgtcgctggcgctgttcggcgcgtacgtcagccgcgccgggatcacggcggtggacgtgctgagcccgcgtgtgttcgtgggactcctcctcggcgccatgctcccctactggttctcggcgatgaccatgcggagcgtcggaagcgcggcgctgaggatggtggaggaggtgcgccgccagttcgacaccatcccgggcctcgccgagggcctcgccgtgccggactacgccacctgcgtcaggatctccaccgacgcctcgctcaagaagatgatggcgccgggcgcgctcgtcatgttcagcccgctcgtcgccggtacgctcttcggggtcgagacgctcgcggggctcctcgccggcgcactcgtctccggcgtccaggtcgccatctctgcctccaacagcgggggtgcatgggacaacgccaagaagtacatcgaggccggcttgtcggaggaggcgaggtcgctggggcccaagggatcggaggcgcacaaagcggcggtgatcggggacaccatcggcgacccgctcaaggacacctccggaccgtccctcaacatcctcatcaagcttatggccgtggagtcgctcgtcttcgcgcccttcttcgccgcgcacggtggcatcatcttcgaccacctctgatcaatgcatgctgctgacgttccatggcaaaggcgccggctgtcgccgcaagccgcctctttgaatttgccgtgatcagttagtaagaataatcgtcgtgtatgtagcctgtaacaagtaatgccagaccaccagagttggaggcttattcatgtctggccctcttatcttacccttgaatatgttgctcggtatgctgcaactgcaatacaaagcgcgaacactagtcggctagaaataaaagcaaaaaaaaataaaaagtacccaaa

SEQ ID NO: 1585 - DNA, 355 bp, Zea mays
  Clone ID: PAT_MRT4577_173437C.1
aaaaatgaaacggcttataattcgcaataggggaattttccctttcccattttttaagaaacaaaaggggatggctttttccctgactttttgggattcaaaacagggcgtcgtagtaaccctagggctggactaattgggctttaagcaacgggaaacgggaacattttaacaggcgggagcaaccccgttcgcctttttggggtccctgttgcccttgggccccaacagggggtccgtttccttggcaggcatttgtgacaccgggagggggttccctggggacttttttttgccctcaccccccgaaaaaatggagtaaagccccatccccaaaatggcgacaaggatgccc

SEQ ID NO: 1586 - DNA, 495 bp, Zea mays
  UNSURE (1)..(495): unsure at all n locations
  Clone ID: PAT_MRT4577_17351C.1
  unsure (1)..(495): unsure at all n locations
ggggtacacgcgnccccccctcgagnttttttttttttttttttttttttttttttttttttttttttttttttttttttttggagccggaaattaaaccgagtcactgaactgaagtttgtccaaagtaacaaagacgggcacccaaaaaaaaaaaaagacgatcccgtatgacgttcctaaacacaaacctggcagggaggggagttccccgatatctcaactaaacgggagctacagctagacttcaaaaaaaaccccgaaaacgaaaccaacgcacgccgactacagtctacagttcgtccttgtcaaaagacggttccaacccctccttggccgccggttcctttttttccacctccggttgctcctcggcctcgtccctctcctccacggccgggtgggggctaaagtccaggcttttgggcaccgacttgtaaatgctggacgcgaactccttggggtcgggaaggttaaaccccctctccataaggg

SEQ ID NO: 1587 - DNA, 392 bp, Zea mays
  Clone ID: PAT_MRT4577_173645C.1
tagcaacatacaaagcacaatattgtaccaacaatggcagccaaaatattgcgcctggttatgctactaggacttactgcaagtagctgctacagcaaccattttcccgcaatagctagcaagctcctatagctttccatcttcacccggacctttcaccagcagcgtcttcagaatgacaaaacccaattctttaaccctacatgatccaacaagcaatagcagcttgcatcttacctctatcacccgtggtcctcctacaatcataagccctattacaacagttacctaaggagcatttattggcacagaacatcagggcacaacaactacgacaaccagtgctagcataccatgctgactactctcagcaacagcagtttcttccattc

SEQ ID NO: 1588 - DNA, 1822 bp, Zea mays
  Clone ID: PAT_MRT4577_173809C.1
gcctctcctcctctcccctgccctcgcaaacgcacgcaccacagcatcgtccttcgttccattcccatccataccccctcgatcggccgggatgctgggtgtggggatggccgcggcggtgctgctcggggccgtggcgttgctgctcgcggacgccgctgcgaggagagcgcactggtggtacagggaggcggctgaggcggtgctggtcggcgccgtggctttggtggtggtggacgccgcggcgcggagggcgcacgggtggtacagggaagcggcgctgggcgcggcgcggcgggcgcggctgccgccgggggagatggggtggcccttggtcggcggcatgtgggccttcctccgcgccttcaagtccggcaagcccgacgccttcatcgcctccttcgtccggcggttcggtcgcacgggcgtgtaccgaagcttcatgttcagcagcccgactgtgctggtgacgacggcggaggggtgcaagcaggtgctgatggacgacgacgcgttcgtgacggggtggcccaaggcgacggttgcgctggtcgggccgcggtcgttcgtggcgatgccgtacgacgagcaccggcgcatccgcaagctgactgccgcgcccatcaacggcttcgacgcgctgacggggtacctgcccttcatcgaccgcaccgtcacgtcgtcgctgcgcgcgtgggcggaccacggcggcagcgtcgagttcctgacggagctgcggcgcatgacgttcaagatcatcgtgcagatcttcctgggcggcgcggaccaggccaccacgcgcgcgctggagcgcagctacacggagctcaactacggcatgcgcgccatggccatcaacctgcccggcttcgcgtaccgcggggcgctgcgcgcgcgccgccgcctcgtggccgtgctgcagggcgtgctggacgagcgccgcgccgccagggccaagggggtctcgggcggaggagtggacatgatggaccggctgatcgaggcccaggacgagcgcgggcggcgcctggacgacgacgagatcatcgacgtgctcgtcatgtacctcaacgccggccacgagtcgtccggccacatcaccatgtgggccaccgtgttcctgcaggagaatccggacatgttcgcgagagcaaaggcggagcaggaggcgatcatgaggagtatcccgtcgtcgcagcaggggctgacgctcagggacttcaggaagatggagtacctgtcgcaggtgatcgacgagacgctgcggctcgtcaacatctccttcgtctccttccgtcaggccaccagagacgtcttcgtgaacggatacctcatccccaagggctggaaggttcagctctggtaccggagcgtgcacatggacccacaggtgtaccctgaccccaccaagttcgacccgtcgaggtgggagggccactcgccgagagccggcacgttcctggcgttcgggctgggcgccaggctctgccccggcaacgacctcgccaagctggagatttccgtcttcctccaccacttcctcctcggctacaagctggcgaggacgaaccctaggtgccgggtgaggtacctgccgcacccgaggccggtggacaactgcttggccaagatcaccagagtcggtagctagctgctagattgtgatggaagtacgaatgaaaaaaaagcccagcagaaactctagcggctgggccggctggaaattatgggccgggccattgtggttgcccccccctgtctgtgcaaaaataaaacaagcagaaaggaataaaaaaaaggaaaagtattacttcgaacgctg

SEQ ID NO: 1589 - DNA, 378 bp, Zea mays
  Clone ID: PAT_MRT4577_173816C.1
tacaactccctatattgagtcgtattacttctccttctctcccggacctctatcgtgttcatcatcacgggctacataactctctccctcgcacccatggcgacgccggacaacacggggcaccggcatccgctgcacatatttggggagtggtacgtgtacaatccggccacgtccgagggcttcatcgtcatattcaacaacgccagctactacaagaagaccaccaccggccctgaggctgggaacgcgcgcacaggcattccgccggtcttcaggaacagcggccgcgacggcgggtacaggcccgacttcggcgacggcaaccagtacacgcagcccacactgaagaagttggccttctgtgggtgctgaatc

SEQ ID NO: 1590 - DNA, 186 bp, Zea mays
  Clone ID: PAT_MRT4577_174037C.1
ctgtggctcctttcttctcaacggcagcggccgcggcatggcggactactgcggcggcctaaccgtacccgtcgtcaggacctgtctcatggcgggctccggcggactcatcttcggctacgacattggcatctcatgaggtgtgtctgagatggaggattttctgaacaagattttccccgggtt

SEQ ID NO: 1591 - DNA, 2474 bp, Zea mays
  UNSURE (1)..(2474): unsure at all n locations
  Clone ID: PAT_MRT4577_174085C.1
  unsure (1)..(2474): unsure at all n locations
tccacgcgttcgcccacgcgtcattgggtacctcgaggccggccgggaaaaaaaaaaaaaaaaaaaaaaagaagatatataattattattcgcagcaaagaggggcacaagcaagagaaggattaggacacaaacgctagagagagagagagaggtggtggccggtgggacgtccgtggtggtggtggagttggatcggctgtgcttgttccttgctcctcgctggatcagaggaggtcatgatcaactaatgcctattcatttattatggacttgcaccagttgttaaagtacagattaactggtgctaacgtctactacgaatttcctacagagaacaacttagcaaacactccttggccagctagtccactgaagtctgagttcagcagctcatcatacactcctctttcatcccagcttgagtgtgataatttgtctgcactcagcaatactccagataaccagagctccacagaaaccatttcagcacaaccaatatcaccactggaagtagacagctcatacaaacaggcagctatccttcgggagaacacccaagtgagacctgatccattgtacacaacatcaaggcataatatgcaacacgctttacgagaaatagagactgttctgatggcacctgatgctgatgatgcagccactagcaccaagcatgaatttgaggaacataaacctgctcagctgatgaggcagcggtcaaggacatggagtcatgaatctaggcagccatcaccaggagttgtacggacacaacttgcatctggataccccacagcaagctatgagttccgcccagagaaacggctaagggagttaagggaggatccgcagagcatggtgaagcagctattaaccaagtgtgctgaagcattaagtgaggagaggatagaggagttccttaaccttgttcagcaagctcgtggagttgtatcaattactggggagccaatccagcggttaggtgcttacctccttgagggtttggttgctagacatgcaaactcaggtacaaacatatatcgtgccctgaagtgccgtgagccagagagtaatgaactcttgtcttacatgaagattttgtataacatctgtccgtacttgaagtttggctatatggctgccaatggggcaattgcagaggcattaagaaatgaggacaggatccatattattgatttccagattgcccaagggacacagtggataacactgatacaagcgctagctgcaaggcccgggggtccaccacacgtgcggatcactggaatagatgacccagtgtcagagtatgcccgtggtgaaggtctggaccttgtagggaagatgttgaaaagcatgtctgaggaattcaggatacctttggagtttacccctctgcccggtatttatgcaactcaagttacaaaagaaatgctggacattaggtcaggcgaagcacttgctgtcaacttcactctgcagctgcaccacaccccggatgagagcgtggacgtgaacaacccacgggacgggctactccggatggtgaaaggcctgtctccgaaggtgaccacgcttgtggagcaggagtcgcacaccaacacgaccccgttcttgatgcggttcaccgagaccttggactactattcggccatgttcgagtcaatcgacacgaacctgccacgggacaacaaggagcggatcaacgtggagcagcactgtcttgccaaggacatcgtgaacatcatcgcctgcgaggggaaggaccgggtggagcgtcacgagctcctgggcaaatggcggtcgaggctgaccatggccgggttcagaccatacccgctgagctcgtacgtgaactcggtgatcaggaagctccttgcctgctactcggacaagtacaccctggaagagaaggatggcgcgatgctgctcggctggaagaacaggaagttgatatctgcttctgcttggcactgacagtaacgttttcagaagaccggaagtacacgtcaactcttacatatatatatgtatgtatgtataatgaattacctggtctgctttccgcaaaaaaggacgccctttgttgtacatgtacatgatgctgtacccttagttttcctgaagtgcagaccagagaagagaacattgacattagattgtagctgctaagctgtatggtaattacagttttcttttgctctcatgtattcacccctgtcataaaaaaaacccagcgtattcttagctaatcagcatgcatacatgctgagatgcttcttagtctttctttcatgctcttgagcgtgcaatgatgtcaacaagttaacatgccctgatgcccctccgagggaagatggatctcaagtcttccatctgcgagatcccagtttgggcaggcaaagtgtgctgnnnnnnnnnnnnnnnnnnnnnnnnnnnnnnnnngnnnnnnnnnnnnnnnnnnnnnnnct

SEQ ID NO: 1592 - DNA, 1969 bp, Zea mays
  Clone ID: PAT_MRT4577_174111C.1
cattgggtacctcgaggccggccgggagacagagaggctagaacaacctgaatttcatccccaccgtcgcctcgctcgacctccacctctctttcctcccggcagcaatggaggcggcacccaggtgaggcgagcaagcagccagccctggctccccgatggcgtgcctggcgccgcagttcaagtgggcgccgtcggccgccgcccacatgccttcctcgtcctcgtcctcgtcctactccaggtgctccgcgctccgcgtccactgcgccgtcacctccgccgctgtcgtcgaggaccgcaccaacggcagcgcggcgcagctgaggctcgcttacgcggctccggcgattcagagaaactttgaggcaactctggcatcagaagcacttctaaatgaagaggcggtagtagcagcggcagccgcagaggcagttgctcttgccagagcagctgccgaagctgcccaagaagttgttcagatagtacaaagaaacaaccatcagccggtaattagaccaaaaaagtgtgtggacaactacttggcaaatgaaatccttcgcacagagatgcgatcgagcagtcctgacatgtatgctaataatcctttgatggagtatctggactcttatggtatcatggatgctgaagatgaattagatgcttatgcgcagtatactgagaacatagctgtgaaatctgctcgtcaatctgagagaaaagctaggagaactagagcagcaataaaagctagcacaaccctccatgcttcacaaaaggttgcattatcctcaaagaagaagcggtccaagggttcctcgtctagtatgaatcctttaggttcgttgtggaagatgaccggtaggagacttcttacagccaaggaagaggttgaattctcagaaggtattcaggatcttttgaagcttgaggcgatccaagctgagcttatagagtacaatggcggtcagccaaccttctcgcagtgggcaacagcagctggagttgatgagaaaactttgcgcaagcgcttgaattatggtatttattgcaagaacagaatggtaacatctaatgtgagacttgtaatctctattgccagagagtttgaaggccctggaatggacttttatgatcttattcaggaaggaatgcagggccttataaggggagctgaaaaatttgattcatcaaaaggttttaggttctctacgtattctcactggtggatcaaacaagcaatgcgtaaatctgtctcagaacaatcccaaatatttcgcttgcctgctcacatggttgaagcaagctaccgtgtaaaggagtgtacaaaacgacttcgccgtaagcttagaagacgacccaccaatgaagaaattgcagtggacactggtattccaattaaacgagttgaggcagcagtaaacctcccaaaatatagtgtgtcccttgatagcaaaattggttccaccgacatgacatatcaggaggtcacagctgatcccagtgctgagacagctgaagagatgctcaacagaatgtccatgaagaaggacgtacacatggcactagatactctcaccactcgcgagaagcaagttgttgttctgaggtttgggctcgaggatggtcggataagaaccctgcaggagatcggtaacatcatgggtgtgagcagggagagaatccggcagatcgagtctggcgcgttccggaaactaaggagcaagaagaaggtgaaggctttgaaggattatctggtgccagtaggcaattggtgaaccgtttgtttgcagaatttgttttccttttggttcctctttttttttttgaggattctgtacttgtaccattttacgtgggtcctcatgtaaaacacgctatcagaatacttgcatcacaagaggaaagagtagtttagttccgtgggaaatgaagtaaaattcacaatttctaaaaaaaaaaaaaaaaa

SEQ ID NO: 1593 - DNA, 1487 bp, Zea mays
  UNSURE (1)..(1487): unsure at all n locations
  Clone ID: PAT_MRT4577_174278C.1
  unsure (1)..(1487): unsure at all n locations
cattgttggctcgctccaggccggcaggaatctccctctttcggaagaaaacaccctccacctctctctctctctctctctctctctctctctctctcttgttgggacctggagaagaggaaggaacagggagcaggggggaagaagaggttgctgcgacggctcaagcctcaaatttttggatccaggcagacaagcagagaaacaccagttggtcaagatgtcagctggtttccagctcggtgtgatcgggtcacttgcactctctgtcgcatcctcagttgccattgtcatctgcaacaaagctctcatcagcacgcttggttttccgttcgccacaacattaacaagctggcatctgatggtgaccttctgcaccctccatgtggcacatcgcttgcatttcttcgagcccaaggcgattgatggacagacggtgatactctttgggttgctgaatggcacgtcaattggccttctcaacctgagcttaggattcaactccattggattctaccagatgacaaaattggcgatcatacctttcactgtgctattggagactatcttcttgaacaaaagattcagcgagagtatcaaactctctcttctggtcttacttcttggagtaggaattgcttcaattactgatctcaagctaaacatgcttggttccatcctttctggcctcgccattgccactacttgtgttggccaaattctcacaaatacaatacagaagaggttgaaggtctcctcaacgcagcttctgtaccaatctgcgccttaccaggcaggaattctgtttgcaactggcccttttgtggatcaacttcttactgaccggagtgtctttgcacacaaatactctgctccagttctgggtttcattgtcctatcttgcttgattgcggtgtctgtgaacttcagtacatttcttgtgatcggaacaacatccccagtgacataccaggtgcttggtcaccttaagacatgtctggttctatcatttggttacactctattacatgatcctttcactctaaggaacatattgggcattctaattgccatatttggtatggcactatactcctacttctctgtaagagagggcaagaagaagtcagcaaatgatgctctaccagtttcacagatggcagataaggaggctgaaccacttttggcaactaaagacaacaacgacaccaagaaagcaaatggtttatctcacgactgctgaggcttttcttgtagtttaggtctagtatgaactgcccttcgaatttaaaggacctggaaagccattcttttcattcttgagttcctttttaggaaacggagcttttaaaatttgtatagaatgcatattttgacattaaaattattatttgattgtattctacacacagcagttccagctgaagttttactagtgcagatctcgtaaaaaaaaaaaaaaaaaagcggccnnnnnnnnnnnnnnn

SEQ ID NO: 1594 - DNA, 227 bp, Zea mays
  Clone ID: PAT_MRT4577_174307C.1
tcttctgttcgctagctgtgcatcatccgtcgttctggcgagcgagcgagcgagggagagacctagcttgactgaccggacgtcagcaggccgagaacgaatcgcgtgtttgtgcatgagccatggcggaccaacagcagccacagcatcagccgcaagagatggacctcgttcgtaccggaggcctcgaactgccttcagggttccgtttttcacccgagcgactt

SEQ ID NO: 1595 - DNA, 605 bp, Zea mays
  Clone ID: PAT_MRT4577_17436C.1
atcgcacatattattgagaccaactaagcacatagaaagcacagtactgtaccaacactggcagccaagaaattctgccttcttatgctccttgggctttctgcacgtgctgctaccgcgaccattgctcccgcaatgctcgcaagctcctatagcttccattgttcccccgtacctctcaccagcggcgtcttctggatgtgaaaacccacatcttcaaccctacaggatccaacaggcaatagcagttggcatcttacctttatcaccctcgatcctccaacagtcatcacgccctattacaacagctacctttgctgcatttattggcacaaaacatcagggcacaacatctaccacaactggtgctagcaaaccttgctgactactctcagcaccagcagcagcttccattcaaccaactacgatcattgaactctgatgcttatgtgcaccaacaacaactaccattcagccagctacctgctgcctacccccagcaatttatggcattcaactcaactagcagcacagaactctccagcttatctacagcaggagcaactactaccattcagccagctagctggtgtgagccctgctac

SEQ ID NO: 1596 - DNA, 250 bp, Zea mays
  Clone ID: PAT_MRT4577_174586C.1
gctctacttccgccagcgttatcatcatggacaactgcgaggagctcatcccggagtggttgggcttcgtgaagggactagtggactcagacgacctgccgcttaacatcttccgcgagacactgcagcaaaacaagatcctcaaggttatccgcaagaacctggtcaaggaagtgcatcgagatgtacttcaagatcccggagaacatggacgactacgccaaggtctacgacggcttctttaagaaca

SEQ ID NO: 1597 - DNA, 211 bp, Zea mays
  Clone ID: PAT_MRT4577_174660C.1
aacaccctagagtgagtcgtattataccacttccacatcctgatagtggtggcctacagcgacggcattcgtctctgatcaagccgcaatgcaaagatgcgtatgtcgtcggcggcacccgttccggcggcaactcaacacaccatgtatcatgttgcgtggcgaccgttgtccggagatttggctgagctagcgaccttgccacacctga

SEQ ID NO: 1598 - DNA, 307 bp, Zea mays
  Clone ID: PAT_MRT4577_174833C.1
caagcctgccctgtccagccttgttaaacagcacagcgagacatcacgagagctagagagagatggcggccacggtttcctccttcccggtggtgaacatggagagagctgagacagaagagaggacaacggccatggaggtcatccgcaacggctgcgagaactggggcttcttcgagctgctaaagcacgggatctcgcacgagctgatagacgaggtggagcggctgaccgaaggcgcactagcggaccttccgggaggccaagtaccaggaattcgcggcacggacactggaaaccggcggag

SEQ ID NO: 1599 - DNA, 371 bp, Zea mays
  Clone ID: PAT_MRT4577_174881C.1
ggacagtgtcaaacgaacattatactatttgattgagacacaccaacaccaataacaagttgcgctgaattggtcaattataggagaatcctagccgacacagaaggagaaaaagaaaggacactgtgccttggcataaaggggggcttagcggaaacaaccctacacctctaattttggcacgtatacatatagggacgggagggactaacgcccaccagctcgctatgcgcgagagatataaggtgagaacacatataccggcagacattctaccttgcccctatttttaccattggccgggacagacaagcaggtagtgcgcatatagaatcacagaagacatgaaacccaggggctacataatggat

SEQ ID NO: 1600 - DNA, 1585 bp, Zea mays
  Clone ID: PAT_MRT4577_174940C.1
gggctttcttctactgttcaccccgcgtgcgctcgctcactcgctctctcccctctggctctgagtggcgctagtgggcgaccgccgccgcgtccctccgtccctcgtcagcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaataaagcttcttttccaaactggctttgacgaggcagagcttaggagctacacatcagtcatccatgctaatgtgtatcagacaattaaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaggaaacttattcacgtgggagtattctgcaagtcccagactgtgcacagtacttcatggaaaatttggacaaattatctgaagaagattatgtaccgacaaaggaggatgtgcttcatgcaagagtacggacaaatggtgtggtagaaactcagtttagccctctaggagagagcaaaagaggcggagaggtctataggctgtacgatgtaggaggccagagaaacgagagaaggaaatggatccatcttttcgaaggtgttaatgctgtaatattctgtgctgccattagcgagtatgatcagatgttatttgaggatgagacaaagaacagaatgatggagactaaagaactctttgattgggtgctaaagcaaagatgttttgaggtccctttaagcgtgtgcgagtggtttaaagattaccagcccactgcacctggcaaacaggaggtggaacacgcctacgagtttgtaaaaaagaagtttgaggagctctacttccaaagcagcaagcctgaccgtgtcgaccgagtgttcaagatctacagaacaacagccctggatcagaaacttgtaaagaagacattcaagctgatcgacgagagcatgaggcgttccagagaaggaacttgatcgaggatgtggtgttataagccacaagacaagtaactaggatggtgtgaggagcagaaagtttacagtgtcgcggctttggccgattgtgattctttttacatgaggaacatttgttgatctttttgccccaccacaagccagtaaaagtatctgttttgcgctggtcttggggaggtttgggtcgtctccatttccccccaatgttaggacaaaatgtacttaccatcttttggagctctgcctgtttggcctcacaatatcaagttcattcgttgttgtct

SEQ ID NO: 1601 - DNA, 1746 bp, Zea mays
  UNSURE (1)..(1746): unsure at all n locations
  Clone ID: PAT_MRT4577_174943C.1
  unsure (1)..(1746): unsure at all n locations
ccggccggatacagcacggaactacgcgtccgcgctgcctttcttctactgttcaccccgcgtgcgctcgctcactcgctctctcccctctggctctgagtggcgctagtgggcgaccgccgccgcgtccctccgtcaggtgcccaggtgtagcctcgtcagcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaataaagcttcttttccaaactggctttgacgaggcagagcttaggagctacacatcagtcatccatgctaatgtgtatcagacaattaaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaggaaacttattcacgtgggagtattctgcaagtcccagactgtgcacagtacttcatggaaaatttggacaaattatctgaagaagattatgtaccgacaaaggaggatgtgcttcatgcaagagtacggacaaatggtgtggtagaaactcagtttagccctctaggagagagcaaaagaggcggagaggtctataggctgtacgatgtaggaggccagagaaacgagagaaggaaatggatccatcttttcgaaggtgttaatgctgtaatattctgtgctgccattagcgagtatgatcagatgttatttgaggatgagacaaagaacagaatgatggagactaaagaactctttgattgggtgctaaagcaaagatgttttgagaaaacctcattcatgttatttcttaacaaatttgacatatttgagagaaaaatacaaaaggtccctttaagcgtgtgcgagtggtttaaagattaccagcccactgcacctggcaaacaggaggtggaacacgcctacgagtttgtaaaaaagaagtttgaggagctctacttccaaagcagcaagcctgaccgtgtcgaccgagtgttcaagatctacagaacaacagccctggatcagaaacttgtaaagaagacattcaagctgatcgacgagagcatgaggcgttccagagaaggaacttgatcgaggatgtggtgttataagccacaagacaagtaactaggatggtgtgaggagcagaaagtttacagtgtcgcggctttggccgattgtgattctttttacatgaggaacatttgttgatctttttgccccaccacaagccagtaaaagtatctgttttgcgctggtcttggggaggtttgggtcgtctccatttccccccaatgttaggacaaaatgtacttaccatcttttggagctctgcctgtttggcctcacaatatcaagttcattcgttgttgtcgatgcnnaanaaaaatatatanattatattatattttatatcttatttagg

SEQ ID NO: 1602 - DNA, 306 bp, Zea mays
  Clone ID: PAT_MRT4577_174972C.1
ccggccgggacaccaccattgagaccactctagcatagaatgcacaatagtgtacctacagtggcggccaagatattttgcttccttatgctccttggtctttctgcaagtgctgctaccgcgaccattgtcccgcaatgctcacaagctcctatagcttcccttcttcccccatacctctaataagcggtgtcttgagtatgagaaaacccatttctggaacgcctacaggatccaacagggggtcggagcaggcatcttacctttatcatccttgtttctgcaacgaccggggtccctattaca

SEQ ID NO: 1603 - DNA, 309 bp, Zea mays
  Clone ID: PAT_MRT4577_175212C.1
cccacgcgtccgcccacgcgtccgaccacgcgtatggttcgtgggtgaccggatcgaaatgggggcgtctgatgtggaataccgctgcttcgtccgccgcctcttctgggccactgactaccacttccttcacaacggcttcagcacctaccgcgtggtcctcgagtccaacatcatcctcgatcaggagacgcataagtcccgtggcttccgcttcttgaccttcttcaccgaggatgcgatgcgcaacgccatcgttggcatgaacggtactgagcttgactgacgctacatcaccgtcatctaggc

SEQ ID NO: 1604 - DNA, 573 bp, Zea mays
  Clone ID: PAT_MRT4577_175238C.1
ttccagatcatcagccaactgcatcttctctccagcttcatcccgctgcaactatctcacccaaccaacaaaccccccctcacacatcaacatgactggacgcggaaaaggtggcaagggcctcggcaagggcggagccaagcgtcaccgcaagatcttgcgtgacaacatccagggtatcaccaagcccgctatccgtcgtctcgcgcgtcgtggtggtgtcaagcgtatctcagccatgatctacgaggagacccgtggtgttctgaagaccttccttgagggtgtcatccgtgacgctgtcacatacactgagcacgccaagcgcaagaccgtcacttctctcgacgttgtctacgcccttaagcgtcaaggccgcaccctgtacggtttcggtggttaagcgcttttctttcatggttttcatatcacgacttctaccggcctcatcggtctatggtcggtttcggtgcttgggtggacggtcacaatgccttgtatagtaggctacggagtttacggtcacatcagtgggattaactgcttttacatggaatgataccataattcttc

SEQ ID NO: 1605 - DNA, 2597 bp, Zea mays
  UNSURE (1)..(2597): unsure at all n locations
  Clone ID: PAT_MRT4577_175240C.1
  unsure (1)..(2597): unsure at all n locations
ccgggnaaaaaaaaaaaaaaaaaaaaaaaaaaaaaaaaaaaaaaaaaaaattcagtcatgtggaaattcaatgttgccagaacaggacagttgacttagagcttcttgcaaagagctgcaagtcactacgccgcttccccattcccgacgggacctggtcctcctctccactctctcttctccctccaataattctctccacccctgcttgctgcagcttcaagcactaccgaatcagggcgagtgggagcagaggagggaatcccatgtctccgcccctcgctggagcagatcgttgtcgagccgacgtggagctgctgcggtagaaagctagcggagcctgcgagctagcctgatccgtccgcagtccgatcgggatcgatgggtggggaggcgccggagccgcggcggctgacccgggcgctgagcatcggcggcggtgacggcggctgggttcccgaggagatgctgcaactcgtgatggggttcgtcgaggacccgcgcgaccgggaggccgcgtcgctggtgtgtcaccggtggcaccgcgtcgacgcgctctcgcggaagcacgtgacggtgcccttctgctacgccgtttccccggcacgcctgctcgcgcggttcccgcggctcgagtcgctcgcggtgaaggggaagccccgcgcggccatgtacgggctcatacccgacgactggggcgcctacgcccgcccgtggatcaccgagctcgccgcgccgctcgagtgcctcaaggcgctccacctccgacgcatggtcgtcacagacgacgacctcgccgagctcgtccgtgccagggggcacatgctgcaggagctgaagctcgataagtgcaccggcttctccactcatggactccgcctcgttgcccgctcctgcagatcactgaggactttatttttggaagaatgtcaaattgatgataagggcagtgaatggatccacgatctcgcagtctgctgtcctgttctgacaacattgaatttccacatgactgagcttgaagtgatgccagctgacctaaagcttcttgcaaagagctgcaagtcactgatttcattgaagattagtgactgcgatctttcagatttgatagagttcttccaatttgccacagcactggaagaatttgctggagggacattcaatgagcaaggggaactcagcaagtatgtgaatgttaaatttccatcaagactatgctccttgggacttacttacatgggaacaaatgaaatgcccattatgttccctttttctgcaatactaaagaagctggatttgcaatacactttcctcaccactgaggaccattgccagctcattgcaaaatgcccgaacttactagttctcgcggtgaggaatgtgattggagatagaggattaggagttgttgcggatacgtgcaagaagctccaaaggctcagaatagagcgaggagatgatgaaggaggtgtgcaagaagagcagggaggggtctctcaagtgggcttgacggctatagccgtaggttgccgtgagctggaatatatagctgcctatgtgtctgatataaccaatggggccttggaatctatcgggacattctgcaaaaaactatacgacttccggcttgttctacttgatagagaagagaggataacagacttgccactggacaatggtgtccgagctttgttgaggggctgcaccaagcttcggaggtttgctctgtacttgagaccaggagggctctcagatgcaggtctcggctacattggacagtgcagcggaaacatccagtacatgcttctcggtaatgttggggaaactgatgatggattgatcagcttcgcattgggttgcgtaaacctgcgaaagcttgaactcaggagttgctgcttcagcgagcgagcactggcccttgcaatactacatatgccttccctgaggtacgtatgggttcagggctacaaagcgtctcaaaccggccgagacctcatgctcatggcaaggcccttctggaacatagagtttacacctcccaatcctaagaacggaggttggctgatggaagatggggagccttgtgtagatagtcacgctcagatacttgcataccactccctcgccggtaagaggctggactgcccacaatccgtggttcctttgtatcctgcgtgagtgtaaatagactaagctggtgtctttccttagcctcctggtcaacaagaatggtgttgataactcgatatatgcggttattgtatggatctagatggctagctgctacgtactgtaataagctactagtagctgagagatgtcctggaataagcccttgctatttttgcctgtactgctttctaatcctagggagatgtatactgctaagcaacgatggaagatgtgagtctgcttgctcgccctgatttgatttgtaccattggaggtataagaatacctgggttttggccgtctccagcaacttacccatctctgtacttatattcaaactttattgagcgaacagtgcagtcttattaaaaaaaaaaaaactaaaaccaaaaaacaaaaatggggcggggcggtctaaaccc

SEQ ID NO: 1606 - DNA, 2621 bp, Zea mays
  Clone ID: PAT_MRT4577_175243C.1
tgggtacccctcgaggccggccggggtgcgccgatcaaattccctgcccggccccctgccgacgtggcatggcatccccagctggagcccgcagaagtaaacgccgcatcccaaatccccaccccacctcgtcctcctctccactctctcttctccctccaataattttctcctctctgcttgctccagttccaagcaccaccgaatcagggcgagtgggagcagagggaatcccatgtctccgcccctcgctggagtagatcctcggcgagccggcgtggagctgccgcggtagaaagccagctgagcctgcgagcgcctgatccgcccgcagcccgatcgggatcgatgggtggggaggcgccggagccgcggcggctgacccgcgctctgagcatcggtggcggtggcggcggctgggttcccgatgagatgctgcaactggtgttggggtttgttgaggacccgcgcgaccgggaggccttgtcgctggtgtgtcgccggtggcaccgcgtcgacgcgctctcgcggaagcacgtgacggtgcccttctgctacgccgtgtccccggcacgcctgctcgcgcggttcccgcggctcgagtcgctcgcggtgaaggggaagccccgcgcggccatgtacgggctcatacccgacgactggggcgcctacgcccgcccgtgggtcaccgagctcgccgcgccattcgagtgcctcaaggcgctccacctgcgacgcatggtcgtcacagacgacgacctcgccgagctcatccgtgccagggggcacatgctgcaggagctgaagctcgacaagtgcaccggcttctccacggatggactccgcctcgtcgcccgctcatgcagctcactgagaactttgtttttggaagaatgtcaaattaatgataaaggcagtgaatggatccgcgatcttgcagtcaactgtcctgttctggcgacattaaatttccacatgactgagcttgaagtgatgccagttgacctagagcttcttgcaaagagctgcaagtcactgatttccttgaagattggcgactgtgatctttcagatttgatagggttcttccaatctgccacatcactggaagaatttgctggagggacatttaatgggcaaggggaactcaccaagtatggggatgttaaatttccatcaagaatttgctccttgggacttactttcatgggagcaagtgaaatgcctattatatttccttttgctgctatactaaagaagctggatttgcagtacactttcctcaccaccgaagaccattgccagctcattgcaaaatgcccgaacttactagttctcgcggtgaggaatgtgattggggatagaggattaggtgttgttgcagatacgtgcaagaagctccaaaggctcagaattgagcgaggagacgatgaaggaggtgtgcaagaagagcagggaggggtctctcaagtgggcttgacagctatagcggtaggctgtcgtgaactggaatacatagctgcctatgtgtctgatataaccaatggggccttggaatctatcgggacattctgcaaaaaactctatgacttccggcttgttctgctcgatagagaagagaggataactgatttgccactggacaatggtgtccgagctttgttgaggggctgcaccatgcttcggaggtttgctctgtacttgagaccaggagggctctcagatgcaggtctcggctacattggacagtgcagtggaaacattcaatacatgcttctcggtaacgttggggaaaccgatgatggattgatcagtttcgcactgggatgtgtaaacctgcgaaagcttgagctcaggagctgttgcttcagcgagcgagctctggccctcgcaatactaagtatgccttccctgaggtacgtatgggttcagggctacaaagcgtctcaaacaggccgagacctgatgctcatggcgaggcccttctggaacatagagtttacacctcccagttcccagaatgctggtcggttgatagaagatggggaaccttgcgtagatagtcatgctcagatactggcatacggctctcttgctggtaagaggttggactgcccacaatccgtggtcactttgtatcctgcgtgagtgtaaatagactgagggcccgtttggtgcccatggaaccgttgtctggaacaatttctggtaggattgcttgctgatttgtataggctttgatcagctggaaacaaatgaacaaggcctaagctcgtgtctttctctcacgtccttgctttcttagcctcatggtcaacaagaatggtgttgataacacgatatgtgcttattgtattgatctagatggctagctgctacgtactgcaatcagctactagtagttgagatgacctggattctggaataagcccttgctatcttcgcctgtactgctatctaatcctaggaagcatgtatatgtatactggtaaaagtaacgatggaagatgtgagtctgattgcccgccctgatttgtctcatgggaggtataagactatctccagcaacttacccatctctgtacttatattcaaactttattgagcgaacagtgcagtct

SEQ ID NO: 1607 - DNA, 262 bp, Zea mays
  UNSURE (1)..(262): unsure at all n locations
  Clone ID: PAT_MRT4577_175247C.1
  unsure (1)..(262): unsure at all n locations
cctcgaggtcggccggcagaccaccacaccaccactaacagaacagctaagcctctccacaagacagcaacatggctgaggaggaggccagaaggtggaggtggaggtaccaaggagcccgaggcggcggcgaaggaggacgtagccgatgacaaggtccgtcatccccgcgaccgacccgccgtcgtcgccgtcgncggccgacgactncaatgcccctgggccatcgtcgagaaatagttgcagatgaatcctgctcccc

SEQ ID NO: 1608 - DNA, 358 bp, Zea mays
  Clone ID: PAT_MRT4577_17540C.1
acgcgttcggatccacctgacgcagatgaccttttggttcagcaggcatgacgtgggaaaggtcattggcggctatcttgctcagggcattctccaacatgaccccttcgaggtcctggaccagaggggagtgggcgagctgctgaagcttgctacatactggggcccgatagctaggcctaacttgaaagtgggcacttgtggataacactgtggagagccttactctgaggccttattcgcgaaagctgggctggattacgtttctcgctcccctttcacggttccgattgctatgctagctgcaactcaagtgcttgtctgaagctgcctcttcattggcaaccggattgcctgc

SEQ ID NO: 1609 - DNA, 419 bp, Zea mays
  Clone ID: PAT_MRT4577_175419C.1
gcttcatataaagcacaatagtgtaccgacaatggcagccaaaacatcttgcttccttatgctccttggactttctgcatgtgtagctaccgcaaccattttgcaacaatgctcacagcctcctatagcttacattgttcacacatacctataaccagcggtgtattcaatgtgtgaaaccccaagagttcaaccctacaggatacaacaggcaatcgcaacaggcatcttaccattatcacccttgctcctacaacaaccgtcagacctattacagcacatacctctggtccattaggtggcacaaaacatcagggcacaacaactacgacaactcgtgctagcaaaccttggtgcatactctcagcaacatcagtttcttccattcgaccaactgtctgcattgaactctgctgctt

SEQ ID NO: 1610 - DNA, 465 bp, Zea mays
  Clone ID: PAT_MRT4577_175436C.1
aaaaaaacagttttggaattttattattacataaacatcgttgagtcaaaagcgcgggggtttaagtcaacacaaatgtaaaacaacccgtcctgaaaaaagtttacagcctgcaccaaacactgaaagtttgaaatgaaagggaaaatttttgaacctaaaggaggggatcaaaaacttttggaacaaaaacactgaaaagtttggctgccgggtcctttaaaaacccctgccaggtttgggggtgctggtgtccttgccggcgtcgggggggggggtgccgtccttgtcctcgccggccatgccgagggagttaattatcgggtccttggttcccacgggggggctgacaaccgtgtccttggcccccagggccgtgctgacaaccgtgtccttggcccccaggggcgggctaatcaccttttcccctgcctgttgaagaaaagcgccgtttttgtccttgcc

SEQ ID NO: 1611 - DNA, 2454 bp, Zea mays
  Clone ID: PAT_MRT4577_175464C.1
aattcggcacgaggccgccctctgtgcccaaaggagctcctctccatcccatctccaacgtcgccccaacccccatcaccgacagggaacccacctctcacgtcgacaccgccagaggaggagatggtggagatacgggcgttgcgatccgaggcagcacgctagagcgacgagagcgtggcgacgtggagatcatgggagtcctgcgcagcgtcgcggcgaggcgcccgtcggggaggcagcgtgcacgtagcgagcggcccgcttgccccccgggcgggtcccgcctgtcgcgcgaaccagggaaatatctacatctcgtctgcgccgccgctgggagttattagggttctacttctagcccgggccgactccactccaatccaatcctggggcgggcgactgcctccttccctcgatctattccccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgttcagcaaattcggcaacctcactgaggcaaaggtggttcttgacaaattttcaggacgttctcgtggtttcggctttgtaacttttgatgagaagcaagccatggaggatgctattgagggaatgaatggactggacttggacgggaggaacatcactgttgataaagctcagccacaaggacctggtagagaccgtaatggtgaccgtgattatgaccgcgagcgtggatctcgttatgaacgtggtcgtgactatggtggtgggcgtgcaccgcgaggtggtggtggtggtggtggtgactgcttcaagtgtgggaaacctggtcattttgctagagagtgcccatctggggatggtgggagaggggacagatatggtgggagagatgacaggtatggcggcggtggcggtcggtggcggtcgttatggttctgaccgtggtggtgaccgatactctggccgtagccgagatggcggcagctatgggggtggcgatcgctacagccgtgaccgatcaggtccttactgatggccttagttcttgattagaccagtatgtgccatccttgagtatgaaagtctatctactaggcatatgacttggtcatagtgcttggcgcttggatcctgcatgtttgcttgatgtgctatttggctattaaaagaaataataaaaaaaaaaaaaacaaaaaaggcatatgacttggtcatagtgcttggcgcttggatcctgcatgtttgcttgatgtgctatttggctattaaaagatggattttgtcactgtgtttgatgaccctggtcctaattaagcttatgcctgtgatacgggggattggatggcaagttagtgtccgcatttgtgttcttttcggggaagcaaggggttgactactataatctacttgaacacacctacagctacaagaaaaaactatgttcttgttacctcttctgaaagcaagtgatgaatcgtccattagagaaaattaactggcttctttttggttatttgttcttgttgtggattggttgatactgtggttctggatttggttacttgcgtcctaagatcatttcagttgtcattttagtctggccagttgatccacgaatgcaaagagattatcctttggttccattctatgtgcctttagcattggagggcctctatttatggttgcttgatgaactggttatgtttgcttcgccatgttggtggggtgttccttgagctgtcccgtgttccttgtgacttgtgagaacaccagaggttatgcttgcctgagtggatgtgatgctacctggttgctgttcctttgacaatgcaccaatgtcctatcgcagcttatatactctggttccagattaattactggtgcccctttgagaggagttatgatgatgttattattcatcagcagcattctaattgcccttgatttagtgtagcctttttttcttagttcaccgaatctcaggatgcaaacgttaggttacttttactgttcgtactaaccaattgagcttttgtactaaaaaaagtatgttacattaagctgctccaggttccgttttctcccggctttgaacatgttgatttgtactgaaagtgctcctctctgtttgtgctgtatgtttatcatttgtggcgatttggggcatttcctttgaggctattctttcattcagtccattggcgcctgagactgcgaaatattcagtcatttacaacacaacaaccaacggttaaaagtacagtgtgatcattttacagtgatctagatggtccagcttgcttgtttctcaactgctgtattgttcaaatcgtattttgtgccggatctggccaagc

SEQ ID NO: 1612 - DNA, 294 bp, Zea mays
  Clone ID: PAT_MRT4577_175476C.1
ggcttctcctacctctcttaccaagttctcttcgggttagggttacttagggtttggtggaggtgcaatggcagctgctgatgtggagtaccagctgcttcgctcgacgggcttgcacttcagacaccagcaacgaagtcctcgagaatgcctacgtctgctactgctagatcctcgactccaatgtaataaaccgaccgcgagacggtgaggtcttacggcttcggcttcgttaccttctactacgagaactacatgctagacgctatcgagaacatgaacggcaacgatctc

SEQ ID NO: 1613 - DNA, 374 bp, Zea mays
  Clone ID: PAT_MRT4577_175574C.1
tttagagtaagtatcttttcagagaagcacaaccatggtggggcaccaagaagcaccattttttacttaggattaacttagaacaaatccttacaggagtaacagcatccattgatccacagtccatgctggttgatgcatgctttgatggagcccaggatgaacacagcactcacaactgtacacagagcgaccttcccatcaaaaacacagatgggcatcaacaaactagaccaacgaagatgaaccctctggactagggtaaacattacggcggcgaacaggataacttggccgcacgggccccaccgatgagctactccagtttccgtcggagtggccgcagccgccgctactgttgccaccgccgaagc

SEQ ID NO: 1614 - DNA, 1962 bp, Zea mays
  Clone ID: PAT_MRT4577_17557C.1
ccggagtgcgagtctgtaatgcagcagcatgctagaatgagctgctcgattagagaaatcatctacctttcttgttggacggtttgttgatgagctccaacagggagtctcagatccagatgctactttaacaaagaaaaatgggaaatccataatggaaggtataacaagctcttcatcaaggtctagaacaaaaggaccagcagatgaaatgtgggatgtccagagtactacttctgaagtgaccttcaagacggccgacaaggaggaagcgacctcagctgatggagctactaattctgcctctcagacaccaaaaaatgaaattcggcacgagaggaaagttcacaagtcactctgggcttatgttgctgatataatccgtcttggatttattcaacatggtgactcccatgattctagtcacaaatcagttaagaaaagttcatctaataattctcagagcacagagggttggctttctagtcaggaacgtgataatgatggcacaaagaagaaaaatggaagtaccaacactctgggtggtggtgaacaagaatctggagtggcttcaatgtcaaatgaggaatatttgcacactgatacccatggtttgcagatatcagaaactgttgttgaacctcaagtaggtagatctgagggagacttgttgcctacaagttctacagatgatctacatatatcaggggggagaacaaagcaatctgatgcaggtgaattacgcaaaggaaatagcatagatgatagcactccaacttatctagatatcacgataggacatttacctgaacgcaaaactgcatccaggatcacaacagagggttctggtgagtttattactgggaaaggaatgttagctggcacatcttctgtgaccatcagtgcaatggaagctggtcgcagtgaagatggagctgattcgatatatgatccttcaggtgctataactccttatcatgattctcaaacgcaaacagtaatgccacatgagaatacctcaactggtatccttggaccaccagcgttacctgtgggagtttctacaaggtttgaagaaaagaatatcatgcaagaggccccagaaattattaaaacaggagggaaggatacagaattgaaaaggagaaattttcaaagaaataaacaagtattgaaggatacatttgatgaatgggaggaagcataccagcgggatgctgagcagagaaaagctgatgagttattcatgagagaagctttacttgaggcccagagagctgcagatatttgggaggtacccgttggtgcagtgttagtacagaatggcgaaattattgctcgtggttgtaatcttgtcgaagatcatagggattcaactgcgcatgctgaaattgtttgtataagagaagcttctaacaaactcaagacatggcgcctagcggacacaacgctttatgtgacattggaaccttgtgccatgtgtgctggtgctattcttcaagctagaatcgatactgtggtatggggtgccccaaacaagcttctgggagccgatggcagctgggttaggctgttccctggggatggacaaacaagcactcttgattcaacaaaccagagccaggccgcagggcctgtccaccctttccatccgaagatagccatcaggcgtggtgtgctgtcggccgagtgctcagagataatgcagcagttcttccagctgaggaggaagaagaaaccacagtcaccaccgcaggcccaccgccatgggcaccatcatcctgtcaagttcttcagcaagatgcaccacatgttcggcacgatattctgtttataacttcgcctctctgttttattttagcttcctaaatttcgtattatggaagtgtgaaaaatgcatttctttctgtgcatctagtgtttttatacaggtccccgtttgtgttaaaaaaaaaaaaaaaa

SEQ ID NO: 1615 - DNA, 783 bp, Zea mays
  Clone ID: PAT_MRT4577_175664C.1
gccggtcagcaggaggagcagcggcggcggcggagagaaggctgctaactggtggccggccgttcgccgcgagctccggcaccccgcagccggccggcacgcctccggtccggcggacggcagcagcagcatgtcttcggccgccccgctgctaggcggcgaggccggcggtggcgagcccgcgccgcggacgccgccgccgccgtcgtcgtgggtggggcgcgtggtggacgcggcggaggcgcgcgcgcagctggggttcgcggtgccgatggtgctgaccagcatggcctactacggcatcccgctggtgtcggtgatgttctcgggccagctcggcgacgtccacctcgccggcgccacgctcggcaactcctgggccaccgtcaccggctacgcgttcgtgaccggtctgagcggcgccctggagacgctgtgcgggcaggcgtacggcgcggggctgcaccgcatgctgggcctctacctgcagtcgtcgctcatcatgtcggccgccgcgtcggcgctcgtctccgcgctgtggtggttcacggagccggtgctcctgctcctgcggcaggagcccgaggcgtcccgcgccgcggcggcgttcgtccgcgcgcaggcgcctggcctcttcgccttctccttcgtgcagtgcctgctccgctacctgcagacgcagtccgtcgtgctcccgctcgtcgcctgctccgtggccccgttcgcgctccacgtcgcgctggcgcacctcatggtcaacgtgctcggcctgggcctcacggg

SEQ ID NO: 1616 - DNA, 2915 bp, Zea mays
  UNSURE (1)..(2915): unsure at all n locations
  Clone ID: PAT_MRT4577_176181C.1
  unsure (1)..(2915): unsure at all n locations
cctggtatnntttacttctcttaacaagnntctttcaatgggtatatagnatacccnnatgctaggtcactnnnacttctncnngccaatacctnntgttagnagggcagnagnnatgttacccctaatnnataatcagtnnncattctgccccaaattgggntcatcttgggttctncnnttctacctatagcgctgtgcttcaagtgggtnncctcgcgtnngcatgtnntttccnnttttgaccaatanngttgcaccaaaaaacctnnttcagttnngcttcagggggggtgagtannactagatcaaaccatgtnnntctgtgcattcagnnaacatgcaagaaanaaatggctaatcaaaatatantttgcagnncctttgcgtgaagagagctaggtgggccgtagaaaaggcttcagttcagatctcatttcagatagcacaggaccaatctggtctgcagtgttcaactggaatataagatttcgctgcataggtcaaaattgaagtttacggtgctgtacgctcaagcgatgtaaacgatcagaatgtgaacgatacgtccaggaagcggactcagatgactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctgcgaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtctgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccatcctctccccgtgcctcggcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtggcctggggattccgcaggctcatgcggctcgagtgctcgccgtaaacgtcagcgttacggactcggactctgtactccagtttaggcactgattccaccgagggtaccggtaattttatctgctctcgcgccagagtgccgggctgcctgcgaccactcctgtgtacccagagttgtaacgtagtagggtgttgtgctgcatgccgaccttttgaaacttttcgagaccgtcatttggaccatttttttcgtcgcaataacacaatacagatcggagtttgtacaggaaaaaaaaaaaaaaaaaaaaaaggcccaggcgggcgccccacccccctagctgtttttccccataccaaacaggaactattacccaatcacctcaacctcaattgcccccccccccgtctttttcctagaaaaaacacattccccactattatcccgatccgcactatttccccccctcattagtcatcgcacatccatcctcctcgccatgaaccttccagttttattccccccgccactacagttatctcccccacccccaaccttttccacctatttctttttattttcctccctatccaccacacaccccgctacctatccacccttgaccttttttcccccattttatgccatttttcccccaccccactttttactgcccaccctatattttaccccccattctcctttcacctcccaccaccatctcaatattacttatactagttctcccaaatgttgacccggcctatataccaccattcttctccccacttccacgccgccgttctttcacccatttattctcctccccttcttcttccacctctgttatcacccagctgtatcgctctctgcatggagacacgcaactcgttctnattcacgttcgnatagttcaccacacgcgcccgctcagctctatccagtgtcatacttcccgccgatantctattcanccaatatgtatgatgcctcctcttacgtgttagtacataactcgatctagtcgtactttgagtcagaccgcccttgggtcacaggtttatgtcgatgttttaagtacattactctaagatgcgtgttgatctgntgtacttctcatcccgtatattacatat

SEQ ID NO: 1617 - DNA, 2356 bp, Zea mays
  UNSURE (1)..(2356): unsure at all n locations
  Clone ID: PAT_MRT4577_176183C.1
  unsure (1)..(2356): unsure at all n locations
tttcaattctgcgggcaatgcgttgatttctccnnnnnnnnnnnnnggattcatgcagcatccagctgcatccagttatttggcttagcctcgtcgtttatattagagtagttcgtgggcgatgattattattacggtggctaaattcgagttatgcacatattcatcacggagaccccgagagttggtgcatgatgcactgaatcccagctgcacatgtttaaaacagcgacacagttatatcccagtaggannnnnnnnnnnnnnnnnnnnnnnnnagtgcagcatcgtcgcgtcagcagcggcgaagctctatactggtcagacccattaggtgtattccattcccacctacagtcggtgaatcactcgtcnnnnnnnnnnnnnnnnnnnnnnnnnnnnnnnnnnnnnnnnccttagcttattaactggtgaagtggtttctttcgccctgtaactctttgggtgtaacttatggagagcgattagcaaattattaccgttttagatagttctgcgtcaagattttaaannnnnnnnnnnnnnnnnnnnnnnnntgtctctgtcaccctttgcgtgaagagagctaggtgggccgtagaaaaggcttcagttcagatctcatttcagatagcacaggaccaatctggtctgcagtgttcaactggaatataagatttcgctgcataggtcaaaggtttgtacgagtgtcggactgcagtgtctgctggcagtggtaatattatttgaacagtgtcatccattgaagattacagtgcagaaggatactattgtgtaaatgagtaaattgtatgttgtgataatctgaacttttactcagatggtggacctggcgcagaaaccaccacaggtnggaaacggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccannnnntttcgggacaccatatgctgcagtatacccacatggtggagcttacccacannnnnttgtgcccatgatgtcaacttcaatgagcgtggagccagccaaatctgcgaatagcaaggagnnnnnttccaataagaaacttaaggaaatagatcggactgcagtgtctgctggcagtggtaacagtaaaagaacagtgtcatccattgaagattacagtgcagaagcctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggttaacagagagctcagagaagctcagactagagaactcagctctaatggtgaagctgaaggacaccgcagaaccgtctcccagcaaagcannnnnnnnnnnnnnnnnnnnnnntgcctcggcggagaacttcctttccatgatcgacagcgccaacgcgccgagcgtcagcaggcacacggagcacggcggtcccaggctccggcagctcctggactccagttccgcgacagacgtcgccgccgtaagctgatgatgaagccggtccggcaaatacgccacagcacatgcatgtggcctggggattccgcaggctcatgcggctcgagtgctcgtcagcgttacggactcggactctgtactccagtttaggcactgattccaccgagggtaccggtaattttatctgctctcgcgccagagtgccgggctgccgcctgcgaccactcctgtcctgtgtacccagagttgtaacgtagtagggtgttgtgctgcatgccgaccttttgaaactttcgagaccgtcatttgcaccannnnnnncgtcgcaataagacaatacagatcggagtttgtacaggacggatgctgcctggtgtgcgcaattctctactg

SEQ ID NO: 1618 - DNA, 2340 bp, Zea mays
  Clone ID: PAT_MRT4577_176184C.1
tttcaattctgcgggcaatgcgttgatttctcccgcctctctgcgcggattcatgcagcatccagctgcatccagttatttggcttagcctcgtcgtttatattagagtagttcgtgggcgatgattattattacggtggctaaattcgagttatgcacatattcatcacggagaccccgagagttggtgcatgatgcactgaatcccagctgcacatgtttaaaacagcgacacagttatatcccagtaggaggtattattttctattgatcttttgagtgcagcatcgtcgcgtcagcagcggcgaagctctatactggtcagacccattaggtgtattccattcccacctacagtcggtgaatcactcgtctgcatctcatcgaagctggtgatgcaagctttgcatgcatccttagcttattaactggtgaagtggtttctttcgccctgtaactctttgggtgtaacttatggagagcgattagcaaattattaccgttttagatagttctgcgtcaagattttaaaccatttttttctgtaagttttttgctgtctctgtcaccctttgcgtgaagagagctaggtgggccgtagaaaaggcttcagttcagatctcatttcagatagcacaggaccaatctggtctgcagtgttcaactggaatataagatttcgctgcataggtcaaaggtttgtacgagtgaaaaaggtatttatttttaagttcatttagtattattttggctggctgaattgtatatttctatgttattttactatactattgaaaaaatgagtaaattgtatgttgtgataatctgaacttttacatgacagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaagcctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacggcattatctccaccacctggtgtgatggttccagttcataatgcagtaccatctgacttatcagttaaggatgagagggaattgaagcgcgaaaagaggaagcagtcaaatagggagtccgctagacgatcaaggctgagaaaacaggctgagacagaggagttggctacacaagtggagtctcttgcagcagagaacacgtcccttagatctgaaatcggccggctaacagagagctcagagaagctcagactagagaactcagctctaatggtgaagctgaaggacaccgcagaaccgtctcccagcaaagcagccgcatccccgtcctctccccgtgcctccgcggagaacttcctttccatgatcgacagcgccaacgcgccgagcgtcagcaggcacacggagcacggcggtcccaggctccggcagctcctggactccagtcccgcgacagacgtcgccgccgtaagctgatgatgaagccggtccggcaaatacgccacagcacatgcatgtggcctggggattccgcaggctcatgcggctcgagtgctcgccgtaaacgtcagcgttacggactcggactctgtactccagtttaggcactgattccagtgaagtaaccgagggtaccggtaattttatctgctctcgcgccagagtgccgggctgccttgcctgcgaccactcctgtcctgtgtacccagagttgtaacgtagtagggtgttgtgctgcatgccgaccttttgaaacttttcgagaccgtcatttgcaccatttttttcgtcgcagtaacacaatacagatcggagtttgtac

SEQ ID NO: 1619 - DNA, 666 bp, Zea mays
  Clone ID: PAT_MRT4577_176191C.1
aaaaaaagaaaacaacctatacaactaacagaaactataaaaaaaaaagaaagacaggaaaaacttccttgttatccccatccgcacctctgtccatttccctgctcctccgcctccttcttgatccacccaagccagggatggccatgcaggactcggaggagcaccacttcaaatcgaaggccgccgccggatactccaagacctacccgaagacaggttggctcccgaccgtaagaacggcttcatcgactataaaaaccgcccctgcacggttggggaggttcttacctgaaagactgcaaacaatgcccatgccaaatgccactttgttgccatagacatattcaacgggcaaaaagctcgaagatatgtgacgcttaggaaacaagtgagatattccgtatgggaaccgtactgagaaccaggtgatcgttatatgagaggatggatttgtgaccctttttacttgagatggcgacactaaggatgatcttagactcccaactgatgagactcttgtggcccagatcaaggaagggtccgaaacgcgcaaggatcttgcagggactgaccagcatgctatgggggaggagcaaatctgagcgcttaaggatgtagacccacagtaactcccctgccttggcatacggtatttcaagacct

SEQ ID NO: 1620 - DNA, 677 bp, Zea mays
  UNSURE (1)..(677): unsure at all n locations
  Clone ID: PAT_MRT4577_1762C.1
  unsure (1)..(677): unsure at all n locations
tcgggaggagaggagggaccacagagctagctcttctcgctagccagacgtcggtccatcgagacgagatccgaggatgtccgggtcgggcggcggcgtgtgggtgttcaacaagaagaagggcgtcatgcagctggagcagccggcgccggcgagccggaaggcgctggtgtacgtgccgacggacgaggtggtgcggtcggtggaggcgctggagcggaggctgggggcgctggggtgggagcgctactacgagaaccgcagcgtcgtgcagctccacaggcgcggcggcggcgccgacctcatcaccatcccgcgcgacttcgccggcctccgctccacccacatgtacgacgtcgtcgtcaagaaccgccaccacttcaaggtcgtcgaccgagacgcctagctggcaagcagctccgtcgtcgccgatgcatggtctcggcatgcatcaatcatcatgcgtgtgtgcagttgctcaacgatcgactgctgatcgatcgttgtaaaaaagaaaaaaaggaactcctgataatctcctggtcgatcgatgatgttgcaggagttatattattgtacttgttaatagtttgcacccatttgtaattttactccataaactaattcattaatatacgcaaactttaanannnnnnnnnnnnnnnnnnnnnnngana

SEQ ID NO: 1621 - DNA, 352 bp, Zea mays
  Clone ID: PAT_MRT4577_176389C.1
aaccgtggtcattgaactcttctgcttatttacagctacaacagctgctactttttaaacagctagctggtgcgagccctactgccttcttcacacaaccacagttgttgtcgttctaccaacacgctgcgcctaacgctggcacccttttacaactgcaacaattgctgacattcaaccaacttgctttgtcaaacccagcagcgttctaccaacaacccatcattggtggtgccctcttttagattactaatgagtaatagttcaatttaaaagtttttgactgatgttagtagcttcccagtaataagaaagttcatttcgtgatttaataaaaataaaaaaaataatt

SEQ ID NO: 1622 - DNA, 272 bp, Zea mays
  Clone ID: PAT_MRT4577_176479C.1
tcgcacaacatccaatgagaaagcagagcgggcctatccacccagggagaaagaggccaaaagggaggggagagtgtcatcatggcttccattgtcgcttccaggagggcctttcctctagttcgcgctctggataagctcatcgcagcatcctccgctcccggcactgtctccgcccttattccttttgcagacgcccgcggtcttcaagtatacaacacctgcccttcgctacaactctactaaggggccgagtctgaagacgatagcgt

SEQ ID NO: 1623 - DNA, 449 bp, Zea mays
  Clone ID: PAT_MRT4577_176683C.1
gggggcggggggcaaggaatactgcagcgttttaacctgataaataacaaatgttttcaaatccccattatttgcaaagttttgcgttttgcccacatgaaaaaaaaaaactgggggaaaaacttggattgctttagcattcatggcctgaccccgtaaaaatttgaattaggacctcttgccaaattaaatcgcctttttttaaactttttaaatcccaaaaccaaacatcccacgtttcccgtggaatatgaaatctctccaacctttttccgggttttcaaccacagttgaattcccatacttgtttttctttggcacaccaatttgtttgagttttatgactggaactccaaactggggcttatccaacattaaccggaccgaggagtacaagccgtgaggccatttttcaaaccgccatttttgggcaatcagttttcctttct

SEQ ID NO: 1624 - DNA, 327 bp, Zea mays
  Clone ID: PAT_MRT4577_176748C.1
tcccggctcgacccacgcgtacgggttggcttctactacccctgcgggtcgggttcgggttcgtgaggctctccgggttgggatgcgtgcatgaccggatcgagatggctgcatcagatgttgagtaccgttgattcgtcggcggcctcacctgggccacggacgaccactagctacacaacgccttcagcaactacggcgaggtactagagtccaagatcatcctcgatccggagactcataagtccgccgattatgctacgtcaccttctccacggaggaggcgatgcggaacgccatagacggcatgaactgcaaggagctgga

SEQ ID NO: 1625 - DNA, 253 bp, Zea mays
  Clone ID: PAT_MRT4577_176784C.1
ctctgttgggcaagaaaaagttacgctgcctttcgatgctttacaaatagggctaacgggggcatgtgttttgaccacagaaaggggtaaccaaagaaaagaaaagaaaagaaaggacaaagaaaagaaaatcaaaagtgtttgttgtttatgttcaacaatctttactgagggcactgctggggcaaatagaacccgatacggccagtacttgaaggcttgttttctccaagccctttgctctgcagctacc

SEQ ID NO: 1626 - DNA, 379 bp, Zea mays
  Clone ID: PAT_MRT4577_176815C.1
gcgtagtccattacaacagcctatagtgagtcgtattaaacggcttattactattgtaccttcgcaggttcgcacgcacctggacggaagcgtatgcgacgacgagtcagaagagtcatcggcgtcgaggaccgcagggtggcggactacatcccttcaccgtggcacgcagtgcagctgctcgtcctcagcggggccggatctgtcaacatctacgacgccaacgcgggcgtgctccgcacgctggctgggacacgctgggccgtctccatcatggtgccagaccaaatcacaccggacctcgccgcctactctgccgcagcggaccggtgggtcgccgacaacctggtcccctactacccggggacacgggtcaagt

SEQ ID NO: 1627 - DNA, 793 bp, Zea mays
  UNSURE (1)..(793): unsure at all n locations
  Clone ID: PAT_MRT4577_176859C.1
  unsure (1)..(793): unsure at all n locations
agttcgaaagccaagcgcgacgaggagaccagcggcgacacacgcagacgcagatttggcattcagaaaaaattgaaattgtgaactgtgaagatgacggcaccagcggagctttcccgtgaggagaatgtgtacatggctaagctcgccgagcaggctgagaggtacgaggagatggttgagttcatggagaaggtggccaagaccgtcgactccgaggaactcactgtggaggagcgcaacctgctctctgttgcatacaagaatgtgattggagcccgccgtgccccatggcgcatcatctcctccattgagcagaaggaggagagccgtggcaacgaggaccgggtcacgctcatcaaggagtaccgtggcaagatcgagactgagcttagcaagatctgtgatggcatcctcaagctgctcgaaacccaccttgtcccgtcttccactgcccctgagtccaaggtcttctatcttaagatgaagggtgactactacagatatcttgccgaattcaagagtgggcctgagaggaaggatgctgctgagaataccatggtggcatacaaggctgctcaggatattgctttggctgagctggctccaactcatccgattaggcttgggctggcctgaaacttctcggtgttctattatgagatcctcaactcgcctgatcgtgcttgcaatctcgcaaagcaggcattcgatgaggncattttcggagctggacaccctgagcgaaaaaatctaccaagacagcaccttgatcatgcaactccttcatgat

SEQ ID NO: 1628 - DNA, 1899 bp, Zea mays
  Clone ID: PAT_MRT4577_177068C.1
gtacccttcgaggccggccgggggcctgggccgttactagcttagctcatatacgtacgtacgcaggaaggctgcaagagagaggagcaatataatggctggttcttcgatggacactgaagctgcaggcaaggagctcaagcagggcagcggcggcggcggcggctacaccatgccggctactgctcatgcggtggacacagactcgtggcagcaggtggggctgctcctggtgatcggcttcaactgcgcctacgtgctcagcttctccaacctcatgatggtgcccctgggctgggcgtggggcgtcgcctgcctgctgctcgtcggcgccgccgcgtggtacgccaactggctcctcgccggcctccacttcgtcgacggccagaggttcatccgctacagggacctcatgggcttcatattcgggaggaacatgtactacatcacctggttcctgcagttcgcaactctacttctgtgcaacatgggcttcattttgctaggagcaagagcgctcaaggcaatcaacacggagtttacccacaccccagccaggctgcagtggttcatcacggccacgggaatcgtctacttcgccttcgcctacttcgtgccgacgatttctgccatgaggaactggctcgccacgtcggcggcgctgacgttagcttacgacgtcgctctgctggctatcttgatcagagatgggaaatcgaacaagcagaaggactatgacgtccatgccggatcccaagccgagaaggtgttcaacgcgttgggcgccgtcgctgccatcctcgtctgcaacacgtccgggctgctcccggagatacagtcgacggtgcgggagccggcggttcgcggcatgaggcgggcgctgctgctgcagtacaccgccggcgccgcggggtactacggcatcagcgtggcggggtactgggcgtacgggtcagcggtgtcggagtacctccccaacgagctcggcggcccgaggtgggccgccgtcctcatcaacgccaccgccttcctgcagagcattgtgtcccaacacctgttcacggtgccgatccacgaggcgatggacacgcggctgcagcggctggacgaaggcatgttctcccgctacaacctcacgcgccgcgtctgcgcgcgggggctcgtcttcggcttcaacgtcttcgtcaccgcgctgttcccgttcatgggggacttcgtcaacctcgtcggctccttagcgctcgtcccgctcaccttcacgttccccagcatggccgtcctcaagatcaaaggcaagagcggtgggagatgtaacagactttggcattggggcatcatagttctgtcctcggctctctgcgttgctaccaccgccgccgccgttcgtttgatcttcaacaatgctaggatctaccacttcttcgccgacatgtagcgagcgagtagtagtgggattgacatgtgtatcgtcaccacgaggtgatagtatggccacttcgttctcaattttttgcttggttcaagagtggaagggtacggtggtcacttagctcatgtttgataagggcactacatgattaataagcatgcatcatgtacgtagtcatcctatcaaaatttagaaaaatgagcttattgtgatcgatggaccacctccctctaaccaaacatctctgttttccgtgaaagcttaaaaggcaactcgtgaatgtgttcttttagacacctcatgcctattatttcttggaagtatagaataatgttgagagttgtaaacatacatgcatgtcgcatctagcccttttgtctatcacacgtgtgctacctgtagactaattgcattatagtgtgactcttgggactcagactcatgattatatataaaaagtattgaaattg

SEQ ID NO: 1629 - DNA, 377 bp, Zea mays
  Clone ID: PAT_MRT4577_17713C.1
cggaattcccggcggatgatgatcctcctatcattcgtgccgctcgtgcgtgcactcttgggttggtttctactgcccctccggatcgggatggggttcgtgaggttctacatggttcgtgttcctgggttagcggatctagatggctgcgtcagatgttgaataccgctgcttcgtcgtcggactcacctgggccactgacgaccactcccttcacaacgccttcagcacctaccgcgaggtcctcgagtccaagatcatcctcgatcgggagacgcagaagtcccgcggcttctgcttcgtcaccttctccacagaagaagcgatgcggaacgccatcgatggcatgaacggcaaggaacttgacggtcgcaaca

SEQ ID NO: 1630 - DNA, 284 bp, Zea mays
  UNSURE (1)..(284): unsure at all n locations
  Clone ID: PAT_MRT4577_177407C.1
  unsure (1)..(284): unsure at all n locations
gaccaactagcaactatagaaagcataaagtgtaccaacaatggcagccaaaagtntttcctacaatgctcattggcctttcttcaagtgctgctactgcgaccattttcccgcaatgctcgcaagctcctataacttcccttcttccaccgaacctctcaccagcaatgtcttcagtatgttaaaacccaattcttcaaccctacaggatccaactagcaattacaacttgaatataacctttatcaccctagatcctactacatatatcatccctataacaa

SEQ ID NO: 1631 - DNA, 811 bp, Zea mays
  UNSURE (1)..(811): unsure at all n locations
  Clone ID: PAT_MRT4577_17745C.1
  unsure (1)..(811): unsure at all n locations
tcgggaacaacgccctttcccttgccatttttggtgagtgcgccctttcccttcctccccagatccccgtccccgttttccacttttgcctccgccccaattcggataacaaacccctccgcctcgtcgcgtctcctcccagccgagccgatccggtagagagagggagagggagggactgagggaggaggagctgggttccggtcccggccgcccggccggctgcgcgattcgattgcagctctcgtccccgggcggcgtccaggatggtgcggggcaagacgcagatgaagcggatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaagtgcaagaagcagccgccctggtgccgatggcttcggcgccgcctcgtgcgccggcagtcgacaaacgtggnaggacggtc

SEQ ID NO: 1632 - DNA, 1392 bp, Zea mays
  UNSURE (1)..(1392): unsure at all n locations
  Clone ID: PAT_MRT4577_17749C.1
  unsure (1)..(1392): unsure at all n locations
cattgggtacctcgagggagatccccgtccccgttttccacttttgcctccgccccaattcggataacaaacccctccgcctcgtcgcgtctcctcccagccgagccgatccggtagagagagggagagggagagggagggactgagggaggaggagctgggttccggtcccggccgcccggccggctgcgcgattcgattgtagctctcgtccccgggcggcgtccaggatggtgcggggcaagacgcagatgaagcgaatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtctgtctgtgtatcatcccgtcccgtccgtcagagtctcagagaacgaacacttcttctccttctccctgtagctagctgctcctgcttgtgtccaaaaaaaaaaaaaaaaaaaaaaaaaaagaaaaaaaaaacggnggagggggcagaaaaggnnaaaangagaaggaaaaaaaacccgggggcaaaaaaaaaaaaaaaaaaaagccgtgcccacaaaaaattttgtccctgggccgggcacccccctaggggggatttttgcagattttctcacactggggggccgttggggctgccctttgaagggccccttcggccttttgggggg

SEQ ID NO: 1633 - DNA, 1656 bp, Zea mays
  Clone ID: PAT_MRT4577_17753C.1
cttaatccaacgattagtgctttttattcacttaagccctcccacctcaacgatgagtgttcctggccagcagcctgatctttataattacatatgtgtccaacgtaagtgtcagtgcatcccatgatggcatacatacatattttgcgtacatacacatcacatgactggataattacatatgtccaatgtaagcgtcagtgcaccccatgatggtatacatacatattttgcatacatacacacatcacatgactggagaatcatgcagagatctctcatctcagccaagatcaggaacgatgaagtagtcctcgtcgtcgtcgtcaggcacctccatccgtgacttcttgaacaggcgcgccccgttcgccttgtagaacccggcgttactcactggctgcggcgaggcgaagaactccgccatggcagttttagctggcgaatgggcgtggaacaggtcgatgtcctcgaaccactccagctccttgagcccaagagacgagtctttcttgtcgctggattcgtagtccgacagctcgaggaggtcctcgacggcccaaccggacggtggcaggaacggcgaggacggcacctcctgcggcagcgcgtccttgaccgtccttgttttggtggtcgtcccggcagctggcgcgctgacgacggccgcgggcttggagctgcccttgggcggcgccggcgggaggccctcggcgctggcgccgcagacggagctgaagccgacgcggatgccggtggcgaggtagcgctggtggttgccggagagcgtgccggggacgtggatgggctcgtcgcagtcgcggcagaggagcgccctgtcctcgacgcagaagatgaaggccggcctctcctggcacacgtcgcagcgcgggaggctggcggggagcgccgcggcgtcgccgagcgggagccgctggtgcttgctggcgagcttgttggcggcgtggatctccacgtcgcagcgcgcgcacagcgccgcctcgtcggcgcagcacaccaccgtggccgccgcggcctcgcacgcgtcgcactggatcctcatgccgcccgttgggaagggagcttcgaggcggcccgccgcggcgcgtcggccgggcgggctgagccaatggcacgggcccttggggcgcgaacgccctaacgtgggtcggggcttccagtggagacaggcaggccagcagccgcctaaaaaaatcagcatgggaacgcgaacgcagacgtcgcagcgcggaaggctggcggagagcgcctcgagcgggaggcgctggtgcttgctggcgagcttgttggcggcgtggatctcgacgtcgcagcgcgcgcacagcgcggcctcgtcagcgcagcacaccacggtggcagccgcgccctcgcacgcgtcgcactggatcttcatggccgctccacctctctgtctgcagtctatactcccaggcccagctcgctatcctgtcctgtcgtctcgcaagtcgcaacaacgagggaggcaaggacgaacaagataaggccactgactgcgatggaggaggacgagcttgcgcgcgcgagcacgcaactggagcaatcagtgagctgccgctgctgggcgagcttgtggtggaggactcgccggggagacttgtggccaggggctcccgg

SEQ ID NO: 1634 - DNA, 4202 bp, Zea mays
  UNSURE (1)..(4202): unsure at all n locations
  Clone ID: PAT_MRT4577_17758C.1
  unsure (1)..(4202): unsure at all n locations
tttcttttattttgttaacacctgattcaaagcggggtgacttattaacagttcacagggggtgccctggagtggcgaatctagggtgagagaagagttagtcctaactcccgcaaagaaatagcgttcttcagggccgtggtacctgacttttataattagcatatatgaccaacgtaagtgtctagtgcatcccgatgatggcatacatacatattttgcgtacatacacatcacatgactggataattacatatgtccaatgtaagcgtcagtgcaccccatgatggtatacatacatattttgcatacatacacacatcacatgactggagaatcatgcagagatctctcatctcagtccctgccaagatcaggaacgatgaagtagtcctcgtcgtcgtcgtcgccgtcaggcacctccatccgtgacttcttgaacaggcgcgccccgttcgccttgtagaacccggcgttactcactggctgcggcgaggcgaagaactccgccatggcagttttagctggcgaatgggcgtggaacaggtcgatgtcctcgaacccactgccagctccttgagcccaagagaacgagtctttcatggtcgctggatacgtagtccgacagctggagggggtcctcgtcggtttatctggactgttttaacgaatccgtgcgacgcggggctggatctcagtggatcgtggcagcaaggccactctgccacttacaatgccccgtcgcgttttaagtcgtctgcaaaggattcagcacgccgcccgttgggaagggagcttcgaggcggcccgccgcggcgcgtcggccgggcgggctgagccaatggcacgggcccttggggcgcgaacgccctaacgtgggtcggggcgggcggcgagcagaggcgccggttgctagcttggattctgacttagaggcgttcagtcataatccggcacacggtagcttcgcgccactggcttttcaaccaagcgcgatgaccaattgtgtgaatcaacggttcctctcgtactaggttgaattactatcgcggcgcggtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctggtggtaatcttttctgacacctctagctgcaaactccgagggcctgaggcgaccggtgcgcgctggcgaacgctgcgcttgctggaaaaacatcgaagtgtctcttagactgctactagcgtagcaacaaagacacaaagtgtgcttagagttatcatgttcacagctgtgcaatactacagtcaaagatgcacgacacatgacactggttgtacacacagcaggagaagaaacaaaactcctgccctttcttttattttagccgagatcagggacgatgaggtggtcctcgtcgtcggtgacctcggtccgggccttcttgctctggcgcaccccggcgccggcagtggcagtggctttggctggcctgtagtacgccgcgtcgttcgcggcctgggttccggaaagctccggtacctcggccaatctcctgccggctttcggcgtctgctcgtggaagaggtcgatgtcggtgaaccactccagctccttgaacccgagcggggactccttgtgcagcttgtcgctggactcgcagtcggagaactgcaggagctcgtcgacggcccagccctgtggcaggaactgcggcggcgagggcacctgctgcgccgcggaggagacggcggccttgggcggggcgtggtggtcggagtcgtcgtgggcgtcgcaggcgtcactgcacgctgacgaagcggaggcgaagccgacgcggatgccggtggcgaggtagcgctggtggttcccggagagcgtgcccgggacgtggatgggctcgtcgcagtcccggcagaagagcgcccggtcctccgcacatcaggggatcggggcttaccgacgcgccgcggcgggccgcctcgaagctccctttccaacgggcggcgtgctgaatcctttgcagacgacttaaaacgcgacggggcattgtaagtggcagagtggccttgctgccacgatccactgagatccagccccgcgtcgcacggattcgtaaaaaaaaaaaaaaaaaaaaaaaaaaaaaaaaaaaaaaaatatcttaagaggtacgtcccttgggaaaaaaaaaaaaaaaaaaaaaaaaaaaaaaaaaaaaaaagacaaaaaaaaaatgagaaaagaaggtgtatcccattatgagtaaattaaaaaaaactggcgctttcgactttttgttccattatattgagccataattntgtgtatttaaaatatataatattctagcgttttttttatttggtactagtttcccttctcgatttttttttttttttttttttttttttttttttttttttttttttttttttttttagggacgaatccgtgcgacgcggggctggatctcagtggatcgtggcagcaaggccactctgccacttacaatgccccgtcgcgttttaagtcgtctgcaaaggattcagcacgccgcccgttgggaagggagcttcgaggcggcccgccgcggcgcgtcggccgggcgggctgagccaatggcacgggcccttggggcgcgaacgccctaacgtgggtcggggcgggcggcgagcagaggcgccggttgctagcttggattctgacttagaggcgttcagtcataatccggcacacggtagcttcgcgccactggcttttcaaccaagcgcgatgaccaattgtgtgaatcaacggttcctctcgtactaggttgaattactatcgcggcgcggtcatcagtagggtaaaactaacctgtctcacgacggtctaaacccagctcacgttccctattggtgggtgaacaatccaacacttggtgaattctgcttcacaatgataggaagagccgacatcgaaggatcaaaaagcaacgtcgcgtatgaacgcttggctgcacaagccagttatccctgccttgtaacttttctgacatctgtccagtaagcttcaaacatctcatgatggcatacatacatattttgcatacatacacacatcacatgacaggagaatcatgcaaagatctctcatctcagccaagatcaggaacgatgaagtagtcctcgtcgtcctcaggcacctccatccgtggcttcttgctctggcgcgccccgttcgtcttgtagaacccggcgttgctcgctggctgcggcgaggcgaacaactcggggacctccgccgtagtggttttagcgggcgaatgggcgtggaacaggtcgatgtccgcgaaccactccagctccttgaacccaagaggcgagtctttcttgtcgctggattcgtagtcggacagctgcaggaggtcctcgacagcccaaccggacggtggcaggaacggcgacgacggcacctcctgcggcagcgtgtccttgaccgtcgtcgttgtcttggtggccccggcagctggcgcgctgacgacggccgcgggcttggagctgcccttgggcggcgccggcggcgggaggccctcagcgccggcgccggcgccgcagacggagctgaagccgacgcggatgccggtggcgaggtagcgctggtggttgccggagagcgtgccggggacgtggatgggctcgtcgcagtcgcggcagaagagcgccctgtcctcgacgcagaagatgaaggccggcttctcctggcagacgtcgcagcgcgggaggctgctggcgctggcggcggtggcgtcgccgagcgcgagcgggagccgctggtgcttgctggcgagcttgttggcggcgtggatctcgacgtcgcagcgcgcgcacagcgccgcctcgtcggcgcagcacaccaccgtggctgccgcggcctcgcacgcgtcgcactggatcctcatgccgcccccgcccctctcctactcctcggcctcaggcggcacaccctgagtccccacccaacccagctctcaggcctcacgtaatccggagcttcccgctcgagacaggcaggccagtaaccacctaaaaaaatcagcacggcaacg

SEQ ID NO: 1635 - DNA, 1341 bp, Zea mays
  Clone ID: PAT_MRT4577_177639C.1
ctcgaggccggccgggccgggcttctctcctcccttcgccggtcaccctatcgcggccgccaggagaagccgccgccacagcaggcgacaaagatgggggggttcgtcaagacccagaagaccaatgcgtacttcaagcgtttccaagtgaagttcaagagaaggcgtgctggtaagacagactacagggcaaggataaggttgattaaccaagacaagaacaagtacaatacacccaaataccgatttgttgtgcgatttaccaacaaggacatcattgcacaaatcgtatctgcaagtatcacgggtgatattattcttgctgctgcatattcccgtgagctgccacgatacggtctagaagttggtctgaccaactatgctgcagcctactgcactggtcttcttttggctcgtcgtgttctcaagatccgtgatttggatcaggagtatgagggcaatgttgaggccactggtgaggacttctctgtcgagccagcggaagagaggaggcctttccgtgccctcttagatgtcggccttattaggactactactggaaaccgtgtctttggtgccctcaagggagctttggatggtggtctagatattcctcacagcgataagaggtttgctggcttcaagaaggatgataagcagctggatgctgatatccaccgcaagtacatctatggtctccatgttgctgagtatatgaagaatctggctgatgaggagcccgagaagtaccaggctcacttcagcgagtacatcaagaaggggattgaggccgatgacatggaagctctgtacaagaaggtccatgctgccatccgtgctgatcctagcatggccaagtcaacaaaggcgcaaccaaaggagcacaagaggcacaaccccaagaagttgacctatgagcagaggaaggccagactcgtggaaaggctcaatgccctcaattcctcgggtggtgtcgatgatgatgaggatgacgaatgaagtgctagtcgcgcgcagcacagtagtgctatcctatttggcgatcagaacttgcgcaatggcatttgttgttccctttactcctgtaacaggcatttttttttgtttgagtttagagctggatatatggagttcacgatgtgctgccggttgaccttgctctttttatccctggattttgtcagtctttgggctgagacacaaatcttggaatctcctcaattcccagggatgaatggacgtgtagctcacatgggacaagatctgcgtcacgtcttgtacttaaaacaaaaaatatgtactccttgaatgaaattgagtcaaaaaaaaaaaaaaaaaaaa

SEQ ID NO: 1636 - DNA, 1202 bp, Zea mays
  Clone ID: PAT_MRT4577_177749C.1
cttgagaaaccaagctttagccttcttggaatcatgctggttgtttcgtttggagttctactaacagttgctaaagagacagaatttaatctgtggggatttatatttattatgcttgctgctgttatgtctggtttccgctggtccatgactcagattcttctccagaaagaggaatacggattaaagaatccttttaccttgatgagccatgttaccccggtgatggcaatagtaacagcaattatttccattgtgatggatccatggcacgacttcagagcaagtcacttttttgatagttctgctcacataataagaagcagcttgttgctgcttttaggtggcgctttggcctttttcatggttttgacagaatatgtccttgtttctgtgactagtgctgtaacagtgactgtagcaggaattgtgaaggaagctgtcactattctggttgctgtgctattcttcaacgatccatttacatggttgaaggcgcttgggctagcaataataatatttggtgtcagtctattcaatatttacaagtataaaaggttcaaaaaagggcattacaatgaaaatgctgggacaaatacccaatcttccaattggacttcaaaatacgtcatccttgatgaagatactgaagctcaagatgatacaggctgatctgaatgtgatagaatgcagactatatatggcgcttccagagaagcaagatcatctgtgcctgcatagtcttactttcacaggctaactgacttcatattctttgagttcatcaattactctggtcagccatgcacgaacatgacgcttgcagccgtgtggcaagttgggaagattacacatacatggaacatacaagatacaacctggtatcagtacatatgttttgtcctttcattcaaaacaaagaacagtgcatatatctgaacgaggcattctgcattatgtccactaagaaaatgctccatcaaatacaattagaactacagctgacacacttaactttctggaagaggataggactcaattttatagtccattctgattgttgaagagagattcggcatcggaacgtagctttcttttctttatttatttttagatgaaaataaacactcgtatatgtaatgttgtatgtatgggactgtatactgttttacacacgagcaccacaagttgaagttcttccc

SEQ ID NO: 1637 - DNA, 2269 bp, Zea mays
  Clone ID: PAT_MRT4577_177750C.1
ctggccggggacctttctaccagaaatcggagcgaaccaaactgccggaaaaacccctcgcctgcggcttcgcgtcggccgccgccgctgccgacactttaccgcgtgccttgcgcccccgcgccgctgatgcgatcagcgacgcacgccagatccgagcttctgtaggaccttcagccgtcgccgtcccatgggggactgcgtcgtcgaggacggccacgggcaccactactcggaggcggtggagggcgcggtttcgttgacggtagccgtggggctcgatgagcgggcggaagagtcgcgggaggaggaggagggtggcgggcagcggaagaaaatgggcgggatcccaagggagccgtcgttctcgcggtggtgcagggacccatctgccgcctccgcctccaataccgccgctgctgcggcgaccagtgacagcgacgcctcagaggagttcgagctgccgctcctgccatcctcctcgggcggcggcggctcaccgatggacattgaggtgggggcaacggcgagatctgatgatctgccgatctcgccgaggttgcttgcgaaggtcatcgggttgatagcgtgttggtacacactgagcacgtgcttgacgctgtacaacaaggagatgctgggaaagcacatgtggaagttcccggcgccattcctgatgaacacagtgcatttcacgatgcaggccgtggcgtcgagggccatcgtgtggttccagcaacgaggtctagagggagggccaagtaaaatgtcgtggaaggattactgtttacgagttgtcccaacagctttggctactgctcttgatataaatctgagcaacatttcacttgttttcattactgtgacatttgctacaatgtgcaaatctgcttctccaattttcattcttctgtttgctttcatgttcaggcttgagaaaccgagctttagccttcttggaatcatgctggttgtttcatttggagttctactaacagttgctaaagagacagaatttaatctatggggatttatgtttattatgcttgctgctgttatggctggtttccgctggtccatgactcagattcttctccagaaagaggaatatgcattaaagaatccttttaccttgatgagtcatgttgccccggtgatggcaatagtaacagcaattatttccatcgtgatggatccatggcatgacttcagagcaagtcacttttttgatagttctactcacataataagaagcagtgtgttgctgcttctaggtggggctttggcctttttcatggttttgacagaatatgtccttgtttctgtgactagcgctgtcacagtgactgtagcaggaattgtgaaggaagctgtcactattctggttgctgtgctattctttaatgatccatttacatggttaaaggcgcttgggctggcaataataatatttggtgtcagtctattcaatatttacaagtataaaaggttcaaaaaagggcatcacagtgaagatgctgggacaaatatccaatcttacaatgggacttcaaagtacgttatccttgatgatgatactgaagatcaggatgattcaggctgacctgaatatggtagaatgcagactactatatgcactggcgtttccagagaagcaagatcttctggtgcctgcatagacttacttccacaggctaactgatatcatactattttttgagttgatcaaccgctgtggccactggccagccatgcacgagcgtgacgcttgcagccgtgtgacaagttgagaagactacacgctcgtacatggaacatacaagatacagcctggtattcagtacagatgttttctcctttcgttcaaaacaaagaacggtgcatatatctgaacggtgcattctgcagtatgtccacgaagaaaatgttgcatcaattacaattagaaacacagctaacacacttaactttatggatgaggatagggttcggttttgtagtgcattctgattggttgaagggagattcagcatcggaacatagctttcttttctttagttctttctcttttttttgttgagatgaaaataaatactactaacaatcttatatgtaataatgttgtatttacgggaatgtgtaccgtttcacgtaggagcatttcgcgccttattgtaatacctcatcttgagaggtcagtgccaagtcggcacggtccatctcaaatttcctttgcgtattttgagagcagcttgtcattgtacatgtc

SEQ ID NO: 1638 - DNA, 426 bp, Zea mays
  Clone ID: PAT_MRT4577_177789C.1
aggcgttccgagctcccccgtggtgcggcacgcgctcctcttgtcactcctctgcgccggagcactcggtttcttgctctgctgccatggcgccgcggtagcgccggcctacgtcaccgtctccgccgccagcttcgcgccgtcctcaacgtgcagcgcctccgacccagttgcgccgcagcagaacgacacgttcaccgtgctgcggctgacgcaccggcacgggccgtgcgcccccttgcgggcgtcctccctggcggccccgtcggtcgctgacacgctgcgcgcggaccagcgccgggcggagcacatactgaggagggtgtcggtttttttctcgcctcagctgtgggactataaggcggcggcggtgacggtgccggcgaactgcgggtacgacatcggcacgtccaactacgtggagac

SEQ ID NO: 1639 - DNA, 863 bp, Zea mays
  Clone ID: PAT_MRT4577_177993C.1
cacctcttctcttcctcctcgtccgccgttgctgtctgtctgcctcctcctccgccgcctagctgcttacctgcttccaccgcaacaagcagagtgcgagcaaagacagaaaaccatgggcgccctgttgctcttcgccgtctgcctgctggcgccgatcgtgctggcctgcgccgtccgtggcaggaagcggcgggccgccgcgccggcgccggcgccggcgtgcggcaagaaggcgctgccgctaccgccggggtcgatggggtggccgtacgtgggcgagacgctgcagctctactcgtccaagaaccccaacgtgttcttcgcccggaagcagaaccggtacgggccgatcttcaggacccacatcctgggctgcccctgcgtgatggtgtccagccccgaggcggcgcgcttcgtgctcgtcacgcaggctcacctcttcaagcccaccttcccggcgagcaaggagcgcatgctgggcccgcaggccatcttcttccagcagggcgactaccacgcccgcctccgccgcctcgtctcccgggctttctccccccaggccatccgcgcctccgtgccggctgtcgaggccgtcgcgctgcgctcgctccgctcctgggacggccgcctcgtcaacaccttccaagagatgaagctgtacgcgctgaatgtggcattgctgtccatcttcggcgaggaggagatgcggtacatcgaggagctgaagcagtgctacctgacgctggagaaggggtacaactcgatgccggtgaacctgccgggcaccctgttccacaaggccatgaaggcccgcaagcggctgagcgccatcgtggcccacatcatcgaggcccggcgcg

SEQ ID NO: 1640 - DNA, 2490 bp, Zea mays
  Clone ID: PAT_MRT4577_177997C.1
attgggacctcgagccggccgggatatgcttccattaaaaatgtccaacttacctttttccccaaaaaaaaaaaaaaaaaaaaaaaaaaaaaaaaaaaaaaaaaaaaccccccaagcttcagtgcggcccgcccacgcgtccagggccggactccaggacaccccatctcatctcttgctcctcgtccgtagttgcagttgcagtgtcctcggccgcctctagtcctagccgtttactccttcctttcaccgcatcaagcagagagcaagcgaggcaagagccatgggcgcctttctgctcttcgtctgtctcctggcgccggtcgtcgtgctcgcctgcgccgtccgcggcaggaagcggcgggcgtcctccgcggcggcgggcggcaaggcgctgccgctgccgcccgggtcgatggggtggccgtacgtgggcgagacgttccagctctactcgtccaagaaccccaacgtgttcttcgcccggaagcagaaccggtacgggccaatcttcaagacgcacatcctgggctgcccctgcgtgatggtgtccagcccggaggcggcgcgcttcgtgctcgtcacgcaggcccacctcttcaagcccaccttcccggcgagcaaggagcgcatgctggggccgcaggccatcttcttccagcagggcgactaccacgcccacctccgccgcctcgtctcccgggctttctcccccgaggccatccgcggctccgtgccggccatcgaggccatcgcgctgcgctcgctcgagtcctgggacggccgcctcgtcaacaccttccaagagatgaagctgtacgcgctgaatgtggcattgctgtccatcttcggcgaggaggagatgcggtacatagaggagctgaagcagtgctacctgaccctggagaaggggtacaactcgatgcccgtgaacctgccgggcaccctgttccacaaggccatgaaggcccgcaagcgcctgggcgccgtcgtggcccacatcatcgaggcccggcgcgagggcgagcggcagcgcgggagcgacctcctggcctccttcctggacgaccgcgaggcgctcaccgacgcccagatcgccgacaacgtgatcggcgtcatcttcgccgcccgcgacaccaccgccagcgtgctcacctggatggtcaagttcctcggcgaccaccccgccgtcctcaaggccgtcatcgaggagcagcaggagatcgcgcggtccaaaggctcctccggcgagcccctgacgtgggcggacaccaggcggatgcgcacgacgagccgtgtgatccaggagacgatgcgggtggcgtccatcctgtccttcaccttccgggaggccgtggaggacgtggagtaccaagggtacctgatccccaagggctggaaggtgatgcccctgttccggaacatccaccacagccccgaccacttcccctgcccggagaagttcgacccctcccgattcgaggttgctcccaagcccaacacgttcctgccgttcggcaacgggacccactcgtgcccgggcaacgagctcgccaagctggagatgctcgtgctcttccaccacctcgccaccaagtacaggtggtccacctccaagtccgagagcggcgtgcagttcggccccttcgcgctgccgctcaacggcctgcccatgaccttcgtccgcaaggactgatgagccgccgacagatgtgtggatcgtggacggagccacaccaaaaccacggcaggccgacggaaccaaaccaaagccaacaacaaacaggcggatggatatggtatggcggtatatgctagctagtactactataggagccgcgaaaaccgcttccgggatttggcgttgcggcggtcgccatcggacgggacggggacaggcatcaggcaagcatgggatgatcacagaggaaaaaaaaaaaaaaacggtgtacagattcttcttcagctagtaggaccggatcccaagaagccggaagaggagaccaaacacaaaattaggcctagccacgtaggtgtcactcggtgtaagctactagttccagtaggcatcagatgacccagcgctacaaacaagtggcgtttaattgtaaaaccaaaccattttttttctctatcttcttcttcttcttcccccccctttagattttttttaataagctagccagacaacacccataggagaagaataagggaaaccataaaagaaagagagggaggccctgattgggattgtaagctagctaggttgtccgcctgaaagcaggctggcagctaggcacaataatccatggacggatggatggattggatgggtcgccggagtcaaaaggaggccacgtcgtcttccccgcaggcgcagccaaggactacggcccgggacggcgaccccgccttgtatttgtttcgtgatttcgtccaatgcaaaaaagacagtgactgctttcacagcaccaactgcccgtattacta

SEQ ID NO: 1641 - DNA, 5552 bp, Zea mays
  UNSURE (1)..(5552): unsure at all n locations
  Clone ID: PAT_MRT4577_178070C.1
  unsure (1)..(5552): unsure at all n locations
aaggtcttggaaagcattttgaacaattaaagaaaataaaaagaaagatgcaacattgacggttccagttctgagaaggaagaatgtaacagtaactgctcgtcaatgaatggtatgcaagtatcagataagatatctgttgatgaaacgaataagggagctgatgtaagcaagttaatgccagaggatgctttctttcgcttgaagagtttgggagctggccttcatgaaaagtccctcgaagagctcacaaagatggcccataatttctatgatgagactgcactcccaaagctggtggctgatttcgcgtcccttgagctttctcccgtggatggaagaaccatgaccgatttcatgcatacaaggggacttaatatgtcctctttaggcagtgtggtagagctagcagagaagctcccacacatccagtctatatgcattcatgaaatggttattagatcctttaagcacatcgtccgagctgttattgctgctgttggtgacatgcaaaatatttctgcagctatagctgaaactctaaacatattacttggatctcccagacttgaaaatggtgctgacacagatgcccatattgacaataatttgcgtttgaaatgggtagagagcttcctttcaaaaagattctgctggaaactgaaagatgaatttgcacacttacggaaatttatcattctgagaggtctctgcagtaaggttggactggagctagttgcaagagattatgatatgaatagccctaacccatttgacaaatctgacattgtcagcattgttcctgtatgcaagcatgtggtctactcatctattgatggtcgaaacttactggaatcatcgaagatggcattggataaaggaaaattagatgatgctgtgagctatggaacaaaggcattgtccaaaattatagctggttgtggtccataccatcgactgacggctaatgcatacagnccttcttgctgtggtgctntatcatactggnagattntaatncaggcaactgtatatcaacagaaggcagctcgagggccggcatcgatctgcaagtctcgctacggcaataaaaaaagcagccgcaatggcgagcagcaccatggccctctcctccacggccttcgccggcaagggtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccgccgagctacctgacgggcgagttcccgggcgactacggctgggacaccgcggggctgtcgggacccggagacgttcgccaagaaccgctggaggtgatccactcccgctgggccatgctgggcgctcggcgtcttcccggagcttctcgcccggtgtgactattgctccggtgggccctcttgatatcaatgaagggagctgggtcttgacatccggaactatgaagattatggggatttatctgtcttctttaccgccttcaacattgaacgcccgcgcgtgcaggccatcgtatcagagctcatcgtgctgacttccttgaacaggaccaggaagggcacccaaaggagggacatagtgaagcggaagcacagacaactcaaaaggagggtcaagttgtgaaagtcgtttcaggtaaaggaaaggaaaacagagggaaagacatcgtgagaaactcatacaaaacagaacttgcaaggcaaattttgctcagtttcattgtgaagtcagtgcatgacagtttaggttccgcccaagctgaaccagagaggaagccaagtggatcagatgaagctagtaataaacagagcagcaacttagtcaagaatgcttctggtcgcaaagattcagataaacaagagaaatccatggaggttcccaagggcctgaaggatacagagggatttacagtcgtttcaaaacgtcgaaggcggccccagccattcatgaaccccataaacggcctctgttctcagccgtctatttgcacctctgtcagttaaggtctcattgcattttcaaagacctgcaatagtttggaagatggaccattgcttttgcttaggggttggtagaagaattttgccgtatccaagcgagcagcgagcatgtagtcaaactgtacaaaattttccaggataccctttgtaataataataaaaaaaaactgctgtaatctgcagtagctgtagcgctgaataaagtattcctttgtatgttagatatgacagaatcagaggaaatagcaagcagatgtttaggttaatccaacacaccaatagtgcttctctttacttttaggcatagatagcaatttgacagattaagatcatccacttcaaaccaggatcagggttatcaaggtcctagtcatacggcaaggaggaagtatatgatgccagtgccttccttcaaccaatgcctacttaactatgaaatggctctacagtatgtcaaccgtgcgctatatctgcttcagttttcatgtgggctttcacacccaaattcagctgccacctacataaacgtagctatgatggaagaaggcatgggaaatgttcatgttgctcttcgatacttgcatgaagccctgaagtgcaataagaggttgctaggagctgatcacatccagactgctgcaagctaccatgctatagccatagccctttcaatgatggatgcgtactccctaagtgtgcaacatgaacaaacaaccatgcagatacttcaggagaaactaggggaagatgacctccgaactcaggatgctgctgcatggctagaatattttgagtcaaaagcattagaacaacaagaggctgcccgaagaggcacgccaaaacctgattcatctattggaagtaaaggacatctaaggtatgaaactacaaatcatctgagcactttcaattataatatatttaaatttagattgaaacatctacctttacaaggtatctgatcttctagacttcataagctcggtccaagaatgcagagaaagaagagaaaaaagcaaaggtcagcaagggactgaaggatacagaggtattcacggtcaattaaaaacagcaaaggagactcccgccgttgatgaaccccatatttggcctattttctcagctgtctaattgcaactctgtcagttgaggtcattgcgttttcgaagacctgcaatattttgagagatggacctttgccatcgcctttgcctttgcttagaggattggtagcagagattttccctatccaagtgaactgtgagcagcgagcatttagttaaactgtacaaaaggtttccggaataccctttttgtaataaaagaaactgatgtattccgcagtagctgtagcgctggatataatgttcctttgtatgttatatatcacaggatcagaaagaagattctgtaactgctcctagccagatttcatttggtagctttttaaaaactgacaagttgaatggggattccagcattgctgaagataagacgtgcaatggtagtgctaaccaagaacaacggacaaagccaacaggaattaacaggccaaccagtatcgcttccaaatttatatcatacaaagatgtggctgtttcgccccctggcacagtattgaaacccattttggagaagaaggaagcaaaggagaagggtagtggacatgatatttatctaacactgtcatccgaggaagaagatccacagtttacagaaaatgagaaggaaaagccaagtgaggacagtagcaaagaggttctttcaagtcagcaagacttagagagtcatgtagaaacacctgacagcaacagtgatgaaaacccatctgcacctaagaaggcatctggaagcaaactgtcagcttcagcgcctccattcaatccaggatcactcttatcaatgtcccacccatacagcacggtggcaatatatgatgctagtgctgttattcaggcagtaccaaaccaagcaatggagattctccctcatgccattgacactagagtgcctcgtggccctcggtccaccttgtactatcgtactgggcattccttccaaaggaagcaaggttacacgcacagccagagcactattgtaaggggtagttactcccccacaaccatgaacccccatgctgctgaatttgtgcctggaaaaacttcgcaacaatctgatgtggctgacagagaacccagtcctgctaatcatgtggccaattctgatctggatgttgtatcgcagaccacagatgaagtgaaggctgaaacacctgccactgaaaaggcaggtcaagttgagaaagtcgtttcaggtaaaggaaaggaaaacagggggaaagacatcgtgagaaactcatacaaaacagaacttgcaaggcaaattttactcagtttcattgtgaagtcggtgcacgacagtttaggtccctcccgggctgaaccagagaggaagccaagtggatcagatgaagctagtaatgaacagaccagcgtcttaggcaagaacgcttctggtcgcaaagattcagataaacaagagaaagcgacggaggttcctaagggcctgaaggatacagagggatttactgtcgtttcaaaacgccgaaggcggccccagccattcatgaaccccataaatggcctatattctcagccgtctatttgcacctctgtcagttaaggtccattgcattttcaaagacctgcaatagtttggaagatggacctttgcttttgcttaggggttggtagaagaattttgccgtatccaagcgagcagcgagcatgtagtcaaactgtacaaaattttccaggataccctttgtaataataataaaaaaaaactgctgtaatctgcagtagctgtagcgctgaataaagtattcctttgtatgttatatatgacagaatcataggaaatagcagatgttaagctaatccaatattcagtggagcgcccttgtgctttatgatgttcctcaaaaaaaaaaaaaaaaaaaaaaaaaaaaaaaaaaaaaaaagggcggccgcatcatagtacgtcatatatcccagtagtgcttttcttatgcnctagtgtttctgcagtttctcaagatgtcgtggggatttatcgttgcaatctgcaaatgctgtcagagcagaagaaactgaatctgctaggcgccaagagtttgttcatgaaggcatgtcttttattgcttctttcccctgtgcccagactgctcagtgtggtcattggatgccttgtcagaggacggagcagcgtttcaccgtgaagcaattgcagctgcagaccagatcaccagaccactgaggccaggcgtgaactgggccggcagttttaaagctgttggcagctacgtatactgtacgagtctaaggagtagcctgcagctaagcgtagctgcagagaccacacaaatgtgaatcaaatcagttcagttccaaactgtcattgctgggagcc

SEQ ID NO: 1642 - DNA, 156 bp, Zea mays
  Clone ID: PAT_MRT4577_178107C.1
ttcctggaccaagggatgcgccgatgcactgttttatccggagggacaaagaaaattaaaccttttttttttatttaagtttaacgcaggccttacgggtaaagggaaagttcttttggctggtcgaagggtcaaaccaggggcacattccggata

SEQ ID NO: 1643 - DNA, 1457 bp, Zea mays
  Clone ID: PAT_MRT4577_178188C.1
ctttggtccctctccctcccccgtccgccctgcactctccagctcaacaaggaagaagagggggccttcaccacaccactcgattcctctttagagcacgacttacgaagtgtgcccaggccgtcgccgccgaccagcaaaagggctggaaagcccccctcttttgtgctgtgcgtgcaactcggctcctgccctgccatcttgctttccaagacccctgcgcccccagtcccataattagttaggattaggatcaccaccatttccaaatccttgcagagctgccgaagcgcggatcacagatgaagaggcaatccaagaggcccaccgccagccgcgaatccccagaaacaggggagaagcagaagctggcgttcgcggaggaagaggccccgccggcgcggaaggtggagcccgacgacgaggccgagatggacgaggacgaggacgagctgggcccgggcctgggcggcgggcgcgcggcgcggtcgccgtgcgggctcggggagaagaagcggcgcctggcgctggagcaggtgcgcgcgctggagcgctgcttcgagacggacaacaagctggacccggaccgcaaggcccgcatcgcgcgcgacctcgcgctgcagccgcgccaggtcgccgtctggttccagaaccgccgcgcccgctggaagaccaagacgctcgagcgcgacaaggacgccctcgccgccgagataagggagctgaggcagaagctgctgcccaagccggaagccacggtgaagctggaggcgacgacgggcaatgacacggcggaggagcgccgccaggcgacggccggcgcgccgcccgcgggggcctgcaaggacggctcctcggacagcgactccagcgtggtcttcagcgacgtcgaggcgtcgccctactccggcggcgcggcgttcgagccgccggccttggccgggctcggcgcgccgttcctggacacgtcggtggcgccgacgggctgctcgtctccccccgttttcgtcgagaccaagtggcagcagcacgggccgacacagtacccgttcccattcgactcgtacaaggcctgcgccggctatggcttcacggaggaatggctcgccagctcggacctcatcggcagcgacggcggcgcggcggggttcttctccgaggatcacgcctccagcctcaacttcaactggtgcccgagtggcatccagggctgggagtgaagaggggtttttgatctgcacggctagtgtaaaaaaaccgatgttacggtggcatttgtacatgcatggaactggagtctagtgacctggcctggcgagtgtggtgtggccaaagctagaggacatccagcgcaaaaggcgggaacaggagcagtagtagcctgtaacaataacggaataacttgagccaggctagtaaaaaaagaggatgtaaatgtaaaaagaggctgtcgcacc

SEQ ID NO: 1644 - DNA, 1531 bp, Zea mays
  Clone ID: PAT_MRT4577_178190C.1
agtcgtttgcccctttggtccctctccctcccccgtccgccctgcactctccagctcaacaaggaagaagagggggccttcaccacaccactcgattcctctttagagcacgacttacgaagagtgcccaggccgtcgccgccgaccagcaaaagggctggaaagcccccctcttttgtgctgtgcgtgcaactcggctcctgccctgccatcttgctttccaagacccctgcgcccccagtcccataattagttaggattaggatcaccaccatttccaaatccttgcagagctgccgaagcgcggatcacagatgaagaggcaatccaagaggcccaccgccagccgcgaatccccagaaacaggggagaagcagaagctggcgttcgcggaggaagaggccccgccggcgcggaaggtggagcccgacgacgaggccgagatggacgaggacgaggacgagctgggcccgggcctgggcggcgggcgcgcggcgcggtcgccgtgcgggctcggggagaagaagcggcgcctggcgctggagcaggtgcgcgcgctggagcgctgcttcgagacggacaacaagctggacccggaccgcaaggcccgcatcgcgcgcgacctcgcgctgcagccgcgccaggtcgccgtctggttccagaaccgccgcgcccgctggaagaccaagacgctcgagcgcgacttcgcggcgctgcgcgcgcgccacgacgccctccgcgccgactgcgacgcgctccgccgcgacaaggacgccctcgccgccgagataagggagctgaggcagaagctgctgcccaagccggaagccacggtgaagctggaggcgacgacgggcaatgacacggcggaggagcgccgccaggcgacggccggcgcgccgcccgcgggggcctgcaaggacggctcctcggacagcgactccagcgtggtcttcagcgacgtcgaggcgtcgccctactccggcggcgcggcgttcgagccgccggccttggccgggctcggcgcgccgttcctggacacgtcggtggcgccgacgggctgctcgtctccccccgttttcgtcgagaccaagtggcagcagcacgggccgacacagtacccgttcccattcgactcgtacaaggcctgcgccggctatggcttcacggaggaatggctcgccagctcggacctcatcggcagcgacggcggcgcggcggggttcttctccgaggatcacgcctccagcctcaacttcaactggtgcccgagtggcatccagggctgggagtgaagaggggtttttgatctgcacggctagtgtaaaaaaaccgatgttacggtggcatttgtacatgcatggaactggagtctagtgacctggcctggcgagtgtggtgtggccaaagctagaggacatccagcgcaaaaggcgggaacaggagcagtagtagcctgtaacaataacggaataacttgagccaggctagtaaaaaaagaggatgtaaatgtaaaaagaggtgtcgcacc

SEQ ID NO: 1645 - DNA, 614 bp, Zea mays
  Clone ID: PAT_MRT4577_178214C.1
gtcgatgacaagcctctagtgtgattcatcttaaagctcctgttaagatatttggagatttacacggacaatttggagatctgatgaggttatttgatgaatatggtgctccttcgactgcaggtgacattgcttacattgattatctattcttgggggattatgtagatcgcggccagcatagtttagaaactatcactcttcttcttgcattgaaggttgaacgtcctcgtggtgtgaatttgattcgaggaaatcacgaagctgcagatatcaatgctttgtttggtttccgaatagagtgtatagaacgaatgggcgaaagagatggtatctggacatggcatcgaatgaataggctatttaattggcttcctttggctgcgcttatagaaaagaaaatcatctgtatgcatggtggcatcggtcggtcaatcaaccatgtcgagcaaattgagaatcttcaaaggccaattacaatggaagctggctcggttgttctcatggatcttctatggtctgatccaacagagaatgacagtgttgaaggactgaggcccaatgcccggggtcctggtcttgttacatttgggcctgatcgggttatggagttc

SEQ ID NO: 1646 - DNA, 2012 bp, Zea mays
  Clone ID: PAT_MRT4577_178226C.1
gcggcgacacgccagggcggagagcacacaccgaagcgggccgcggcggcggcgcaggcgcaggcgcttacatgggagtagaggcgggcgggtgcgggcggagggcggtcgtgaccgggttctacgtctggggctgggagttcctcaccgccctcctgctcttctcggccgccgccgccgccgcagactcttactagctagctagccaccttcttcctcctcctccttgtaggtagtagtagtagtaggctacacaacaacgaccacatatatatatacatactaggtactactagcaggcgagcgagattcgtgcagtaattaaggccgcagccagttaataataattagtcgtcggcgagcgagagagatggtggaggaaggcgccaccgcggcggcgtcgaggagcgggccggcgccgttcctgagcaagacgcaccagatggtggaggagccgggcacggacgaggtgatctcgtgggcggagcagggccgctccttcgtggtgtggaagcccgtggagctggcgcgcgacctcctcccgctccacttcaagcactgcaacttctcatccttcgtccgccagctcaacacctacggtttccggaaggtggtgccggaccggtgggagttcgcgaacgagaatttccggcgaggcgagcaaggcctcctgtccggcatccgtcgccgcaagtcaacgacgccgcagccatccaagtacggcggcggcagcgtcgtgaacaccgcgttccctccgccgttgccctttccgcctcccgcgtcggtcaccacgtctggcggtggcggtggtgctggcgctggcaacgagcgcagctcctcgtcggcatcgtcgccgccacggaccgacgacctgaccagcgagaacgagcagctcaagaaggacaaccgcacgctgtccaccgagctggcgcaggcgcgtcggcactgcgaggagctcctgggcttcctctcgcgcttcctcgacgtccggcagctcgaccttgggctgctcatgcaggaagacgtgcgagcgggtgccggtgacgacgccgcgccgcgccgcgcaatggtcagccagctggagcgcggcggcgaggaggggaagagcgtgaagctgttcggcgtactcctcaaggacgccgcaaggaagagggccaggtgcgaggaggcggcggccagcgagcggcccattaagatgatcagaatcggcgagccgtggatcggcgtcccgtcgtcgggcccggggcggtgcggcggcgggaattaagtaaggtatggttggaactgatgcgccacggccggccgtgtgacagctttattacagcgagcgcatgttcgagtcgtggatgctttttgtgcgtgtttgtatttgtcatccaaggtgaggttgatggcaaggataattccagtgctgtggtaaaactgtgaaggcagaacacagggcacaggagataaccgtaacgcatgttaaaagttaattatgggatgctttggaggtagcaagattgaaagtagggaactagggatgaccggatgagtagacggtctagaaagacaagcccatatgtttggaatggaatattatcgtttttatatgttttgttaatctgttaaaaaaaaaaaaaaaaaaaaaaaaaaaaaaaaaaaaaaaaaaaaaaaaaaaaaaaaaaaaaaaaaaaaaaaccaaaaaaaaaaaaaaaaagggggccttggacctcaagtttttgttccttttagggggggtaaatggccccttgggggaaataagggcaatagttgttccctggggaaaatggttttccgttcaaatttccacaaaaaatccgacccgaaagcataaagggaaaagcctggggggcctaaggggggacctacctaactttaatggggtggggctcattgcccgttttcaagtgggaaaccctgtgggcccagttgatttaaggattgggccaccgcgcgggaagggggggttggcgtatggggcgtttttccgtttcttggttaattga

SEQ ID NO: 1647 - DNA, 449 bp, Zea mays
  Clone ID: PAT_MRT4577_178395C.1
aaccatacaggggcgtcatgagctcattcaatgctgggaccatccggcgtgtgttgggtcccgcctccgacccataattgaccagtcctggtcctacccatatgtacgattgcttactccctagcgccatcagcttcctcaagccagcggcgaccatgatctccccggacaccatccgaacggccatcgtgcgaatcagcaatggaactgcacgttgtgctcttcctctgcccagtgcctacgttcatccggatctggaagaaagggtcgaaggagcaatactcgccgatccagtacgtggggacgctgttgaactgcatgatgtgggtgctgtacgggctgacggcggtgcacccgcacaggatgctggtgatcaccatcaacggcgccggcatgccgatgcagatgacctacgtggcgcacattctgctctactcggaggtggctgc

SEQ ID NO: 1648 - DNA, 112 bp, Zea mays
  Clone ID: PAT_MRT4577_17855C.1
gcaggaatgataactgaatttgtcatctcttttgatgaccggtatctctactttgtaaattggctgcatggcgatattaagcagtacaacattgaagatcccgcaaagcctt

SEQ ID NO: 1649 - DNA, 697 bp, Zea mays
  UNSURE (1)..(697): unsure at all n locations
  Clone ID: PAT_MRT4577_178582C.1
  unsure (1)..(697): unsure at all n locations
caggccgatttcgggcggcttgaaatcgagctggccgaagttgaaatgcctggtctcatggcttgtcgtactgaatttggcccttcacagccatttaaaggtgctaagattactggatctttacatatgaccattcaaactgcagttttgattgaaacccttactgctttgggtgctgaagttagatggtgttcttgcaacatcttctccactcaagatcacgccgctgctgccattgcacgtgacagcgccgccgtgttcgcgtggaagggtgagactctgcaggagtattggtggtgtactgagagggcacttgactggggtccaggtggtgggcccgacttgatcgtcgacgatggtggtgatgctacactcttgattcatgagggtgttaaggcagaagaagagtttgctaagaatgggacaatcccagatcctaactctaccgataatgctgagtttcagcttgtacttactattattaaggaaagtttgaagactgatcctttaaaatataccaagatgaaggaaagactcgtcggtgtttctgaggaaactaccactggagttaaaaggctttatcagatgcaggctaatggaactttgcttttcctgctattaatggtaatgatctggtacccaagagcaagttcgacaacttgtacngatgccgccctcactggccgatggctcatgc

SEQ ID NO: 1650 - DNA, 292 bp, Zea mays
  UNSURE (1)..(292): unsure at all n locations
  Clone ID: PAT_MRT4577_178635C.1
  unsure (1)..(292): unsure at all n locations
attatttagaccaactagctttttttaaagcacaatagngtaccaacactgccggttaaaatattttgcctccttatgctccttggtatttctgcaagtgctgctacggcgaccattttccctcaatgctcacaagctcctatagcttcccttctttccccgtacctcttaccagctgtgttttctttatgttaaaacccaattctttaaccctacatgatctaactgtcatatcgtaattggcatattacctttatcacccttgttccttcaacaatcattatccctatta

SEQ ID NO: 1651 - DNA, 1948 bp, Zea mays
  Clone ID: PAT_MRT4577_178810C.1
ccaccacttgtaatattattattaccttgtaaaacaccattcacatttatgaataaaaatgttgtactagatagaattatagttgccatcacaagtcagataacaaccgactctgagaacagcctagcaaacaaacggctgtctgaaacaagcaaacataaaaaagcctagcgaatgtcagactcgccttccatcgccacttcccctaaagcaagcaataggcaaacacggataaagtagccttcgttcacttgcagatctcctctgcgggtggacgcagcgcgacccctccgaactgctcgctggaatacttcttgtatacaaccctcagcttgctctcaggggcagtcgagtgcgcgatcaccagcatcttcgtgcattcaatgagctctggcctctgactgccctgaagcccgtgtggtgcttgagggtgtcggtccaaaggggagcccctcttgagagtgagtctggctgcgtagacagcagaagcagcgaccagcgatggcaggcgcgtcaccaaattcgtattgcatcagcgccaattcagcgaagaagaacaccatattctccatctctttctcaactttgccgcccaatgttgcgggccttcagaaaacggacaaggaacatatacactgtagggacagtcaggttccactccagcctattcagaattcccttctccatcgaaagaatctgttctctactgtatgcactgtctgatatgaggatgaagtcgttcacctctggggcccaaatctcctcgtacttgcaggcgatcagcatagatgaaacgccgacaagctgcagctccttacgcaggactggttgcagcgagaggtactgatcgatgatgtacatggtcaggtagagagtttcgggcatcagttcaaacttgtggtgtacttcgattatccaatcagccaggatagccctcatcttagagttgatctcgagttgggcgtcgatgtagtcacatggccgtctctcgtgctgagcaatcttgtagaacgtgtagatgtcctcaatgtattccaccaccgcgagctcattgttgacgtccagcttgtcgatgtcatcgaccacttgtctaggcttaccagcgattccacaggcagcctttgagcgagccgagagcacggaagaaagggtgttgatggccttcctcctggagcggacggagctagcgctgctctcggactgcgccctgctctgttcagaatcggagctgagtactatgatatcctccggcggcggttgctgcttgacaggagccttcctctcctgcctcggcgcatgcctcgcaggcaggattgcggcattcttgattgcggccttcgcctgcgctttcttgacgagttgagcgccgaagcttctagtgatggggcgattgacctgctcctgcgggttccctgtggctgggcggacgctgacgaggttgcctatatcgccgagagggggtcgccggttcagagcgtcagctcgggcgggcacggccttggtctttccaagagcgggaacaccggctcggttgtgatggtgaagctgcggagcggcggcgttgtggttgcgcgaggccatctcttggtcctcgtcctgatcggcctggccgaagaagaggcccgagagcacggaggcgaagaaagactggaggcgcgcagcccgcgacccctcttccccgccggcgagcgcagccaccgcgtatcggcaaagcaacagcggcggcaacaagaagcgtgatgggtggtcgggtcggtcaaggtcaatcgatggcggcgcgtgatgggtacagttcttgaggggggacgaggagaggctcgtcccagcacaaaggcaacaagaagcgttttcttgccccctttcaccctctcttctcctctctcccagtccctgctcaatcaaaggcggcgcgtgatgctacagttctcgaggagaccgggcgcctggg

SEQ ID NO: 1652 - DNA, 306 bp, Zea mays
  Clone ID: PAT_MRT4577_178846C.1
gcgctctgcttcacctcactaacaccttctagctactctcactgtactgcaacaatgggcgctgggtcctcctgctcgcaggctcagatcgtcacggccgtggctgtactcgcagcggtgctgctgctgctggcggcgggggtcgagacggcgtttgcggcggtgagcagcggcgaggtgacgtcgtcagtagcgccgtgcctcgggtacgcgatggacatcgcggagacgccctccgcggcgtgctgcaccgaggagcgctcgctgaacagccgcgcgtcgtcaacggcggaccggcaggccacc

SEQ ID NO: 1653 - DNA, 356 bp, Zea mays
  Clone ID: PAT_MRT4577_179029C.1
aagcacaatagtgtttcatttctggcagccaaaatattctgcttgcttatgctccttggtatttctgcaagtgctgctaccgtaaccattttcccacaatgcttacaagcttctatagattcctttcttgcggcatacctctcaccagcggagtctttagtgtgcgaaaactcaatatcttcaaccgctacaggatgcaacaggccaatcgcagcatgcatgttacctttatcacccttgttcctcgcaacaaccgtcagccctatgtacaggagttacctttgcggcatttgttggcacacatcatcagggcacaacaactacaacaacttgtgctcggagaccttgctggctac

SEQ ID NO: 1654 - DNA, 212 bp, Zea mays
  Clone ID: PAT_MRT4577_179182C.1
gctgcgcataacgctggcacgctcttacaactgcaacaattgctgacattcaagcaacttgctttggcatacccaacaacgttctacgcaacaacccatcattggcggtgccctcttatcgattgcttatgcgttatagttcaataatgaagtttattggatgatacttgtagcttcccagaaatgtactttctatatatctgggaagccac

SEQ ID NO: 1655 - DNA, 345 bp, Zea mays
  Clone ID: PAT_MRT4577_179244C.1
cccacgcgtccgttggcttctcctcccactccgtatcgggttcgggttcgcgaggttctgcggtgtatcatttcaagggtgagcggatcgagatggcaacgtctgatgtagagtaccgatgcttcatcagcggactctcctgggccacggacgaccactccctccacaactccttcagcacctacggcgaggtcctcgagtccaagatcatactcaatcgcgagacgcataggtaccacagcttatgctacgtcaccttctccactgaggaggcgatgctgaacgccatcaagggcatgaactgcaaagagctggacggccgtaacatcaccgtcaactaggccc

SEQ ID NO: 1656 - DNA, 257 bp, Zea mays
  Clone ID: PAT_MRT4577_179465C.1
tactttcttattctgggaaaccacaaacacatccaaaaaacttcattattgaactataactcataagcaatctaaaagaggcaccaccaatgatgggttgttggtagaacactgctgggtttgacaaagcaagttggatgaatggcagcaattgatgcagttgaaagagggtgccagcgctaggcatagcgcgaaggtagaacggaaacaactgaagatgagccaagaaggcaatagggctgacatgaggctagctg

SEQ ID NO: 1657 - DNA, 1674 bp, Zea mays
  Clone ID: PAT_MRT4577_179630C.1
cattgggtacctcgaggccgggccgggagtaggttaaagcgacgccgccgccgcaagccgtccgccttgcccctcgaaggcttggtcctcctccttgtatcccgacctcccccgcgacagacccgtttccccgctaggctagagttatcgttcctctgcagcgatggcgatcaagcggaccaaggcggagaagaagatcgcgtacgacaagaagctgtgcagcctgctcgatgagtacaccaaggtgctcatcgccctcgccgacaacgtcggctccaagcagctccaagacatccgccggggcctcaggggcgactcggtggtgctcatgggcaagaacacgctcatcaggcgctgcatcaaggtctacgccgagaagaccggcaaccacacctttgacccgctcatggacctgctcgtcggcaacgttggcctcatcttcaccaagggagacctcaaggaggtgcgcgaggaggtcgccaagtacaaggttggggctcctgctcgtgttggtctggttgctcctgttgatgttgtcgtgccccctggcaacactgggctggatccctcccagacctctttcttccaggtgcttaacatccccaccaagattaacaagggtactgtggaaattatcacccctgtggagctgatcaagaagggtgagaaggtgggctcgtccgagtctgctctgctcgccaagctgggcatccgccccttctcgtacggtctccaggtcaccagcgtctacgaggatgggtctgtgttcagccctgaggtgcttgacctttctgaggaggacctaatcgagaagttcgccactggtgtctccatggtcgcttctctttccctggcattatcgtacccaacccttgctgctgtgccccacatgtttatcaatgggtacaagaacgtgcttgctgttgctgtggagacggactactcgtacccacacgccgacaagatcaaggagtacctcaaggacccgagcaagtttgctgttgctgctcctgtagctgctgcggactctagtgctgctgctgcccccaaggaggaagagaaggctccagagcctgccgaggagtcggacgaggaaatgggcttcagcctgttcgacgactaagccgctcttatcgtccatccgccgcaagttttgcttctgcttattattttagtgcattatgttttagtagacaaaccatgttggtgtaattgacaatgttatctccttaaatgttgaaagtgcccgtgttgtgtcacttgttattggtttcttgagctagtttggttctcttctcttgtgaaaaagatgtctcccgtaaagacacctcttcaagtaatctcatctaccacaagacatcttttaaagcaatgtgttagacttagattagttaatcatgtaaccaaagggtatgtactttggcatggatggcagtgaactttgttaggattggatggcttgaaattcagaacatctgataatcgttaggaccagctaacggcttagctaactaatgttcttcatggaaatgttgcagcctattccatgtggaaaggattgatgaagaagatgcaacatgcgaggatgaacgttgagattcgtaattttttttaatttagtgcactttgtatcaaattttgtatgaatttatattttatttatgaatatatatt

SEQ ID NO: 1658 - DNA, 1362 bp, Zea mays
  Clone ID: PAT_MRT4577_179632C.1
ctgtgcggcgctcgaggcggcgttccggaactaaaaaacacggccgcagtcgtttatcagctaggttaaagcgaggccgccgccgcaagccgtccgccttgcccttcacgaaggcttggtcctcctccttgtatctccactccccccttcacagatccgttcctccagctagggttagcgttcctctgcagcgatggcgatcaagcggaccaaggcggagaagaagatcgcgtacgacaagaagctgtgcagcctgctcgatgagtacaccaaggtgctcatcgccctcgccgacaacgtcggttccaagcagctccaggacatccgccggggcctcaggggcgactcggtggtgctcatggggaagaacacgctcatcaggcgctgcatcaaggtgtacgccgagaagaccggtaaccacacctttgacccgctcatggacctcctggtcggcaacgtaggcctcatcttcaccaagggagacctcaaggaggtgcgcgaggaggtcgccaagtacaaggtgggggctcctgctcgtgttggtctggttgctccagttgatgttgttgtgccccctggcaacactgggctggatccgtcccagacctctttcttccaggtgcttaacatccccaccaagattaacaagggtaccgtggaaattatcacccctgtggagctgatcaagaagggtgaaaaggtgggctcgtccgagtctgccctgctcgccaagctgggtatccgccccttctcgtacggcctccaggtcaccagtgtctacgaggatgggtccgtgttcagccctgaggtgctcgacctttccgaggaggacctgattgagaagtttgccactggtgtctccatggttgcctccctgtcactggcgatctcgtacccgacccttgctgctgtgccccacatgttcatcaatgggtacaagaatgtgcttgctgttgctgtcgagacagactactcgtacccacatgctgacaagatcaaggagtacctcaaggacccaagcaagtttgctgttgccgccccggttgctgctggggactctggcgctgcagctgctcccaaggaagaagagaaggctgcggagcctgaagaggagtcggacgaggaaatgggcttcagcctcttcgacgactagagctgctgttttcgtcaaactgctgcaagttttggctttttttttttatcatctacaagtactgtttcctatattttttagcagacaaattatcgtgtgtaatcgacaatgatatctccttaaattttaagtacctgtgttgtgtcaaaaaaaaaaaaaaaaaaaaaaaaaaaaaaagaaaaaaaaaaaaaaaaaaggcccctagggcc

SEQ ID NO: 1659 - DNA, 1318 bp, Zea mays
  Clone ID: PAT_MRT4577_180097C.1
tggcgtccgcccaaccctccaaaccaacgccgccaggccccttcccggggtcctcgacgcggccccgcaactgcagatccccaattcgtttatttcttcccaccgagccaagctgcgacgacggcggtcgcagcgtcgccttccctccctccgtaccgccgacgccgacgagcatattgggccgagcgcccgagcacctctcctgtcagcagcggcactcgccattccaagtacgaggtcgacgcgctgtggggcttgctgaaacaggtctacccccaagtgaaatcagggtcttcaagatagcttactgagatgtggggttttgcatcaaacgcttgggcagctgggctggagaagaggagttccccaaaccgcacttcctcgagtgctgcttattctgacgacgaagcatcctcgtgcacaagcagggaagaaggcctggagtgcccgatatgttgggagtctttcaacatagtggagaatgtgccttatgcgctatggtgcggacacaccatgtgcaagaactgcatcctagggcttcaatgggccgtcatcaaagtcccaaccgtgccgatccagctaccgttcttcatctgctgtccctggtgcaacctcctgtcgccccgcgtactttacaagggggaacctcacgttcccacgaaagaactatttcctcctctggatggtcgaggggatgaacggcgagcgggccagatcacgcccagctattcgcagcgagcagcatactccgtggctctcaagcagcagcagcgtgggcaatggaaatgcaggctgttcaaatcccactcgacgccacctcccgccaccatcggttgacacttcgcccaccaacgcaaatcatgccaaccacggggggtcccctctgctgaacgcagggagggtacaagcttcgctgcgcaagtccctgtcgttcctggtccacctgactgccaagtttcccctggtgttcgtcttcctcctcatagtgctgtatgcgatcccagccagcgcagcagtcttgttactgtacatccttatcactgtgctgttcgcgctcccctcgttcctgatactgtatttcgcgtatccgagcctggactggcttgttagggaaatctttgcctgagatttccttgttcggtaaaatctcaatgctgttgttgagtccttgtataactgaactttccctagatcttgttgcaagcgtggatgctattgcaaagttttggtttttacaccatgagatgtgtttaaaaaaaatcaataaagattttgttgcaagtgttgaagttattgccaaaaaaaaaaaaaaaaaaaa

SEQ ID NO: 1660 - DNA, 418 bp, Zea mays
  UNSURE (1)..(418): unsure at all n locations
  Clone ID: PAT_MRT4577_180119C.1
  unsure (1)..(418): unsure at all n locations
tgccattgaaaatgcgaaaacgatggggctatgcaacnccggtcaatccgttgtggccttgcaccgcatcggaatttcatccgtcatcaagctcctgactgtaaagtaagggtccaagggggagggacaccattttgcttggtgaatttttgtgaggctgcttacgcacatcagcgtatccacagcttttctgttgccaaaaaaacagactttgcgttctggtacaccttggtgttacaaggttgtgggaatttgtcgtttagatattagcgatttaaacagtttatcaactgctatagctaattaatttgcagctgtgctgcaactttatcgtactgaaaattttatgtttgtttcacatgcttgcttgttgattttatttcgtttggcaaaaaaaaatttcttgtttggttcagcg

SEQ ID NO: 1661 - DNA, 2139 bp, Zea mays
  UNSURE (1)..(2139): unsure at all n locations
  Clone ID: PAT_MRT4577_180122C.1
  unsure (1)..(2139): unsure at all n locations
aaaggccttggcagtggcggcactcagcattgggatgacacccgaagaaggcacctcgaggccggccgggccgggaaaattccgtccacagaagaagaatccttctcgacgccgcccccattcattcttggagggcaagaagaacgcgcagtccaaaagcgaaacaaggggaaggggcgaggcagccaaacgaatcccagcacctgcctctcctttgcttgcgcagatctagcgatggcggcgggcggtgagttggcgtggggggaggagcccgtggcgcggcgccggcctaagaccaagatcgtctgcacgctcggcccggcgtcgcgatccgtcgagatgatctcgcgcctgctgcgcgccgggatgtgcgtcgcgcgcttcaacttctcccatggctcccacgagtaccaccaggagacgctcgacaacctgcacgccgccatggagctcaccgggatcctctgcgccgttatgctcgacaccaagggtccagagattagaactggatttttgaaagatgggaagcctattcaattgataaaaggccaagaaatcacaatttctacagactatagcattcagggtgatgagaaaatgatatcaatgagctacaagaagcttgctgttgatctgaagccaggcagtgtcatattgtgtgctgatggtaccatcactcttactgttcttcactgtgataaagaacaaggcttggttcgctgccgctgtgagaacactttcaagcttggcgagaggaagaatgttaatcttccaggagttattgttgatctccccacactcacagacaaggacaaggaggacatccttaaatggggtgttccaaacaagattgacatgattgccttgtcatttgttcggaagggttcggatcttgtggaggttaggaaggtacttggtgagcatgccaagtccataatgctgatgtcaaaggttgagaatcaagagggagtagctaactttgatgatatcctggcaaactctgatgcttttatggtggcaagaggtgatttaggaatggaaattcctatagagaagattttctttgcacagaaggtgatgattttcaagtgcaatattcaaggcaagcctgttgtgactgcaacccagatgttggaatctatgatcaagtctcctcgccctactcgggcagaagcaacggatgttgcaaacgcagttcttgatggcacagactgtgttatgctcagtggtgagactgctgctggggcttatccagagttggcggtgcagactatggctaagatctgcctgcaagcagagtcttgcgtagaccatgctgctattttcaaatcaatcatggcttcagctccaattccaatgagtccattggagagccttgcatcatcagctgttcgcacagcaaactctgccagggcagcacttatcttggtcctgaccaggggaggaactactgctaggcttgtagccaagtataggccatccatgccgattctgtccgttgtggttcctgagctgaagacagactcgttcgactgggcctgcagtgacgagggtccggcaaggcacagcctcattgtgaggggtgtcatcccaatgctgagtgccgccactgccaaggcctttgacaacgaagccactgacgaagctattggttttgccattgaaaatgcgaagacgatggggctatgcaacaccggtcaatccgttgtggccctgcaccgcatcgggatttcatccgtcatcaagcttcttactgtgaagtaggggtccaagggtgagggacaccattttgcttggtgaatttttgtgaggctgcttacgcacatcagcgtatccacagcttttctgttgccaaagatacagactttgcgttctggtacaccttggtgttacaaggttgtgggaatttgtcgtttagatattagcgatttaaacagtttatcaactgctatagctaattaatttgcagctgtgctgcaactttatcgtactgaaaattttatgtttgtttcaaaaaaaaaaaaaaaaaaaagcccaaaaaagaaaaaaaaaaaaaaaaaaaaaaaaaaaaaaacatgcttgcttgttgattttatttcgtttggcaaaaaaaaatttcttgtttggttcagcgnaatc

SEQ ID NO: 1662 - DNA, 427 bp, Zea mays
  Clone ID: PAT_MRT4577_180243C.1
tctttaacatgacaaagcacaaatagtggccaccaacaatagtgcagtacaaaatattggagccgccttatgctccttggtctttctgcaggtgctgctacagcaaccatttgaccgcgaatgctcgcaagcgtctatggcttccatccttcccccatacctgtgaccagcggtgtcttctgtatgtgaaaacccaattcttcaaccctacaggatccaacaggcaatcacagactggcatattacctttatcacccttgtacctccaacaatcatcagccctattacatcagttacctttggagcattgatagggacaaaacatcatggcacaacaactacaacaacttgtgctagaaaaccttgctgcctactctcagcaacagcagtttcttccattcaaccaactagctgcattgaactctgc

SEQ ID NO: 1663 - DNA, 790 bp, Zea mays
  Clone ID: PAT_MRT4577_180294C.1
ccagcccagccttgtctgcgtctcctcctcctttccccaacccagaccaggagcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatgagggcagcgatgaggacgaggacgatgacgagtgaagaagacgcatcttgtcaaggctgctccggcggacaagtcgggagctgctgtgcgagaacggacctgagctgtgtgcggtggtgtcataaggagcctatccatctccactagaattatcccaagtttcacttcacatcgtgatgttgttttacctttttcctgtcattgtcctgctataacggatagcgctccctggtggcgccgccgccg

SEQ ID NO: 1664 - DNA, 581 bp, Zea mays
  Clone ID: PAT_MRT4577_180318C.1
tcatccacgcgtccgccgcgcgcgtgcggcttcttgctgccaaagcattccctcccctagccgttggcttcgtcgctcgtctccctgtgaggtgccgggagggaggaactggccgagtcctaagtggagaatcggccttttcttgtctcaccccggggtttgctgcgtctggtggtggtgaatgggagaaatccttgacatctgtgccggatcaggcgtgctagctcggcaatcaggggtttcacacatagctttcgctgcttggaatttgatgtactaatggagtctaagggtggttaaaatgttaccattactcgtcgtataatgtatgaagcttcccttggctacagcattgaggacgttcgacctgccggaggcgtgaagaatttccagtctgttggttactccaactgcgcgaggaagccatcctgatatcccttttggatttctcattctagcagtgtaggatttcttttgtgacacctttgattatgaccaatctctctggtctgctgcttcctgattattgaccagttacacatccttgctccttgcactcactcgtccatgtccagcattgt

SEQ ID NO: 1665 - DNA, 2068 bp, Zea mays
  UNSURE (1)..(2068): unsure at all n locations
  Clone ID: PAT_MRT4577_180468C.1
  unsure (1)..(2068): unsure at all n locations
cccccccccccccctccccttcttctctttttctttttcccttcctcccccaccnattgtggtacccggtcgacgcccgcatagcctcctcgtctcctcgagaactgtagcatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtctttcttcgcctccgtgctctccgggctcttcggccaggccgaggccgaggacgaggacgaggacgaagagatgcccacgcgcaaccacaacgctgccgcggctgccgctccgcagcatcaccatcacaaccgaggtggtgctcccgctcttggaaagagcaaggccgtgcccggccgagctgatcccatgaaccggcgagcccccctcggcgatattggcaacctcgtcagcgtccgcccagccgaagggaagcctcagctgcaggagcagatcaatcgccccatcacgcgaagcttcggcgctcagctcgtgaagaacgtgcaggcgaatgccgcaatcaagaatgccgcaatcctacccgcgaggcacgcgccgaggcaggaaaggaaggctcctgccaagcagccgcctcctgaggatgtcatagtactcagctccgactctgaacagagcaggacgcagttggagagcagcgctagctccgtccgctcgaggaagaaggtcatcaacaccctttcttctgtgctctcggctcgctcaaaggctgcctgtggaatcactgataagagacggcaagtagtagtgatcgaagacatcgacaagttggacgtcaacaatgagctcgcagttgtggaatacattgaggacatctacacgttctacaagattgctcagcatgacagacggccatgtgattatatagacacccaagtcgagatcaaccctaagatgagggctatcctggctggttggataattgaagtacaccacaagttcgagctgatgccggaaactctctacttgaccatgtacatcatcgatcagtacctctcgctgcaaccagtcctgcgaagggagctgcagctggtcggtgtttcagctatgctgatcgcctgcaagtacgaggagatttgggccccagaggtgaacgatttcattcttatatcagacagtgcatacagcagggagcagatcctttcgatggagaagggaatcctgaatagcctggagtggaacctcactgtccctacagtatacatgttccttgttcgttttctgaaggcggcagccttgggcaacaaagttgagaaagagatggagaatatggtcttcttcttcgctgaactggcgctgatgcagtacggcttggtgacgcggctgccttcgctggtcgctgcttcggttgtctacgcagccaggctcactctcaagagggctcccctctggaccgacaccctcaagcaccacacgggcttcagagagtcagagacagagctaatcgagtgcacgaagttgctggtcagcgcacactcgtcgtccgccgctgacagcaagctgaggtctgtatacaagaagtattccagtgagcagttcggaggtgtcgcgcttcgcccacccgcagccgcagtggagatgaagtaaacgaagataacttcgtgctacaagtaaacgaagataacttcgtgctagtgtttgttagtataatgtaatggaaggcgagcctgacattcgctagggtctatccgtctatgtttgcttgtcggggtagtcaagaaagtttgaatgcttgaggcagccgtttgtttggtaggctgttctcagagtccaggtgttatctgacttgtgatggcatgttgtgtttcatgtgatggatatcattagaatcctaatctagtacgatatctattcatgaatataaatggtatttattcatttgttcataaaaaaaaaaaaaaaaaaaaaaaaaaaaaaaaaaaaaaaaaaaaaaaaaaaaaaaaaaaaaaaaaaaaaaaaaaa

SEQ ID NO: 1666 - DNA, 444 bp, Zea mays
  UNSURE (1)..(444): unsure at all n locations
  Clone ID: PAT_MRT4577_18052C.1
  unsure (1)..(444): unsure at all n locations
gactttcttatttctgggaagccacaaacatcggacaaaaaactttattattgaactataactcataagaaatctaaaagaggacaccaccaatgatgggttggtggtagaacactgctgggtttgtcaaagcaagttggttgaatggcagcagggtggtgcagatgtaattttgtgtcagcggtaggcgcaacgcgctggnagaacggcaacaactgcggntgcgtcaacaaggtagcagggctcacaccagctagctggctgaatggtagtagcctgtgctgctgtaataagcaggagaggtcaatgctgctagatggctgaatggaagaaatagctgggggtaggcagcacgtagctggctgaaaggtagatgttgatggtgcgaacaagaagcagaggtcaatgaacctacctggttgaatggaagaaactgctgttgct

SEQ ID NO: 1667 - DNA, 1627 bp, Zea mays
  Clone ID: PAT_MRT4577_180546C.1
acggtggcagtactacgcagaacgcagcttcattgctctgaattcaacaggcggttcggaaaaacgagaccctgatcgacaagagttgaacacgctgacgcacgcacagtccggtagaccgagctgacatttgcactgtctagtaacggtgtcaacacagcagacaactggcgcacgggaaagggcacatagacgcacgcagcaacacggtgaacaaacaaaaaacctagggacaggacaggacaggacgaggcaacacagaaaaggaagaacacagaacgaaacgactggtctgctcaggccaccgatggagggagggaaggatggtcagctcgtcgacggccactcccggcggatgtcgaaggtgtagttgatctccaggtagcacttgcggtcgtcgtcgaggaacttggtcctggcagagtaggacccccgggcaaacattcccgacggggtggtgtcctccggcgtcacgtacgtgtagggctccagctgggggctgaacgtgccgagcatctccttggctctgtcaactttgagccccgtcttccagacggtgttggkgtagcggaggccggagacgatgttgttgctgacggagaaggtgaacttgagccggtacggggagccttcctttawggttaaccacacgcccyttccgttgggctccaccggcagcggcagcacgatgtcgggccgcccgggcgacaggatggacaggctcattatcttcacgtccggctccagcgtctctcccacggagttcaagtccacgccgccgaggagctgctccttccatcgccgcaggctctcgtcgtccttgtccttctcgagctgctccttgatgctgaccatgggaccgaggtcgatggccttgggggccttctcctcgtcctcctcgtcctcctcctcctcctcctcctccccgtgacaacgcggcgcgcacttgccgttgggcgccgtgtcgcagtgctccgcgggcggcgccgcttccttggccggctcccccggctccgggccggcggggacgtcgaccttggggcaggagatggcctccaccgccgacgacatcgtcgcacgcacgcgcgcgcagtggcttcggccttcggctagacaaggaaaggaaggagggcgggccggcggggagaggcgagcgctggcacagataccgagatgagcgcagcgaaaaggagagcgagcacgcagtcacgcacgagacgagtcgcgaggggaggggagagagggagggggaagcgaacacgtcgaggcggattatttcggacaggaggaacgggccgcggcgcaaggctccaaaaaaagaggccccgcgcgcacgccggccggacggcgaggggagattggtttgatactttgatccaacgcacgacgatggcagcgccagcggcagagaggagaggagaggagaggataggggggtgagccgtgagcggggggcgcttcgctttaattctcccccgcgtgccgcagggatgacggagaggagaggagaggagaggagaggcgacggagtggaggcaacgtgatgggcacgacccgacgcgccggcgccgcgctgcaacccctacaggtttacattggggactgcccggccggcctcgaggtaccc

SEQ ID NO: 1668 - DNA, 1844 bp, Zea mays
  Clone ID: PAT_MRT4577_180549C.1
ctcgagtttttttttctttttttttttggactccaaacaatatacttcgtttttttggccatttgtaacattgatcgcaaaaataggactcgaagcatgctacacttgatttcaatgctacagtcgaactctcgaagcacaacaggtcacgatcacggtggcattactacgcagaacgcagcttcattgctctgaagtcttaactcaacaggcggttcggaaaaaacgagaccctgatcgacaagttgaacacgctgacgcacgcacagtccggtagaccgacctgacatttgcactgtctagtaacggtgtcaacacagcagacaactggcgcatgggaaagggcacatagacgcaccgtgcgtcacgcacgcagcaacacggggcgtgttcggctggctacaagccgacactgttgcagctgtttggactgctgcagctgcaatccatagagagaaaaatactgtagaagccgcagccgcagccggattgcagccgcagcaagccgcagcgaacaagctgacggtgaacaaacaaaaaacctagtgacaggacaggacgaggcaacatagaaaaggaagaacacagaacgaaacgactggtctgctcaggccaccgatggagggagggaaggatggtcagctcgtcgacggccactcccggcggatgtcgaaggtgtagttgatctccaggtagcacttgcggtcgtcgtcgaggaacttggtcctggcagagtaggacccccgggcaaacattcccgacggggtggtgtcctccggcgtcacgtacgtgtagggctccagctgggggctgaacgtgccgagcatctccttggctctgtcaactttgagccccgtcttccagacggtgttggtgtagcggaggccggagacgatgttgttgctgacggagaaggtgaacttgagccggtacggggagccttccttgagggtgaaccacacgcccttgccgttgggctccaccggcagcggcagcacgatgtcgggccgcccgggcgacaggatggacaggctcattatcttcacgtccggctccagcgtctctcccacggagttcaagtccacgccgccgaggagctgctccttccatcgccgcaggctctcgtcgtccttgtccttctcgagctgctccttgatgctgaccatgggaccgaggtcgatggccttgggggccttctcctcctcctcctcgtcctcctcctcctcctcctcctccccgtgacaacgcggcgcgcacttgccgttgggcgccgtgtcgcagtgctccgcgggcggcgccgcttccttggccggctcccccggctccgggccggcggggacgtcgaccttggggcaggagatggcctccaccgccgacgacatcgtcgcacgcacgcgcgcgcagtggcttcggccttcggctagacaaggaaaggaaggagggcgggccggcggggagaggcgagcgctggcacagacaccgagatgagcgcagcgaaaaggagagcgagcacgcagtcacgcacgagacgagtcgcgaggggaggggagagagggagggggagggggaggcgaacacgtcgaggcggattatttcggacaggaggaacgggccgcggcgcaaggctccaaaaaaagaggccccgcgcgcacgccggccggacggcgaggggagattggtttgatactttgatccaacgcacgacgagaggagaggtgagcggggaggcgcttcgctttaatctcccccgcgtggcgcagggacggagaggagaggagaggcgacggagtggagacaacgtgatgggcacgacccgacgcgccggcgccgcgcccacgcgtccg

SEQ ID NO: 1669 - DNA, 226 bp, Zea mays
  Clone ID: PAT_MRT4577_180789C.1
ggcacctacacctatggcacctccacccatggccctgcacccatggcacctctacctatggggcctacacccatggcacctgcacctatggcacaaccctggtttggccactccagctagcttctgcgcttatgccacggacaagatcagcgtcgatgcgtaccttgcaagtggcatcattgggaaagggggagctaacataaaccaaatatcttacgtcacaggg

SEQ ID NO: 1670 - DNA, 311 bp, Zea mays
  Clone ID: PAT_MRT4577_18087C.1
accaacgattatcagatacggggggtcaacaagacaaaactgtttttggtaacccacattgccttaccccacgcgactacaccattatttttcagcaaaaggaaaaagatccttccctcccccttaggtgaagcgataaccataaggaaacctggtacgcgactgggtttttgataatgcatatgcctgccaaagataactgccaggcccttggtgcgaactttatatcacacaacggccccagggagctgcaagccgtgtgctggctgtctattaccggtagggggcaggcttgtagggaccctccttcg

SEQ ID NO: 1671 - DNA, 273 bp, Zea mays
  Clone ID: PAT_MRT4577_180924C.1
cggcggctacggcaactccgacgggaactggaggaactgagcggtggggcccgcgcgtgcaagttatcctgtgtgggtgccgtgatgtttaccctagtccagagggtttatcttcgttcgtgtcgtgtttggtgttgcccatctgggggtttgattggaagggcgctctgtgtcacttggtagtgctggggtcatcctcggtttcatcagacccatgcgttaaacaacatgggctgcggatcgatggatgctcttacccccgtctggctttat

SEQ ID NO: 1672 - DNA, 151 bp, Zea mays
  Clone ID: PAT_MRT4577_181067C.1
agcggctctcgcgggcgcgtcatgtaccggggagtcacaaggcaccaccagcacgggcggtggcaggcgcgcatcggccgcgtctccggcaacaaggacctctacctcggcaccttcagcacgcaggaggaggccgcggaggcgtacgacg

SEQ ID NO: 1673 - DNA, 648 bp, Zea mays
  Clone ID: PAT_MRT4577_181072C.1
ctcgaggccggccggggaaggaagttgcaagaagacgagcgtcaagtgaacctttaacttgcggggcgctggctgataccctgacggtgagggagtgatcgagctagctgagctccgatcctcgctaggtaggataccgccataccacaagactccttcacaagcttaggagccatggcaacaacagatcgatggcatctgccaccgtgctcaagtcctccttccttcccaacaagtgcgaatggatcgccaccaggcaggccgaccggtccagaccgcccaccggctccatggtgcgccgcgtctccgcctacgccgatgagctcgtgaagaccgcgaagacgatcgcgtcgcttttgttgtggcatcctgacgatggacgagtcgaacgcgaggtgcggtaagcggctggcgaccatcgggctggagaacacggaggccaaccgggaggcgtaccgcacgctgctggtcacgacgtcggccctgtgacagtacatctccggcgccatcctcttcgaggagacgatgtaccagtccgccgtcgacggccgcaagatcgtggacatcctggcgaagcatggcatcgtgccggggatcaaggtggacaagggtctttgtccgatcgccggctccacaacgagtcgtgga

SEQ ID NO: 1674 - DNA, 357 bp, Zea mays
  Clone ID: PAT_MRT4577_18114C.1
tttttcttctttttttttttttttttttttttttttgggggagggtcaacacaatgcttataataggcccatttccacacggtacaggggggaaggcgaataaaaataaaagcgacctttattcgttgggcattataacacaaggcattgcccgggaggaaacacagttaccggtttattccatgcccacttgacaaaaacccaaacagagaccacggttccgggtattaattgtccatggcgaccccaggcaactggaaaggggccccctcccggttgagctgctgcttgaacatccacttggggaagggggggaaaaagaactccttggaaccagtgtactggtggggggcgggg

SEQ ID NO: 1675 - DNA, 1336 bp, Zea mays
  Clone ID: PAT_MRT4577_181169C.1
ttgggtacctcgaggccggccggccctggccctctccttggcttttcctctcgctctcctcctctctcgcatcccaccgcatcacaaccacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatagtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggattgaatgttgaagaactccagcaattggagaagaacctggaatctggtctgcatagggtgcttcaaacaaaggatcaacaattcttggaacagatcaatgacctcgaacgtaagagtacgcagctggcagaggagaacatgcaactgaggaatcaagtatcccagatacccccagctggcaagcaagcagttgctgatactgaaaatgttattgctgaagaagggcaatcctctgaatcagtgatgactgcgttgcactctgggagttcacaggataatgatgatggttcggatgtatctctaaagttagggctgccttgcgttgcatggaagtaaacaggaaatgaggctccttgtcgattctgggtgtggatgtgggtgtgggtggagctgcggcctcagcggataggcacttgtgtatggttttatggacgaccggcccccgactacgtactgcaataatcttgcattggaagcgagatcggttaacctgatttgtcatccttgtggcttcatgatgcgatgttccgcttgtaccgtttgctagcatgttaactgaatttttagaatcgcatatacttttgttcttatatatcactgtcgtactgctcgtaagatgtatctactttattctatccaatgttgtaacctatcacctgccaacttccctactgttttggcgcgccgcaagctgtgctcaagcatgcttcatgtttgttat

SEQ ID NO: 1676 - DNA, 1444 bp, Zea mays
  Clone ID: PAT_MRT4577_181171C.1
cccacgcgtccggtctgcctttccctctcccagtttccgtttttttaatgctttgtttactcgcggggatcatggggtaatcgcgtgggccgtgcctggctgggtttatttatgccgacctgccaattggagcaaatcccctttcctgcccctccccctccgcctttcctctctctcgctctcctcctctcctctcctctcctctccttccgcatcacacaccacgactcccaaccgccggttggctttgctgctccgagctcttcctcttccacacccgccctctctcttgggtcggcggccgagtgtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcgaacaaaagagtacacaactggcagaggagaacaggcaactgaggaatcaagtatcccacatacccccagttggcaagcaatcagttgctgatactgaaaatgttatcgctgaagatgggcaatcctctgaatcagtcatgactgcgttgcattctgggagttcacaggataatgatgatggttcggatgtctctctaaaattagggctgccttgtgttgcatggaagtgaaaaaacaagatggtctgtgttgatctgggtggagctgcggcttcagcagataggcacttgtgttattgtcttatggacgacccccgactactgcaataatcttgcatcggaagcgagatcagttaacctgatttgtcatccttgtggcttcatgatgcgatgttgcgcttgtaccgtttgctaggatgttaactggactagaatcgtgtctacttttgtactgctcgtgaatcctatctactttgtgctatccaaagttatgacctaccacttgcatcggcatggcgcgccggccgtaagctgtgctcaagcatgcatgcttcgtgttatacgtgtgtacttattgggaagttgagtctgcatacaacctgagcgtagttgttgtcttacagagagaccgtttagttttc

SEQ ID NO: 1677 - DNA, 349 bp, Zea mays
  UNSURE (1)..(349): unsure at all n locations
  Clone ID: PAT_MRT4577_181187C.1
  unsure (1)..(349): unsure at all n locations
ggaaagccacgggcctggatccttttctttcgattttctcccggtttttaatttcactattctctactagggggggggggggggtggcccccccgatccaatcaagggccgtttcagcggggtgaataataacaacgataataatctactgacccccccaagtttttgggtnnntaatcatcgggggggatgctgcacccccaccaggagatcgagggggaatcggactcgtcgtcgtagtcgtcctcgtcgaagtcgtcgagatcgtcaaagtcccacagctcggcttgctcctcctcctcgggcatttgccactggttttgaaaaatctcgccggactccagtagct

SEQ ID NO: 1678 - DNA, 378 bp, Zea mays
  UNSURE (1)..(378): unsure at all n locations
  Clone ID: PAT_MRT4577_181204C.1
  unsure (1)..(378): unsure at all n locations
atgtcggcacnaggcaaggggggagcagcggcgggccgcacaccggaccagctcagctcagctcaccaagacaatcaatcatgggtcgtgcgcgcagtggcgctgccgctgcccccctcctcctgctgctcgccgccgccgcancggggctcgggtccgccgcgtcnccggcagccagggggggggtccgcaaggcttgccgcacgacgcantacccttcggggtgcgagcagagcctggggtcntacggcggggcgccgccgccacggagcccgcgggagcgggggcgcgccncgctntcngggagcgcggaccgcgcgcgcgccgcgtcngcgtacgtgggccggctgtgcggcgccagcaacgggaaaggcgcga

SEQ ID NO: 1679 - DNA, 261 bp, Zea mays
  Clone ID: PAT_MRT4577_181426C.1
cccacgcgtccgaaaccctctggactagggtttatctgggctcgcctcgttagttgttacccatctgtgtattcgattgtaaggtcgatctgtgtcacatgctagtgctgcggtcattctatggttcatcagactcatgcatcaaccagcatggactgtatgatcgatggaagctgttactcctgtcatgatttgttctaagttaatcctaaggaaaaaattgagctattaggtgctgcaaaacatacatacaacggcagt

SEQ ID NO: 1680 - DNA, 180 bp, Zea mays
  Clone ID: PAT_MRT4577_181481C.1
caaaaggacaggcagccaaatgccccaccacagcggagcccctcctcactgactcacctgcaaaaaccacttgcaaaccacacaaaccgaaaacgccagcttccctgccttcatttttagcaactttttcctttaatctcccgtggcagtcacccttctttgccccccgcgcagatttcg

SEQ ID NO: 1681 - DNA, 2620 bp, Zea mays
  Clone ID: PAT_MRT4577_18149C.1
cctcgaggctggccgggccgggcagcctgcggagatgcagtagaggccgccaggcgcagatggaatgagcgaccgggctctgctccgccgctagcctgccgccgcaccgcgccgtcgatcgccgcgccatgaacggtccccgcggctaccccctttctccaccggcaccttacccccgtatggcgtgatccaatgatagcaccaagagcgcaccttcccctctccctgacggcgtcgtcctccccgcacggcggcgcgcgcacccgcaccaagaagaggaagaaaccatgtcccccaacctggacagcgccatcaagagccaggtgccggcgctgctcctgaggcgtctcttcggcgcgtcccggcgggacgaggccaagcagctccagcggaccccggcgccggtggggaggcggagggtgttcgtgcagacggagaccggctgcgtgctcggcatggacctggaccgcggggacaacgcgcacaccgtcaagcgccggctgcagctcgcgttcaacatgcccaccggcgggacctcgctcaccttcggcgatcgcgtcctggagaacgacctctccttcttacgcccggactcgccgctactgctcacccggaacagcatcaaccggagctgctccaccccgtgcctctgccccgtctccaaggacttcgagcacaaggactgcagcggactggttgagatgctcggctgctccagcagctgtgcccgggtgaagcgcctcgtggacgacgtggtgactgccatcaggagcggcgtggatccggtccccattagcagcggccttggtggctcgtactacttcaggaacgtcttgggcgacagggttgctattgtgaagccgacggacgaggagccctttgcgccaaacaatcccaaggggttcgtcgggagggcgctcggtcagccgggcctcaagagatctgtgcgagtgggagagacggggtttagggaggttgcggcgttcctgttggaccatgacaacttcgccaacgttcctgccacggctctggtgaagataacacactccattttcaacataaactgcccggtaaatggaggaaacctggcaccggctcatgaccagcaacagcaagttaacagcaagattgcttcgttccagcagttcatagcccatgacttcgacgccagcgaccatggcacgtcaagcttccctgtcgctgctgttcataggatcggcatactagatatccggattttcaacactgacaggcacgccggcaatgtgctggtgaggaagcttaacggtggcacaggccgctttggttgccagacagagctgttcccaattgatcatggcatgtgcttgccggagaacttggaggacccttacttcgagtggatccattgggctcaggcttctattccgttctctgaggaagagctcgagtacatcagaaatcttgatccaaggaaagatgtgcagatgctgcgccgggaacttccgatgatacgtgaggcctgcctacatgtactggccctgtgcacaatcttccttaaggaggctgcagctttcggactctgcttggccgagataggcgagatgatgaccagggagttcagagggatggaggaggaaccaagccagctggagcttatgtgtatggaggccaggaagagagtagcagagtgggagcccttctctgccacagctgaacatggagaagataccgatttccagttctcggtggatatgctaggagaatacagtgatgtagtgcgatcaccaaggttcaatggctcaggttccaaagtgtccagtttcagaagccctttgtctaagctcgtcgagagcgtcgacgagggcagtgatggccatgaagatcaaaacgagtctgatcgagtcttgtatgctggatggaatacatctagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagaggcactgcacgagagcgcaagggcagcagcaggtcaaaggatgaagcagcggctgggcacttcatgcaagttttgagcagggcaatagcgcatcagagaagaaaaaatatgcagtgctacttgtactgcttgcttatggagtgagtacaggatgaagatatcatcgtatgcggcaccttcaaccttgtgcaacgatctaggttgcagcagccatgtccagcaggtagataggaccacaagcatatgtagtgacggtgtggagaactgctacgcgtgtttattagctatatgtttacgaaggggaatgcttaataataaatgtttgtcagcctgtgtatattggcttgatgttagatactccagctttagcatgcaatttcttagtcgctgaaaattctttgtagcttgtgatgtgacctgtgagcagtgtaaacattgcacctttgatggaaaaataatgcttacctgttgttgaatgcaattttttagtcgctgaaaaaaaaaaaaaaaaaaaaaaaaaaagggcggccaccaacaagtgag

SEQ ID NO: 1682 - DNA, 404 bp, Zea mays
  Clone ID: PAT_MRT4577_181507C.1
ccggcaatcgcactggcatcttacctttattacccttgttcctccaacaatgatgggcggtattacacagttacctttggtgcatttattgcacaaaacataggcacacaactacaacaacttgagctatcaaaccttgctgctacttcacacagcacattcttccattcaaccaatactgtatgaactctgctcttatttgcaacacaacaactaccattagcagctatctgctgcctaccccagcaattattccattaagcactgacacattgaactatctgcttattacagctgcacagctactaccattcaccagctaactggtgtgagcacctgctaccttatgacacaaccacagttgacgacgttctaccaacacgctgtgcttaacgctggcaccc

SEQ ID NO: 1683 - DNA, 262 bp, Zea mays
  Clone ID: PAT_MRT4577_181515C.1
tgttcatagcaaccagcatgtgcgaggattcatcacacatgctgagcagctcagagccaagggtgtagacgagatccagcatatcagcggtaacgaccccttcgtcatgatggcgtgggcgaagacctatcccgagaacaagcacgtgaagttcctcgccgacggatctgtagcgtacaccaaggtgctcgaactcgagctcgatctcacggtcaaagggctggacgtgcgctctaagaggttcgctctcctggtcgacgac

SEQ ID NO: 1684 - DNA, 838 bp, Zea mays
  UNSURE (1)..(838): unsure at all n locations
  Clone ID: PAT_MRT4577_181634C.1
  unsure (1)..(838): unsure at all n locations
atcccctttcacttcttcagcttcctcttcctatcaagttgcctttcacttcttcggtttgctcttcttcgccaagttatcatccatcgagttaggcagtttagatcttggaggaaaggagtagctagctaggttccttttccttcccccgagccgggagagagaaaacagagcggagaagagacacacaggaaccggaggttgaccgggctaaagtaggttggagctcctggctgggccttttctcttggcgacgacatggcgaagctccacttcttcctcctcttgctgctggccgccgccgaagctattcacggcgaagatggggcgtacataggcgtcaacatcggcacggccatgtcatcggtgccggctgccacgcagatcaccacgctgctccgctcgcagaacatccggcacatccgcctctacgacgccgacccggggatgctgtcggcgctcgccaacaccggcatccgcgtcatcatctccgtccccaacgagcagctcctcgccatcggcaactccaacgccacggcggccaagtgggtggcgcgcaacgtggcggcccactacccgtccgtgaacatcacggccatcgcggtcggctccgaggtgctctccacgctccccaacgccgcgccgctcatcatgcccgccatgcgctacctccagaacgcgctcgtggccgcggcgctcgacaagtacatcaagatctccacgccgcactcgtcctccatcatcctcgactccttcccgccgtcgcagggcttcttcaaccgctcgctggacccggtgctcgtgccgatgctncagttcctgcagtccaccggcgccc

SEQ ID NO: 1685 - DNA, 712 bp, Zea mays
  Clone ID: PAT_MRT4577_181639C.1
ccacgcgtccgcacaccttggacatatatatggaaaatagcttcacagtctagattccatggcatcaaggatggggatggtggctattctgtccttgtttgtttgtgctcttgttgcttcaacatctgtcaatgctaatgtgtggcagactgatgaggatgctttttatagtacaaataaactgggagtcaatggcaacatggagatggcacaacaacaaggtggatttattggccatcgcccaagacttgcattattcaatagggcatcaaaacaactggaccgtgaaaaaagacctgtgcctagcgggccagaccccatacatcacagcatcccatcacatgctcctcagcatccaccatcatatggcaaagctccttatgaagatgacaagagcatagcatctcctggtctgtccaacccgataggtcctccaccatttttagatagatactagttcatgcaaaagtagtgagtatttatgcacctatgccaatgaataacctctaattacctacatgtattggcctggtgtttggtaaacatgaagcaataactttctcttatcgaaatacaggtctcaagaccgcctatgttgtctcagcatatgttagtgcagcatagtctggccctaagtctaggtactaggaggagggttgagttaggcacggtgagctagctataaaaaacttagccactccaatggagatga

SEQ ID NO: 1686 - DNA, 676 bp, Zea mays
  UNSURE (1)..(676): unsure at all n locations
  Clone ID: PAT_MRT4577_18164C.1
  unsure (1)..(676): unsure at all n locations
ngatagaggtgtgatcggctcaagcaccagctagccacctcgctgcctcgctggtgctcttccacctcctgcaccacagcgccattgcgcttccacggccagctaccgctgccggaatatacactggtggatctttaacaggttcctccggtccgatccaccgccagcttccgacgtcgtactcgggcggatcggttccacaatgggggaacggggagcagaggaggacggctcgggcggctcctccctctccctcatgtgcctggaggacggcgccgacctcgacgccggtggctccgcggagagcgccgacgacggcgagccggccgtcgttgctcacagcgacgccggtgaggaccaggaggaggagtacatggactacctcgtgtccaaggagagcagcttctgctgctccccttcctcctcgcccgtctcctccgacgccggcgccgagacgcgcccttcgtccacggcgtcgtcatccgacgagtggttccgctgcgcgcgccacgccaccgtcgcgtgggtccttgagacgcgggcttacttcggcttctcccaccgcgcggcgtacctggccgtctcctacatggaccgcttctgcctccgncggtgcatggacgtgtcagtgatgccctgggcggcgncgctgctggccgtggcgtgcctgtccctg

SEQ ID NO: 1687 - DNA, 127 bp, Zea mays
  Clone ID: PAT_MRT4577_181736C.1
gtcgtccgccttgccattaacgaaggcttggtctttcttcttggatctccactcgtccattcacagatccgttccttcagctaggggtagcgttcatctgcagcgatggctatcaagcggagcaagg

SEQ ID NO: 1688 - DNA, 290 bp, Zea mays
  UNSURE (1)..(290): unsure at all n locations
  Clone ID: PAT_MRT4577_181800C.1
  unsure (1)..(290): unsure at all n locations
gtgcggagccggggtccgcgtcgacgccgctgctgcggcggaggggctcgtacacgcggaccgtgtcgcacgcgcgcgacgagctcagcagcttccgctccggcctacggtggatgtgcgtcgaccactcggacgcctccagccctgccgtgtcctggctcgtcttcgccgcgctcggcgtggccgtccctgccgccgcgcacgcggcggcggcgccgcggcgcgcctacgacacgcaggtgcaggtctcgctcacgctctccgncgcgctggcctacaccaccctctac

SEQ ID NO: 1689 - DNA, 344 bp, Zea mays
  Clone ID: PAT_MRT4577_181814C.1
gtagaatagttctgcagattttatctctgtaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggatcaaagtttacttccccgtgcttgcaaaaaaatagtttttttatagggtcacctaaataaaattaattggccggggtttaaaaacgtaggaattggaaaaaccttggggttaccaaatttaatccctttgcaaaaaatccccttttcgccacttggtgtaataccaaaaaggcc

SEQ ID NO: 1690 - DNA, 2279 bp, Zea mays
  Clone ID: PAT_MRT4577_181875C.1
ggcgcctcgctcgaggccgggccgggtacagcttcagcttgtattcaaagagaggcagcgcagggtgcaagaagctgtccctccctccctcccctgtgcttctgctagctaggtgcctgcggaggagagatagggatacgatggccggcggtggcatcgtgaacacgggcggtggcaaggactaccccggcaagctcaccctcttcgtgttgctcacctgcatcgtcgccgccaccggcggtctcatcttcggatatgacatcggtatctcaggcggcgtgacgtccatgaacccgttcctggagaagttcttcccggaggtgtaccggaagaagcaggaggccaagacgaaccagtactgcaagtacgacaaccagctgctgcagaccttcacctcctccctctacctggccgcgctggtcgcctccttcttcgccgccaccgtcacccgcgccgtcggccgcaagtggtccatgctcgtcggcggcctcaccttcctcgtcggcgccgccctcaacggcgccgcccagaacatcgccatgctcatcgtcggacgcatccttctcggcgtcggcgtcggcttcgcaaatcagtccgtgcctgtgtacctgtcggagatggcgccggcgcgtctccggggcatgctcaacatcggcttccagctgatgatcaccatcggcatcctggctgcggagctcatcaactacggcaccaacaagatcaaggccgggtacgggtggcgcgtgagcctggcgctggcggcggtgccggcggccatcatcaccctgggctccctcttcctcccggacacccccaactcgctgctggagcggggccacccggaggaggcacgccgcatgctccgccgcatccgcggcacggacgacatcggcgaggagtacgcggacctggtggcggccagcgaggaggccgacaaggtgcgccacccgtggcggaacatcctgcgccgccggtaccgcgcgcagctcaccatgggcgtcgccatccccgtgttccagcagctcacggggatcaacgtcatcatgttctacgcccccgtcctcttcgacacgctggtcttcaagaacgacgcctccctcatgtcctccgtcatcacgggcctcgtcaacgtcttcgccaccgtcgtgtccatcgtcaccgtcgaccgcgtcggccgccgcaagctgttcctccagggcggcgcgcagatgatcgtgtgccagctcatcgtgggcacgctcatcgccgccaagttcgggaccagcggcacgggggacatcgccaagggctacgccgcggtcgtcgtggtcttcatctgcgcctacgtcgccggcttcgcctggtcgtgggggcccctgggctggctcgtgccgtccgagatcttcccgctgggagatccgcccggcggggcagagcatcaacgtctccgtcaacatgttcttcaccttctgcatcgcgcaggccttcctcaccatgctctgccacttcaagttcggcctcttctacttcttcgccggctgggtcgtcatcatgaccgtcttcatcgccttcttcctgcccgagaccaagaacgtgcccatcgaggagatggtgcttgtctggaagtcacactggttctggaaaaggttcatcgccgacgaggacgtgcacgtcggcattggcaacaaccacccggccaaaaacggcagcgacaccaagggggccgacgcgtgaacgtgatctcaacatctatattccatctacagtcacaactgaaatgtacatttaggcttccattgttccatcaactagtagctacatgtcctcctagtaaagtaccagtgtttgtttgtgtaatgtttgttacgcccattaaattcttcttggattggatgaactacaagcaaagacattccctggatgcagtacaatgataacagcagccagtaggcaaacacattccagatggaagcagagattgccttttatccctcaaaatgccctccgccaacgccaagctcggcggcatgcagtagccatggccgtccctcgctgctcatgttgttgggcaataatctacccatccagtattatttttgggggcttaccgggaaatttgaaaatcatcaccaatgtattataatcgtctcattaggtaggatgactggatgatgacgaatagtcaactagtcttcgtcccctgcctttttttttattctgtgcgggatactgaatgtggagtataattatgtttgcaccagatcaaaccaaatatgaatatcaattgcaagttgccctgc

SEQ ID NO: 1691 - DNA, 279 bp, Zea mays
  Clone ID: PAT_MRT4577_181965C.1
gactcgtgggtcgatacaagactctatactgagtcgtattaccacctcgccgtccctcacgttcctttcacggactcgccagcgcctctccgcgccgtgatctagatgcaggttgttcagcatgggtctggtgaaggaaggcgtcgacatggaggagggaaccctagagatcaggatggagtagaggactgtaactggtgtggccgggcctctggttaacctggggaaagtaataggcccacagtaccaataatctgtgaacatccgacctggagatgg

SEQ ID NO: 1692 - DNA, 413 bp, Zea mays
  Clone ID: PAT_MRT4577_181993C.1
actttcttatttctgggaagccacaaacatcagataaaaaactttattattgaactataactcataagaaatctaaaagagggcaccaccaatgatgggttgctggtagaacactgatgggtttgacaaagcaagccggttgagtggcaataagttgctgcagatgtaagagggtgccagcgttaggcgcaacgtgctggaagaacggtgacactgtggttgcgacaagaaggtagcattggctcacaccagctagctggctgaatggtagtagttgttgctgctgcaaataagcaggagagctcaatgctgctagctggctgaatggaagaaattgcttggggcaagcggcaggtatctggcttaatggttattgtctggtggtgccaattagtagcagtgttccatggagc

SEQ ID NO: 1693 - DNA, 404 bp, Zea mays
  Clone ID: PAT_MRT4577_182189C.1
acggtccgttcgctcctcctcctcccagccgcagctggtcgcggctgctgcggtccttacaagtgggctgctgctgctggcggcggctgccgaaacggcgtcggcggctgtgatctgcgacaaggcgacgtcctcggtggcaccttgcctcgggtacgctatgggcatctcggcgtctcactccgcggagtgctgcaccacagtgcgctcgctcaacatccgcgcgtagtcggcggctgaccggcaggccacctgcaactgactcaagagcatgactggccgtctcggcagcctcgtcaacatggccaacgccagcaacatccccggcaagtgctgcttctccgtcgacttgcccatcagccccaccgtctactgcaccaagatcaactgatcgatggaaccat

SEQ ID NO: 1694 - DNA, 891 bp, Zea mays
  Clone ID: PAT_MRT4577_182206C.1
ctcgaggccggccgggccgggggatatagacgttgtcagttgtcattgctaccaacctcaggtcaccagcaccttctccccacacccccgagttcgagtgcaaccgaagagccaagaggagctgtccgcgtcgtttcgactcccgccgccgaaaggccgagcccgtgcccgtgctcgcaaccctaatcccctttccccgttgcctctcgccgggaagaagagggagccgcgtggcgtcgccagccagcacgcgccccctcccttcccggctccctccgcgccgtgggcgaggcgcatccaacccgatccgccctcaccgcgaggcggaggacctggaggggagggagacaggtctggtgcaccctctctcgtccgcgccggcgagcgccaagtgtcccccacaggcttggctgaggaagacccgtgctctgtgggtcttggacactgcttcaccatttaccaagtcttgagttattgctccgttgttagacaagaaatcaaactctctggccaaacacaatgatggcacaagcctgtaagaagaggagaggagtttatataagcactgaattgggaggctctgatacagattctgatgttgagggaagcaaaccctctaaaaaatctggggtgacatcaatttctacatgcgagcatcagtcatcttataatctcaaggctgcaagtatgaaaagtagcaggatgataaggctgtgtggaaatattgtaaggaagctcatcgatcacaaaggtggttggcttttcaaagatcctgttgatccagatctatataagattcctgactactttgatgttatccgcaacccaatggatttgggtactgttaagaataaactcacaaaaaagaagtatgtaagcattgaggagttc

SEQ ID NO: 1695 - DNA, 253 bp, Zea mays
  Clone ID: PAT_MRT4577_18220C.1
acaacacctatagtgagtcgtattatcagcgacgaccggaactgtgtgaaggagtccagaggtacggcaagagtgacaacagtcgctgtcgcagatctgaaaggcagcatgggtgatgcagtagtttgtgtgcaacgtgatcctgaccagaggcttgctcgacgacctgttttaggcagcactccagaccaagtaattgcacccaaaggtgtgaagccaacattatcagcagatctcaatacacttgccttag

SEQ ID NO: 1696 - DNA, 558 bp, Zea mays
  Clone ID: PAT_MRT4577_18233C.1
gttggtttatgctccgcctacgggccggggtcgggtacctgagggtctacgaggttcggtatcgtgggtgagcggatcagagatggcgcgatgccgatgttgagtaccgatgattcatcggcggcctcgactgggccacggacgaccacttcgtccacaacgccttcagcacctacagcgaggtcctcgagtccaagatcatcctcgatcggatagacgcagcatgtcccgcagatactgctcattcaccttctccacggaggaggcgatgcggaacgcacatcgagggcatgaacggcaaggagctggacggccgcaacatcaccagaaactaggcccaatcccgcggcgggcgtggaggctgaagcggcggcgggtacggcggaggcctgggaggcagtagctacagcggtggcagacgccgtgatggcagcggcagctacggcagtggcagcggctaatgtggtggccgtggccgctacggtggtggtggcggtacctacggaagtcgcaaccgtggcggacgctacggctactccgacgggaactggaggaact

SEQ ID NO: 1697 - DNA, 259 bp, Zea mays
  Clone ID: PAT_MRT4577_182340C.1
tacttctcatgcttcgtccgccagctcatgacctactgattccggaagtgggtgccggacgggttgtgactctgggacgagaagttccgtcgaggcgggcaatgcgtcctgtccggcatccgtctctgcgagtcaacgacgccgcagccgtccgagtacggcggcggcatcgtcgtgaacagctagtgccctccgccgttgccctgtcctcctcccgcgtcggtcatgatgtcttgcggtgtctttggtgctttcgctg

SEQ ID NO: 1698 - DNA, 318 bp, Zea mays
  Clone ID: PAT_MRT4577_182430C.1
cgggttcgtgaggttctccgcggttcgggtgggtcgttgagcggatcgaggagggcggcatctgatgtttagtaccgctgcttcatcggcggcctcgcctgggccacggacgaccactacctacacaacgccttcagcacctacggggaggccctcaagtccaagatcatcctcaatcgggacacgcagacgtcccccggcttcggcttactcaccttctccacggaggaggcgatgcggaaccccactcagggcatgaacggcacagaactagacgggccgaacatcacccgtaacgaggaccagtcccgactctga

SEQ ID NO: 1699 - DNA, 461 bp, Zea mays
  Clone ID: PAT_MRT4577_182672C.1
actacacgaaacgaccggtgggttgtttttatttattcactcgcagaacacaacacactgagtgggggggctcacccaacagcacaatgtacagaccatgaccacggaagactgaacagaacacgtcccccccagacctaccaaaaaaaaacaaccacaggaccccccacaccagtcgcgtcgttgaaacccaaaacccgaccccccgacccgaacccgacgcgaccattcacctggggtgcatgtttttttcagccggagatttggatgcttttaacctcgggctttttgacctcggccttgggcacggggaccgtgagcacccctttctccagggggggccttaccttctgcgtcttggggttttccgggagggggaagcccccaacaaactggccgttgttgccctccacccggtgccacttgtggcccttggcctccttttccctgctgggccgccc

SEQ ID NO: 1700 - DNA, 463 bp, Zea mays
  Clone ID: PAT_MRT4577_182740C.1
aacccgaaaaacaaatcttattcataaacaaaatggggtcacaggtttttctccatacgtacatgcccattggggggggcgccgctgaccccctagagctgcatacttacttattcaaactggtccagcctggggcaacgtcgggaggtcacatgcttacagaccacaaattttcataacaatagcttggcttggctgcttcacagaataacccaacgacaacccccaaattgcgaccatttaaaataaacaactcaaaagcaaatcgaccccaaaagcccgtcttactcattaagcactcccgccttttcctccatgggatccgcttcctcctcccaacataaaaaattagccagtttggagtccttcttcataggaggaggagcactctccacgttctcgccgtcaaagcaggggaaaacaaatttgggcgagggagcaacagcgttttcagcagcacaaa

SEQ ID NO: 1701 - DNA, 1744 bp, Zea mays
  Clone ID: PAT_MRT4577_182743C.1
gccgggaaaaaaaaaaaaaaaaaaaaaaaaaaaaaaaaaaatttaaaaaaaaaaaaaaaaaaaaaaaaaaaaaaaaaaaaaaaaaaaacccctttgggcttcctcattctagtagttaaggattttttttctgaccctttgattttgaccaatctttttggcctgctgtttcctgataatcgaccggttccccagttttgctccttgcactcctccctccatctccagcattgggttctgattcacctgctccaagggctgttctttttgttgctgaggcttccccggcctaagttatcgggtttgagggctatgaaaagcgccttgaaatcacattctttgaggcacctgtttttggggaccctcatgggcgtggtttgcgtgccctctccagggcccaaatggactttgttctggatcttgcacggggcacaattgtgtccgagctctccaacaaggatttcgactcatatgtcctttctgagtcaagcttgtttatctatcctgtgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgaaatgtgcatgactggtctggacaagaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatctttggcgggcgtggccatgccgggacatggggaaaggcacttggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgtacgtatggagaaatatctgtgaacccattttgtttatgaataagatttgttttttttcgagtt

SEQ ID NO: 1702 - DNA, 1342 bp, Zea mays
  Clone ID: PAT_MRT4577_182747C.1
ggccgcttttttttttttttttcgaaaaaaacaaatcttattcataaacaaaatgggttcacagatatttctccatacgttcatgctcattgtggtagacgcagctgaccacctagagctgcatacttacttattcagactgatccagcatgtggcaacatcggaagttcacatgcttacagacgacaaattttcataacaatagcctggcttggctgcttcacagaataaccaaacgacaaccacgaaattgcgacgatataaaataaacaactcagaagcaaatcgaccccagaagcccgtcttactcatcaagcactcccgccttctcctccatggcatccgcttcctcctcccagcagagaagattagccagcttgtagtccttcttcataggaggaggagcactctccacgttctcgccgtcaaagcagtggaaaacagatttgggcgaggtagcaacagcgtcttcagcagcacagaagctctggtacacgaggagcccgcctccaggcagctcctgctccaccatgttgttgcagtcatagacctctgcaccaagtgcctttccccatgtcccggcatggccgcgcccgccgaagatggtcacggcaacggaaaactctgaggggccaaagcaccggaggaccctcttgacaaggtcaccataagacagagcagtggcatccaagcccataacctcgtaactggcgtagctgaaaccgtcctcgggcgtcacatggattgtggagaatgcagagccatggatcgcattcatggagtagccacagggttcgaagtcaaaatcgcagatctccatatcggggatgatttcagagatgccagagagctttgtcatttccttggcacatgttgtgttcccatcagcattagtcttgaaaaagacacaagctttcttcttgtccagaccagtcatgcacatctcaaggttaaccattggttgctctgggtactcagtggcgtagaagacgtgccacttctgtccaggtcttgctggatctccaatcacataagcattaccaccagatttcaggccgccaaagtagcggttaagtgcagcaacttcctcagagaagctcctgtggggggctggctgtgcgccaggaaagatgaacgtcccacgggagtacttcacagcagcaagtggcatagacagctcttcagcaagctcaaggattcttggaatggtgagcaggagcttggtagtgccgcaggtcttgatgacaatcttcagaggatagataaacaagcttgactcagaaaggacatatgagtcgaaatccttgttggaatggtgagcaggagcttggtagtgccctcg

SEQ ID NO: 1703 - DNA, 1731 bp, Zea mays
  Clone ID: PAT_MRT4577_182762C.1
cctcgaggccggccgggagatatagcactcgctgctcgccttggtcccaactacccgctccctgtccagcgtccagcgtgcaaccaacacctcccacgagtccgcgacgcgtcagcgtcaccgtccgtcgtcgcaaacgagcccagtggcgattcgctttcgaaccgcactcgccctcctccgttctcttctctccctcctcctatagttggcttctcgcaaccctctgctttcgatcagctttctccgctccccatttccctctccaactccaatccatggcctccacggatcgctccacgccggcggaggacgagcaacagcagaagcgcccgtctctcttctcgccgtaccagatgccccgcttccgcctcacccaccggtgagcctccatcgcggtggtgctggcgccgatgaccaggtgcagggcgcccgacgcgatcccaggccccgcgctcgcggagtactacgcgcagcggtccacggagggcggcttgctcatctccgagggcaccatcatctcgccgtccggccctgggttccctcgtgtccctgggatatacaatcaagaacagactgatgcatggagaaaggtggttgatgctgttcatgccaagggagctatctttttctgccaactatggcatgtaggccgagcttctcaccaagtatatcagccgggtgctgctgctccgatatcctcaactgataagccaatatcatcaagatggaggatactgatgcccgatggatcctatggcaagtatccaactccgaggcgcctagccacatccgagataccagaaattgttgagcaataccgtcaagcagccgtaaacgccatcaaagcaggtttcgatggcatcgagatccatggcgcccatggctacctcatcgatcagttcctcaagggcggtatcaacgaccggactgacgagtacggtggctcactctccaaccgttgccggttcctcctggaggtgacccgagccgtggtctctgcgataggggcagaccgcgtcgcggtccgagcgcccccggccatcgaccacctcgacgcctacgactccaaccccctgcagctcggcctggccgtagtggaccgcctcaacgctctccaggaggagaccgggcggctggcctacctgcacgtgacgcagccacggtacacggcgtacgggcagacggagtccggccagcacgggagcgccgaggaggagagccggctgatgcgcgccctgcggggcgcctaccgcggcacgttcatgtgcagcggtgggtacacgcgcgagctcggcgtggaggccgtcgagtcgtgggacgccgacctggtgtcctacgggcggctgttcatcgctaacccggacctggtggagcggttccggcgcgacgccccgctgaacagatacgtgcgcaagacgttctacaccccggatcccgtcgttggttacacggactacccgttcctcggccagcctaaggcgcgcatgtgattattagttaggttggtaactataagaggcggactattgttcgtgtattgtggcttgagaaaataagcaaacacatggtggtagtgctgtgcaataagccttaggtgcaaacatgagcctcctgggcctttagataatgatctaattatagatgtaattatagttttgtcaagaagttaatgtttatttgcacagcaatcagcagtcatctctcataaaaaaaaaaaaaaaatagtta

SEQ ID NO: 1704 - DNA, 2810 bp, Zea mays
  Clone ID: PAT_MRT4577_18278C.1
accgaatccccagaccaaatcgccgtcgccgtcgcatcgcagcatcgggagtcccagggtcccggaccgaatccatttccagacacccaaggccaagatccatcgctcgttccaacctgcctcctccttcttctgcttggtcgtctgatctcgttcaccattcgtgtccaatccgatccatccaaccgctgtgaatgatggcgctcaacctgtcccaccagaccggcgcggccgtggcggcggcaccggcggcgccacgagcggccgtcgtcgcggcggcggccacggcgccacgctcggccgtcgtcgctgcggcggccaccgtggcgccgtcgtccgtgtcggcgcccgcccccgctccggcgctccagctgcagacgatgacggtggacccggcccccgtgcaggcgcccgacgcggtgaagcccgcccgcctttccccgccgtttcttggatttctaggatccagacaaccgcccttgtgagcctgccttcctgcctactacctgcgtacgtacaggagggtccttgcttgggtgatccgggtgcctggtttctcggttccgcggcttccgctgctgttggattcgccgagccggagccgccggagatgaccgtcgacgagctgaagctgcaggcgagggccagcggcggccacggcgccaaggaccagttccccgtcggcatgcgcgtgctcgccgtcgacgacgacccgacctgcctcaagatcctcgagaacctcttgctccgctgccagtaccatgtgacaacaacgggacaggcagccacggccttgaagctgctgagggagaagaaggaccagtttgaccttgtgatcagcgacgtccacatgccggacatggacggcttcaagctcctcgagcttgtgggcctcgagatggacctcccggtcattatgctgtctgcaaatggggagacacagacagtcatgaaggggattacccatggagcatgtgactacctgctgaagccagtgcgtattgagcagctgaggactatatggcagcatgtggttaggcggaggagttgtgacgccaagaacagtggcaatgacaacgatgattcgggtaaaaagttgcaggtggtgagcgctgaaggtgacaatggcggtgttaatcgcaacaagagaatttcacgcaagggtagggatgataatggtgatgacggtgatgattctgatgacaacagtaatgagaatggagactcgtcgagccagaagaagccaagggttgtgtggtctgttgaattgcaccgaaagtttgtggctgctgtcaaccagcttggcattgacaaggctgttccaaagaaaatattggatcttatgaatgttgagaacatcacaagggagaacgttgcaagtcatctgcagaagtatcggctgtatctgaaaagactcagcgcagatgcaagcaggcaggctaacctaactgctgcatttggaggaagaaaccctgcttatgtgaacatgggactagacgccttcaggcagtacaatgcatatgggagataccggccagttccaaccactaaccattcacagccaaacaacctccttgcaaggatgaactctcctgcatttggtatgcatggtctgctgccttcgcagccacttcagattggacacaaccagaacaatctgagcacttccctagggaatgtcggggggatgaacaacggcaacctgatcaggggtgcgcatatgccactgcaggatactagcaaatgctttcctactggcccttctggtaattcgttcgcgaacatatcaaacagcacacaactggttacgacaaacaacttgccattacagtctcttgagccaagcaaccaacaacaccttggtcggctgcattcctctgcagaccctttcaactcatttgttggtgagcccccccagtttgcagatcttggaaggtgcaacaccacctggccaaccgcggtctcatcatccaatgttcaggagattggccagaaggacaggatcgtgaataggcccaagcttgagcctctctcaagctttacagaagcatccagtcagatccctttgctgggaagtgaaatgcagagccaccaagtagcatcactagccagcaacggtcttccgatgccgttcactcaggaagcggtgcccttcgcttatggaagcagcacgaactcgagagagatgctgaataacaaccttgcgcttagtaattcaggcgtcaactctacattgccgaaccttcgcatagacggttctgttgttccagggcagacactgggtggtagcaattcaggtggttgtgttgtcccccctctgcaagatggcaggattgatcaccaagctgtcagcagtcatctaaactacaacaacgaactcatggggacaggtaggctgcaaaggggacttagtggtggtctggatgacattgtcgtggacatgtttaggccggaccgcgcagacgatggcgtctccttcattgatggggactgggaactggtctagcaagtttcagttctctacatcaagtctgccttcgtgtgagattttccgcatttgtggttgtggaggggttcggcgcttgattggtccaaagttgtttatagtagcaagattgcatcacaaatgccctttgcatttggtttttcagtttagcgaccaggttccagtgtcacgtccgaatatcaactatgtggtatttgctaccttaactcgtatggctatgttttcaagtcaggtgttaactgtggctatcgtgatatatacagcatggttatgagccaaggaatgctgtcctgtttcctcttgg

SEQ ID NO: 1705 - DNA, 469 bp, Zea mays
  Clone ID: PAT_MRT4577_182851C.1
cgcacacgttcgtcagaggagtacaagtgctggtaccgtcaccatgttccagaagtgctcaggcgcttctatagcttcccttaatgcctagcacctctaaccaacggtctctttggaatgtgagaacccacttcttcaaccctacaagatccaacatgcaatcgcagctgtcatataacctcaatcacccttgatacttcaacaatcattagccgtattacagcagctacctttggtgcatgtattggcacacaacatacaggcacaacagctactacaacacgtgctatcaaaccttgctgcctactctcagcaacagcagtatcttgcatttgactatctagctgtattgaactctgctactatttgcaacatcatcaactaccattcaaccagcttcctgttgactacccccagcaataacttccattcaaacaactggcagcattgaactctactgcttatttac

SEQ ID NO: 1706 - DNA, 414 bp, Zea mays
  Clone ID: PAT_MRT4577_18325C.1
cattgctcacaagtcaaacctcatgttgtgtgttaggacgggtcttcatctctgatgaattcgatgatcttcttccgaagtacctcagctttcttgatgggtatggttgactcatacaccttgcccctcaatgtgtcccgacaaacgcttgaacagcatagcagtgtgaagaccatcaagaagaaactgatccgcaaggctcttgacatgattaggaaacttgctgaagaggatcctgatgagtacagcaacagacaaaagactgatgatgagacgagtgcaatggaggagaagaagggccagtgcaccaagttctggaacgagtttggctaatccctcaagctgggaatgattgaagatgctacaaacaggaacctggttgtgaaacttttcgaatttgaaagctgcaactta

SEQ ID NO: 1707 - DNA, 2020 bp, Zea mays
  Clone ID: PAT_MRT4577_183348C.1
taactcaaaaaaagagatcggattagtttttttttccctaaaatcatgctctacactacatcatacaagactggctactaatattgaacaagctaaataaatatgttctgagattccactaatgttacaagttacaacaacaagcacaccgtgcataaacatacagcaacttagaagatgctccaagtcctagccaacaaaggaaagggaaagaaaatgacttctaggttttcacgtctccttttggttgaccaagaagagatggtcggtagagtgaatggccttgtgccatctcaattctttcgcgtggatcatacattgtctcatctcttatagcctgaagaatcgaatcagcaggacggtccctcgtgatcagaatcctatgtagtgcttttaggatcgggcacatctcaaccggcgcaacagatctgttggcttctggatgcatgacacttaagctatcctgactaagaagctcataaaacgcatcaactgcagagacaccctgaatggtcccttttcctttaatactgtcacccatttctaatgtcaattcacctttagctaacttctgcccataccatgcattacgacctttcaacaatgtgacataagtgtcagctaataagggtccagcaagtttttcaggttcttcttccagaaggtgtgtgatgtagatcatctcagatgtgcaaagtgcaaagtaaacagatttgctggttgcactctcgttggttagtgcagctaccataccagcaccaatagcatagacattttttaagccacccatgacttcatgagtgatgagatcactgttatcccacacaataaaatgaggctgcctcaaaaactttgcaaggggctttctccatttgtcagctccacaaatacgtgcatttgcatattctttgttgtaaatttcagaagcaatattaggtccgccaagataaagaatattctctgatggaactccagttgcattgctaatcatctgcgtgggagttatgatccgtgggagtggatccagcgaggcctcaattcctttggcgagggagatgatgatgggggcagtaatcctctccttccagtacctcctgatctccccgaacacctccctggtgtcggtggaaggcaggccgttgacgacaatgtcagcgtcccagacggcctcctgcaggttggtgacgaccttgagcgggcagagcggcgtgtcgatcatgttgaggcagaagccgtccctgagtatctcgtcggcgtagagcgtgcggtcgccgaggcgcgcctcgacgtacttgaggtaggcgcagcggcggatcaggcggcgcaggacgtcctcgcgcgcgttgatgacgtcgaagaggtgctcggcggtggcgcggtcgacggcgcggcccgggcggcgccagatgcggacctgcgccttgtcgcggaggtggccgtacgcgtcctgcagcagcgcgcagaagacgctgccccaggcgcccgccccgacgccgacgatccggagcgggtcgccgtccgccttccccagctgccgccgcagcaagtccagcttctcctccaccacggccccgttcgcatggccgtccggctggcccagcgcctccgccccgcccattgccctgatctcctccgcctcttcctctctcgccgaaaacgaggcaggctacataacccggtctgtctcgttcggcagaagaggagagacggggaaggctggattaagcgacggcagcaaagctataataactaactcggggagagagaaaggagcggacggcttttcttttggccgaaacgagctcggatcgacgcgaattcgggtgggtttggccgccgaatcgcagcgaggcgaagcgtcggccgcgacggccggagagcccgagggagtcggggcttgctgccggcccgccggccctgtcgcggttgccggttgggttggtgcgccagtacacgtcgcctcgggctctcgatcagctcggccagattggcgcctgctgcccagtgcccacaaaaaaga

SEQ ID NO: 1708 - DNA, 389 bp, Zea mays
  Clone ID: PAT_MRT4577_183709C.1
cgacccacgcgtacgctctcctgcccaccgccatcgcccctcctacgctctgcgctgccacagcctcaccccggcgcccccgccgattcacgtaggcctttgttggaaggaacgatggagcagaccttcatcatgatcaagcccgacggcgtccagcggggcctgatcggcgacatgatcagtctccttcgagaagaaagggttctacctcaaggggatgaagctcatgaacagtgagagggccttcgcgcagcagcactacgctgacctttacgacaagcctttattcactcggttgaacagatacattatgtccggccccgtagtggcgatggtgtgagaggcgaatgacatcatgttgactggccgcaggatcattggggccacca

SEQ ID NO: 1709 - DNA, 445 bp, Zea mays
  Clone ID: PAT_MRT4577_183795C.1
agcaacgtaaaaagcacaatagtgtaccaactatggctgccaaaatattttgcctccttatactgcttggtctttctgcaagagctgctacagcgaccattttcccgcaatgctcgcatgctcctatcacttacatacttcccccgtacctatcaccatccgtgtcttaagtatactaaaacccaattcttcaaccctacaggatccaacatgcaatctcatctggcatcttacctttatcaccctcagtcctccaacaatcatcaaccctattacaacacttacctcttgagcatttattggcacaaaacatcagggcacaacaactacaacaacttgtgctaacaaaccttgatgcctactatcatcaacagcagcttcttccattcaaccaactaagttcattgaactctgcttgttatttgcaacatcaacgactaccatt

SEQ ID NO: 1710 - DNA, 353 bp, Zea mays
  Clone ID: PAT_MRT4577_1837C.1
aagtatgctcttgacgaaagcaagctattcataaacgacaaataaccttgagcaaatgcgcttactgctggtaatccgataaggagagtcaacaagacaaaactgtatttggcatcgcacataaactcaccccttttcgctacaccgttgttcttgaccagaagcaagcagctccttcaatcccccctcatctcaggcgataagcatgagaaaacctgctacgcgactgcatatatgataatgcatatgcgtgcaaaagataattgacaggccagtgtagcgaacttcatatcgcactacgagccccagtgagctgcaagccttgtgcatagttctcatcctggacaggcttg

SEQ ID NO: 1711 - DNA, 1995 bp, Zea mays
  Clone ID: PAT_MRT4577_183825C.1
cattgggtacctcgaggccggccgggagctgcaaagtccggacaaagctcgcgccgcccaccgcacccgatccgcctcgcccaggcgtgctgccgtccgctcccttctcccgcgccgtcgcctccgcctacgcccgggccgacccgctggacccagcgtgcgccgctccactcggacgcgccgccgccctctcgggttgaggcggaggtgcttggggacccgcctccatggcgagcgccggcaacagcggcagcggggacgacgatgcaggagggaagctcctggcggatcgctaccagaagggcgaggtcctcggcgagggcacgtatggagtcgtcttcaaggccatcgacaccaagactggaaatacagtcgcggtaaagcgaatccggataggaaaggacaagaaggaaggtgtcaacttcactgcgttgagggaaattaaactacttaaggagctgaaagatcctaatattatagagctgattgattgtttcccttacaaggaaaatttgcaccttgtgtttgagtttatggagaccgatctggaagctctcataaaagataagaacataatactctctccagctgacacaaaatcatatgtccagatgatgttaaaaggtctagcgttctgccataagaaatgggtgctacacagggatatgaaaccaaataatttactcattggtgccgatgggcagctcaagcttgctgacttcggtctggcccgtgtgttcgggagtccaggaaggaacttcactcaccaggtctttgcacgttggtaccgggcaccagaattattatttggctcgaagcagtacggatctggggtggatatttgggccgctggatgtatttttgctgaactgcttactcgcagagcctttctccagggttctagtgacattgatcaacttgggaagattttcgcagcacttgggaccccaaaatcttctcaatggcctgacatggtttatcttcctgattatgttgaataccaatatgttgctgcacctccactacgtacgttgtttccaatggccagcgatgatgctttggatcttctgtcaaaaatgcttacctatgatccaaaagcaagaatcagtgctcagcaggctctagaacacaggtacttttcatcgttacctgcaccaacaagaccatcgcagcttccaaggccacgtcggaaaggagatcaagggaataacaagattcctgatctcaacctgcaggatggccctatggtgctctccccgccaagaaagttacgtagggtgacagcgcatgaagggatggaaggtatgcacaggacagataaagtggacgaacatccttctgggatgaggcacaccgatgacatgcccagtcagagttctagaattccaatgtcagttgatgttggggctgtgtttggcacacgacctgcacctaggccaacattgaacagtgcggacaagtctcgtttaaaacggaaacttgatatggatccagagtttggatacgcggagtagaaggaacacatgtttacatgcaccattcttttcttattggggatgttgatttttaaaataagattctgacacaatcaactgagatgttaccgtcatcgcctcacgaagaggaaaactgaagagagattattctaatttatcccgagtcacatagggtattacagctaaccaattccgtaaggcaggctcttgaaaacagtagactcaatgggatattcatgagtggagagtgttatggggaattggaggatggaaaagcttgctccatgcgtgtttgtacgtgttttgccaagattgtgctgaagcatctgatctatctactgattctctattttccgtactgtcaattcccgttcttgtatggacagagctttgagcatgttttcagtcagacaccttaggcagtgattcttattgtacaacttatatcatctgacatttcttttgagatgattaaacaatgcatggcgaaaaagggggg

SEQ ID NO: 1712 - DNA, 296 bp, Zea mays
  Clone ID: PAT_MRT4577_183858C.1
ttttcttttggtttttcggggcaacaaaaagcacctttgtttccttaggattaacttataacaaatcctgccaggagtaacaacattcatcgatccacagaccatgctggttgatgcatgggtctgctggagccgtgcatgaacacagcactaacaactgacacacagcgaccttgcaatcaaaaacacagatgggcgacaacaaacgagacaaacgaacataaaccctttggactagggtaaacatcacggcggctaccaggataacttgggcggccgggcctaaccggtaagtt

SEQ ID NO: 1713 - DNA, 3647 bp, Zea mays
  Clone ID: PAT_MRT4577_183903C.1
gatgacgacgccaagccaagggtctattttttgaaataaaactgcaacggcataattgtgcaaaaaaaatccaaaaaggactaaaatgcaaaaaaaaaagttgggctttttcacagctcacaggaactctactcttctaaagctcatagctaaaccaaccagactttgcaccttgagttctacaaaacagctctttaaaagatacaaggatcacaatatcaaataaaaaacatgctcagagaattacactagcaataccacagtagttatatccaacttgagacatttcaaaacctttgctactgcctactggccggtctaacaaagaacaggagattaaatccaagatgcaccagaattatgccgctgtgacaattctccgtcgtacacaaagatcatcttacatataagcaggttcctagctaagtacaaggtaataaacatacttatccaaagaagcaccgtggggctctaaaccctcgtacaaacattttgttaagttgctgcccccagagtgtcggattttgggtcagccagcttctgtgttgtaatactacaaataaggcttgtgtgacctcgcaaaacagagaaactggctccaaagggaaatgagaaacaagcagagggccaataaaaccatgatagggggcagttggcatcacgatgctgctaacttttacttatcaggtagacgtctccccgttctaagcatcctccagctttggttcaagttcatcagagagatggtttggctctatcgacaaagagcttcctgcttttctcttccgggctagcatgacttctgatgtaggtgcctcatcggtgagagaagcttcttcactggcatcgccctcgtgttttgtagcaactgcccaggctatgggtttcacttcttctggttgaaaagacttagaggcaatcatacttgcttcatcacttggatttatcaacttcggtttctttttcacatagtcctgccgtagaggtctaggtatctggaacgaaaactgagctaaagttacaccctgagcaccatactccggattctcttggaggaacctatcgacttcaaccagagacctaagtttccttccagtaggagaggtatagtatacatcagcaaatttggtacccccttcacctcttatcctaatctgcctttcccatccgcgagggggttgtgcaatattgggtttgtcaatagcccaaagcctgctaccatcctgagatatatcttctgggtcattgcatgttacatcaggtctccattcacgagctcttttgcatacaaaaggttcctctataatacgttcacgaatttcttcatacttctctttcgttggaataagcctccatttaaaacatttagcacattggacagtgaatgctccaatagatggcgatattccccttgttatgattgacttctgcaaacggttttcccccagttcatcttgctctttatctcctgcttcagagttgaaaacgaccatttgatttgatgcagcttctgaagaaaaaccatcattgtcaaatcgggggccattactatcagaaggcaccacaatatgactgttctttgacgattgaggagatttagaagtttccatcggttttgtacaaattattagagcctgggtacccctgtattttttgaagagagactgtgtcgaactcaggaccttcggctcagtgggaagccttgctttaaatgcagttgtgatggcttattttatgcttcgcagcgaacgaagaaatcgatccgagcccggacggatctctaccacgccccgacccagtgtctacgatttgagcatgcagtaggcccccaacggcgggctccgaagatatcgaggtcggggggccgggggcggcgggggaacggggagggagtgctccggcgaagaacagcggggtttacggcggagccgcggaggggagggattgaggatgggagtgcttactcgcgttctccgcccacgcgtccgcccacgcgtccgcccacgcgtccggccccgcatggcaccccaggggcggagagcgacgaggagatacggcggggtgccagagatgggcggcgcgtcggcgtcggcctcgtcgggcgccggcgcggacgagcgtcccaagggggaggacggcaagcaggggcaggtggcggcgggggcgcagcctccagcgggcgggaagaagcgcgggcgcacggcgggggacaaggagcagaaccggctgaagcggctgctgcggaaccacgtgtccgcgcagcaagcgcgagagcggaagaaggcgtacctgacggagctggaggcgaaggccaagggtctggagctccgcaatgcggagctggagcagcgggtgtccacgctccaaaacgagaacaacacgctccgccaggttatagatgttagtggaaaagaattcaaattcacctgggcatctggacgtggcgaattgtgtgatatttatgaagaacgtcagagtggagaggatggaaatgggttgcttctggagtgtggctctacttggcgcaagtgaaccctatagcctgggcagttcctacaaaacatgagggtgatgccagtgaagaagcttcttttgccgatgagacacttgcatcagaagtagtgctaacccggaagaggaaaataggaagctctttgtcagtagagccaaaccatctctctgatgaacttgaaccaaagttggaggatgcttagaacggggagacttctaactgaaaagtaaaagtgggcagcgtcgtgatgccaacttacccccctgccatggttttattggtcctctgcttgtttctcgttttccttgggagtcagcttctctgttttatgtggtcgcacacggccttatttgtagtattacaccacagaagctggctgacccccactgagggagaggtgattgatgcaagcattgtgtatgatccttggacaagggaatcgcgggggtttggttttgtcaccatggctgctactaaggaggcagatcactgcatcaaatatctggattgttctgtgttgcaaggtcaggtcataattgtttagaagtactctacacagaacattttattgttttgtcttcaccaccgagaatccgagatcgcctcccatagcctccacatccataaggtcctgcttgactgcgacgacgtccaggctgatgccctcatcgtggatcgactcgcctcgctctagaaggagtggcccctctggagttgaatatgcagttataaccaatttttaccccttttatcctagaagagttgccaagacacggtataagaccatgataatagactaagagaggatttggctctaattactatatgttttatttatgcagtcccatgagaactttgagtatttgcagattgctttattaatttattaaagttaaagattgtatgtgttgagtatgtatccactcttgttggaagtgtcttgcaattccaatccaaggatgtataaaatactgcatgggctaagtatgtgttttttcatgtatttggagtatatatactttttgttgcttgagaacatgtatgtacactagaagcttgtcaattgtgtgaacttgagttgatccctgtctaacctgagtatatatatatatatatatatattttgttgcttgag

SEQ ID NO: 1714 - DNA, 393 bp, Zea mays
  Clone ID: PAT_MRT4577_184060C.1
tattcgagctcaagtcctacgcgctccaaagccctttcactttgcgaagctttttgaccccaggtccggtccctgacataaccgacaactcgaagagccgtggaggcgcatgctaggccggagtcctcgcaggaggaggaggaggactggaaggaggccgaggcggacgtccacgaaatcgaccgtgccgtcaccaatggctccgaagtggggggcgtagcccacagacaggccgatccgtttctacaccagacggaatatacgacctttttcactttgtccatgccaagtctctatagcaggcctagacgtggtctacaaacacatatattattgttggatgctgcaatgactagtcgacacataaattcaaaggaagaactgttatgactg

SEQ ID NO: 1715 - DNA, 1464 bp, Zea mays
  Clone ID: PAT_MRT4577_184395C.1
aaacaaaactgaagcaacccaacataagggcatttatgacacgataaggaatggaaaattcagtgctcatacctcctatcatactacagatttatagcagtggcagtgtggcttgtcgttttctcatcctgctctatttagccttcagcacctctgaactcagctgtcagctcgagttcagaaaaaaaaataacatatcacactgctttaatggggcgatcaccatgctgtgagaagattggactgaagaaaggcccgtggacaccggaggaggatcagaagctgcttgcctacattcaggagcacggacatgggagttggcgagcattgcctgtgaaggcgggcttgcagaggtgtgggaagagctgcagactgaggtggacaaactacctgagaccggacatcaagaggggcaagttcagcttgcaagaagagcagaccatcatccagcttcatgctcttttaggcaacaggtggtcggccattgcaacccatctaccaaatcgcacggacaatgagatcaagaactactggaacacacacctcaagaaaaggctggccaagatggggatcgatcctgtcacccacaaatctatcagtggcactcgcattggcaccacaaacgacaaatcaaccaaggccgccgcaagcctcagccacatggcacaatgggagagcgcccgcctcgaggctgaggcacggctggctcgagaatcgaagatacggacagcaacgccaacaccaactgctctccatgcgcagccaacgatactacctgcctctgctgcttctccatgccttgacgtgttgcatgcttggcagggtgcaaagatagacctggagtcacctacctccacactgacgtttacagggagcaatggtggcacgctgccaacccccaggaccaatggactagacgtatcagaaagcaactgtgcgatgtcgcatcagaggagtgatgagttggaggatgaagaaaacgattggcagatcttcagcaagcaccaattgctggaactcgacagcaaggagagggaagaggacttcattggttgtgaggagccgtggttctcagagatggctggggttggagctggcttcactggcatgctgcttggtgtatccaatgagcatgatgcatcagaatgctggggtgagtccaataatggccaaactgagcgcagcaaccaagcatcagatgaggaggacaagaattattggaatggtgtccttgacatggtaaactcagagctgacacccaagtcgcctccatttgtctagactctagaatacagtcccctccgttttatttcaagtactcctgagcaaaatctattggatcatctcaagtcaaaagagaaacagaacaagcactacaaataaatgctgcatgtgctacaacaatatgttttttttgtccatgcatgtgaaagtgaaataattaactattgtgtggatggagtt

SEQ ID NO: 1716 - DNA, 358 bp, Zea mays
  UNSURE (1)..(358): unsure at all n locations
  Clone ID: PAT_MRT4577_184607C.1
  unsure (1)..(358): unsure at all n locations
ggccggcggaggcgtatcggatccatttattgaactgttaacttaacttttcttagctcaccaccaccacacacggganagaggtatatctagcatagcaagccacccaatcatctacttaacaacaactagctagccatgctgccgtccttcttgtcgccgacggcgagcgccgcggcctctgtgacgcctccgtcgcggcccataccaagcaactacgggccccccgtgctgggcccgctgcgggaccggctcgactacttctggtttcagaaccaggaccagttctttctgaagcgcgcggcggcgcaccgtagaaccgtgtttctgaacaacataccgcccacctttccctttt

SEQ ID NO: 1717 - DNA, 1192 bp, Zea mays
  Clone ID: PAT_MRT4577_184761C.1
cctcgaagccggccggtccgcctcacggcgagaaccgaccggctcgacccttctgccggcgatgcgctcctggccttaactggccgggtcgtgcctccggcgccgttactttgaagaaattagagtgctcaaagcaagccatcgctctggatattatcctggtttaggattatgttgcttttgaaaaaaaaaaaaaaaaaaaagaaaaaaaccgcccgtcattttcgtcacccctgacgctcgacgcctctcctcctctcctcccccacccgtgccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgaacagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgccaagtttgtgttacaagtttgatgccctgggaatgccaggcaactaatgtggtaataaacattttgcccatcttttaaaaaaaaaaaaaaaaaaaaaaaaaaaaaaaaaaaaaaaaaaaaaaaaaaaagaaaaaaaaaaaaaaaaaagcggcc

SEQ ID NO: 1718 - DNA, 717 bp, Zea mays
  Clone ID: PAT_MRT4577_185079C.1
ccggccggggcaccggatccctcctctctttccccggcacctgtcacgggaggaggatggacaagagcggcggcgaggcgttcggttcgaatgctccgggcaacatcttggcggcaggcgggctgggtcccttgtggctcgtcgacattgccaacatgtgcctcatcctccacctgatcggtgcataccaggtatacgctcagcctgtcttcgcttcggttgagaggtgggccgcctcacggtggccagaagccaagttcatgagcagcgcatacaccgtgagcatccccctcgtgcagagaggatcggtcaccgtcgcgccgcacaagctcgtcctgaggaccgtcatagtcggcgcgacgactgcggtggcgctggcgatacccttcttcaacgccgtgctggggctcctcggcgcgttcagcttctggccgctcacggtctacttccccatcagcatgcacatcgcccagggcaagatcgccagggggaccaagtggtggtgccttctgcaggctctgagcatggtttgcttggtgatctcggtggccgtgggtgtaggctctgtcactgacattgtcgatagcctcaaggcctcttctagccctttcaaattgtaggctaacaggttactgtagtcatgtacaatgctctgagccgatcgtgcgttgaggtttaaaagaactgtggtgcgcgaattcgcgtcaatatcgaaac

SEQ ID NO: 1719 - DNA, 1490 bp, Zea mays
  Clone ID: PAT_MRT4577_185080C.1
gcgggacacccgggcgcgtgcacgggagacgggagtatggacaagagcgcggtggcggcatacgacgtcgagcggggcgactacgaggaggagcacgaacggagagggacggtatggacggcgacggcgcacattgtgacggcggtgatcggctccggcgtgctggcgctggcctggagcgtggcgcagctgggctgggtcgcggggaccctcgcgctcgccggcttcgcctgcgtcacctactacacctccacgcttctcgccaacgcctaccgcgcgccgcaccccgtcaccggcgacaggaaccgcacctacatggacgccgtcagatcgtacctcagtcccagggaggtgttcatgtgcgggatcgcgcagtacgtgaacctgtggggcaccatggttgggtacaccatcacggcgaccataagcatggccgcgatcaggcagtccaactgcttccgccggagcggcgccggcgcgcagtgcgacgcgccggggaccgtgctcatgctggcgttcggcgtggtccaggtggtgctgtcccagttccccggcctggagcacatcacctggctgtccgtcgtcgcggcggtcatgtccttcgcctactccttcatcggcctcggcctctcggtggggcagtgggtgtctcacggcggcggcctcggcggcaggatcgctggtgctgccgcggcgtcccccaccagaaagctctggaacgtgcttcttgccctggggaacattgccttcgcctacactttcgctgaagtgctaattgagatccaggacacgctcaagtcaccgccaccggagaacaggacgatgaagaaggcagcgatgtacgggattggagccactaccatcttctacatctctgttggctgcgccgggtacgctgcgtttggttcagatgctccgggcaacatcctgacggcaggcgggttgggtcccttctggctcgtcgacattgccaacatgtgcctcatcctccacctgatcggtgcataccaggtatatgcgcagcctatctttgcttcggttgagaggtgggctgcctcccggtggccggaggccaagttcatcagcagcgcgtacaccgtcagcatcccgctcatgcagagaggatcggtgaccgtggcgccttacaagctcgtcctgaggactgttctggtcgccgcgacgactgtggtggcgctgatgatacccttcttcaacgctgtgctggggctcctcggcgcattcagcttctggccgctcacggtttacttccccataagcatgcacattgcccaggacaagatcaccagggggaccaagtggtaccttctgcaggctttgagcatggtctgtttgatgatttcagtggccgtgggtataggctctgtgactgacattgtcgatagcctcaaggtctcttccaaccctttaaaaactgtaagctaaaggttattgtagtcacgtacaatacatataaaatctgctctaagtcg

SEQ ID NO: 1720 - DNA, 1948 bp, Zea mays
  Clone ID: PAT_MRT4577_185084C.1
ctcactgatgatgatggtggtcggggtcgttgttgtcgctacataataacgataattcagaaggagctacaagagcagagagagagaggaataatcgatcccttgacagcagatattatacattggcctcgaggccggccggggcaccggatccctcctctctttccccggcacctgtcacgggaggaggatggacaagagcggcggcgaggcggcggcggcggcagcagcagcagacgacgtcgagcggcgggggggcgactacgagcaagacgagcacgagcggagagggacggtgtggacggcgacggcgcacattgtgacggcggtgatcggctccggcgtgctggcgctggcctggagcgtggcgcagctgggctgggtcgcggggcccctcgcgctcgccggcttcgcgtgcgtcacctactacacctccacgctgctcgccggcgcctaccgcgcgccgcaccccgtcaccggccacaggaaccgcacctacatggacgccgtcagatcgtacctcagtcccagggaggtgttcatgtgcggggtcgcgcagtacgtgaacctgtggggcaccatggtcgggtacaccatcacggcgaccataagcatggccgcgatcaggcaggccgactgcctccgccgggacggcgccggcgccggcgcgcgctgcgacgcgccagggaccgtgctgatgctggcgttcagcgtggtccaggtggtgctgtcccagttcccgggcctggagcacatcacctggctgtccgtcgtcgcggcggccatgtcgttcgcctactccttcgccggcctcggcctctccgtagggcactgggtgtctcgtggcggcggcggcctcgggggcagggttgcaggtgccgccgcggcatcctccaccaggaagctctggaacgtgcttctcgccctggggaacattgccttcgcctacactttcgctgaagtattgatcgagatccaggatacactcaagtcaccaccaccggagaacaggacgatgaagaaggcagcaatgtacgggatcggagccaccaccatcttctacatctccgtcggctgcgctgggtacgccgcgttcggttcgaatgctccgggcaacatcttggcggcaggcgggctgggtcccttgtggctcgtcgacattgccaacatgtgcctcatcctccacctgatcggtgcataccaggtatacgctcagcctgtcttcgcttcggttgagaggtgggccgcctcacggtggccagaagccaagttcatgagcagcgcatacaccgtgtccgtcagcatccccctcttgcagagaggatcggtcaccgtcgcgccgcacaagctcgtcctgaggaccgccatagtcggcgcgacgactgcggtggcgctggcgatacccttcttcaacgccgtgctggggctcctcggcgcgttcagcttctggccgctcacggtctacttccccatcagcatgcacatcgcccagggcaagatcgccagggggaccaagtggtggtgccttctgcaggctctgagcatggtttgcttggtgatctcggtggccgtgggtgtaggctctgtcactgacattgtcgatagcctcaaggcctcttctagccctttcaaaattgtaggctaacaggttactgtagtcatgtacaatgctctgagccgatcgtgcgttgaggtttaaaagaactgtggtgcgcgaattcgcgtcaaatatcgaaacttctcgattgtattttcagagagtatttattgaatttgatcagtaagcacaattttgctggctaacaggttactgtagtcatgtacaatgctttgacccgatcgtgcgttgaggtttaaaagaactgtggtgcgcgaattcgcgtcaaatatcgaaacttctcgattgtattttcagagagtatttattgaatttggtcagtaagaaaac

SEQ ID NO: 1721 - DNA, 194 bp, Zea mays
  Clone ID: PAT_MRT4577_185199C.1
cgaagaagagctctgtgatgccgcggtctacgccgggagcaatttcatggcaccattggagccctactaacaaaggaagaggatgacggtgttcttgtgtggagctatactaactcggtgctgcgtttttgctacatggttggaccgccggaataaatgtatggtccagtttgctcgacagctacttaggtgat

SEQ ID NO: 1722 - DNA, 144 bp, Zea mays
  UNSURE (1)..(144): unsure at all n locations
  Clone ID: PAT_MRT4577_185297C.1
  unsure (1)..(144): unsure at all n locations
cgcatcgccatggcgccgccgcagacgatcccccggcgcggcctctttattggcggggcctggagggagccgtgcctcgggcgccgnctttcccgttgtcaacccggccacccgggccaccatggcgacatcccggcgggcacg

SEQ ID NO: 1723 - DNA, 276 bp, Zea mays
  Clone ID: PAT_MRT4577_185349C.1
gttcactccgtccctctccccgcgagccgccagaggcacgttcgccctcggttcgacccggattcgtccgcccgagaccgggattcgctccgcaaagcgcggatctgaacgctgcacttcgcgtaaccaatgaaatacgtcatcaagggggccaaatccaagggcgccgaggaggccgatgccaagctggcggcgaacagcaaggtggcggacaagcccaccaagggcaagaaagagaaggccggtaaggaccctaacaagcctaacacggctccc

SEQ ID NO: 1724 - DNA, 2048 bp, Zea mays
  Clone ID: PAT_MRT4577_185399C.1
ctctctcatctgtaggatgtaaaaaactcagccaggaaagctgctgaaactgttctgttggttattgatgaggaaggagttgaaactttgatacctgagcttctaagaggaatcactgacagtcaggcatcaatgaggcggggctcagcctacctaattggtttcctctttaaaaacactaaactatatttggctgatgaggcttctgatatgatgtcaaccctaataattttgttgagtgatacagacaaggctactgtatcagctgctttagaagcattttcaagagttgttgcatctgttccaaaggaacagctcccaacacacataaaactagtgcgcgatgctgtctctacagccagagataaagagcgtagaaggcgaaagggtgtgcctattcttctgcctggcttatgtctttctaaagcactgcaaccttttcttcctatatttcagcagggtttaattagtgggtcggccgaaacaaaggagcaggcggctgaaggtctaggagagttaattgatgtaacaagcgagaagactcttaaggaagttgtagtgccaattacaggacctcttatccgcatccttggtgatcggtttccatggcaagttaagtcagcaatcctatcaaccctgacaatcatcatcatgaaaggtggaattgcacttaagcccttccttccacaacttcaaactacattcgtgaaatgtctacaggataacaataagtctgtccggacgagggctgcagctgctctcggaaagcttagtgctcttagcacacgggtggatcctttagttagcgatcttctgtccatgttgcagtcaggagatgaatctgtaaaagaaagtgtgctttctgcactcaaaggtgttatcaaacatgctggcaaaagtgtcagtgctccaataaggtcacggggatgtgctcttcttgaagatctgctgcaggctgaagctgatgatatccgcagttgtgctgcaaaagtgattggcacattgtctcagtacatggatgacagagagattccagatttggtgcaaatccttttggaagtgggcacctcatcggactggtgtaccaggcatggtgctttgttagcattatcatccatatcaatgcattctccatcaaaattatgtgatttggcatcctttccatctctggttgatcttctgaaagattctcttaaagacgacaagttccctgttcgtgaagttgctacaagaactctgggaaggatactcgttttcgagctacagtcagaagctgacaccttgcaacttgttcagttgcttgtcttggccttgcgtgatgattctagtgaagttaggagaagatctttgtcgtgtatcaaagctgctgcaaagatgaaccattcagctcttgctacacatcactctatattgggcccggcaattgctgatgctttgaaggactctagcatgcctgtacgtctagcagcggaacggtgtgcccttcatgttttccagttgactaaagggccagataatgttacaacagcgcagaagtacctaggcatgactggcttggaagtgaagaaaatcgcaaagcttaacgaggagagtgatggcagtgagagcagtgatgatgacaggaggacatgacctctactcacagcaagcttgtatcggttcagttattatgatctttatatatagttaggcaagttagctacattgacagtggaaggtggggtcattttttgttctgtctgacccattttgtgaacatcctttttgacaacaaatactggcagaggaagacacgtcggcatttgtcatattttgttgcggcaaaccgacaatgtttatggaaaccaacaatttttgttaaagttattcaatcaaagaagtatatgtacccagtttttcccagagttgggaccgggacttgtgttcacttcaatttgaatggacaaatttcgaggacaaaaatatataattaaatttataaaaaaatttgttagaaaattttagggggtgtttctttattttgtgggcttttttttagggtttctttt

SEQ ID NO: 1725 - DNA, 3408 bp, Zea mays
  Clone ID: PAT_MRT4577_185400C.1
aattcggcacgagggttgcttcctgctatcgaggatgggatcttcagtgataattggcgtatccgacaaagttctgttgaacttcttggggatctcttatttaaggtcgctggaacttctgggaaggcaatccttgagggtggaagtgatgatgaaggtgctagtacagaggctcaggggcgtgctattattattctgcctgacctcttcttccgatccttgagatcgggttccatagcacgcaacctcgacaacccctgcaacccttccgttcgtcatcgttaagggtggagttgcacttatgcccccccatcctcaaagtcaaaccactgttggaaatacttggaagggagaaacgcaatgaagttcttgctgccatttatatgcttcgttctgatgtcagcttgactgtccggcaggctgcattacatgtctggaagacaattgtagcaaatactccaagaactctgaaagagataatgccagtacttatggacacacttatttcatctcttgcatcatcttcctcagaaaggcgtcaggttgctggaagatcacttggtgagcttgtaaggaagcttggtgaaagagttttgccctcgattattccaatcctgtcacaaggactcaaagacccaagtgctagcagaagacaaggagtttgcattggtttgagtgaggtcatgggcagtgcaggaaaacaccagctattaagttttatggatgaacttattcctaccattcgtactgctctatgtgacagcacccaagaggtccgtgaatctgctgggttagcgtttagtactctgtacaagagtgctggactgcaagccattgatgagattgtccccacattgctacgagctttggaagatgatgatacatctgcaacagctcttgacggtctaaagcagattttaagtgtcagaacagcagctgttttgccccatatattgcccaaattagtccagcctcccctctcttcattcaatgcacatgcattaggtgctctagcagaggttgctgggccaggtttgaattcacatatcggaactgttctcccagcattgattcttgctatggatgatgaagatgcggatgtacaaaactcagccaggaaagctgctgaaactgttctgttggttattgatgaggaaggagtggaaactttgatacctgagcttctaagagggatcaatgacagtcaggcatcaatgaggcggggttcagcctatctaattggtttcctctttaaaaacactaaactatatttggctgatgaggcttctgatatgatgtcaaccctaataattttgttgagtgatacagacaaggctactgtatcggctgctttagaagcattttcaagagttgttgcatctgttccaaaggaacagctcccgacgcatataaaactagtgcgcgatgctgtctctacagccagagataaagagcgtagaaggcgaaagggtgtgcctattcttgtgcctggcttatgtcttcctaaagcactgcagccttttcttcctatatatcagcagggtttaattagtgggtcggccgagacaaaagaacaggcagctgaaggtctaggagagttaattgacgtaacaagtgagaagactcttaaggaagttgtagtgccaattacaggacctcttattcgcatccttggtgatcggtttccatggcaagttaagtcagctatcctatcaaccctgacaatcatcatcatgaaaggtggaattgcacttaagcccttccttccacaacttcaaactacatttgtaaaatgtctacaggataataatagtgagagcagtgatgaggacaggagtgctttgggaaagcttagtgctctcagcacacgggtggatcctttagttagcgatcttctgtccatgttgcagtcaggagatgaatctgtcaaagaaagtgtgctttctgcgcttaaaggtgttatcaaacatgctggtaaaagtgtcagctctgcaataaggtcacgtggatgtgctcttcttgaagatctgctgcaggctgaagctgatgatgtccgcagttgtgctgcaaaagtgattggcacattgtctcagtacatggaggagacagagatttcagatttggtgcaaatcctattgaacatgagcacttcatcagactggtgtaccaggcatggtgctttgttatcgttctcatacatatcaatgcattctccatcaaaattgtgtcatttggcatcctttccatctctggtcgatcttttgaaaggttctctcaaagatgacaagttccctgttcgtgaagttgctacaagaactctgggaaagatactctgttttgagctgcagccagaagctggcaccttgcaacttgttcagctgcttatcttggccttgcgtgatgattcaagtgaagttaggagaagatctttgtcgtgtatcaaagctgctgcaaagacaaatcattcagctcttgctacacatcactctatattgggcccggcaattgctgaagctttgaaggactctagcatgcctgtacgtctagctgcggaacgctgcgcccttcatgttttccagttaacgaaagggccagataatgttacagcagcacaaaagtacctcgggatgactggcttggaagtgaagaaaatcgcaaagcttgacgtggacagtgatggtagtgagagcagcgatgatgacaagaggacatagactctactcaacagcaatcttttttcggttcagttgttatgatctttacatatagttagctacattgatagcggaatgtggggtcattttttctgtctggcccattttgtgtacatcctttttgacaacaaacaggtaaaagtgacaacgtttgcaaatcgacaaacaatggacacaagttgtattgcaaccaaggactgattcgttagtttgagcacagcacaaccacccagttcaacgataacgcatgtcaatgtaagccacgcataccatatagtatcatatcgtcgagtattgttcgtaccacatcttcctcccagttgatctccttgggcaaggtaggcccttccctggacagctcgttgggcatcttgttgagcatgctctctgctctgtacctgaacgctggagtccacgaacagactgctctgagcggcgtcaatgtggataggaatgtaatcggacgtatattactggttccatgtttgttttcatattttctcattggatattaatgcaaatattatcgagttgggcaaaaaaaaaaaaaaaaaagcggaaaaaaaaaaaaaaaaaaaaaaaaaaaaaaaaaaaaaaaaaaaaaaaaaaaaaaaaaaaaaaaaaaaaaaacattccctttaaaaaaaaaaaaggggggcacttattttgccaccaaatttttttttcctcaggg

SEQ ID NO: 1726 - DNA, 1916 bp, Zea mays
  Clone ID: PAT_MRT4577_185453C.1
gctcgaggccggccgggacaggtcaccagttcggtcctgcgctctcgagtcgagactccaccttccattcatttcatctgctccatctctctctttgttcgccggcgtataataagcttcccctttctgcaactgatctgatccgggctgccgtgagctctgctcgccctgatggagttcaagagggatgtatggagcctgctcctcgtgctgctcctcgggcagctcgtcgccttctccatggccgcctcaagctttgcctcctccctcattgctaatcttggagtcgatgccccactgacacagtctttcttagcctacctgttgctgaccttagtctatgtaccaatcgtcctgcgtcgacggcagaagctgcaaatagcttggtactggtacctagctctggccttctttgatgtacaggggaattatcttgttgtgaaggcgtaccagtactcatacattaccagtgtgactttgttggattgctggactgttgtatgggtcgtcatgctcacctggtacgcactgggcacaagatactcactctggcagttcgtgggggcagggacatgtgtggcagggctcgcccttgtgctgctttcagatgcaaaatctcaagatgagcaagatccgaaaaaaataccacttctgggggatgcccttgttattgctgggacagttggttttgcgtttagcaatgttggggaggaatactgtgtcaagaaaaaggatagagttgaagttgttgcaatgcttggtctctttgggttgctgatcagcacagtgcagatacttgtatttgaaaggaagggcctagaagcagttacatggtctccaacaatgataagtctgtttgcaggatttgcagtggcaattttcgtattctacacagttgctcctttcgttcttaagatgagtggagctacattgttcaacctttcactgctaacatctgacatgtgggcagtcgccattcgagttttattctatcagcaagagataaacaggttgtactacctagcattcgcagttgtggccattggattaatcatctattcgttgaatgatagatcttcagatgatgaaacagctggaagtacagaagcaccggcccaatatcagcaacttccaattgaagacaattcaacaagaattggttctagttcaggtagccaagaaaggacacataaggaagaagttcatatctgttagtgggataatgtattaatgtacgaagacacttcattgtcaatgcatggatttttaccaaatcaaatatggcatagagatatgcagagtaaaatgctggttgcttcatgtataggaaaatgtttaattggctcaagaagctaagcaagatgaggaagagaatcagaattaattttctttacaagtcagtccagcagattattcacaagagcagaaccattgctgaaggctcccgcatcagtgagatctaaggaagggataatacatcgggttaaaatgatctttgactagggattgtgaacaatcacagctggtctgcaaagcataatagcaacagtatgaacatgtaaagggagttactagtcactaaagctctttcaagaattgcctatgaaggaaaaaagatatttttagatagcatatggatagcttacatgctttactggaatgcagagtgctaaagcgccacaatattttcttgttaggagaattatgatttaatgatattttctatattactcattgtaaaattctatgagaagtatcatgccccgtgaattggaagctaaaaggggtaagtgaaaaatagggggggaatttggttgtgttagtgttagtgtatctggttaggccttagtgttagtgtatctggttaggtctatgtaccaggcccatgtaagactatattgctaccctctagggtt

SEQ ID NO: 1727 - DNA, 204 bp, Zea mays
  Clone ID: PAT_MRT4577_185609C.1
caagctcgcatatacatcctctgaagattggcatcaagacctgtggcactaccaagcttctgctcaccattccaagaatccttgagcttgctgaagagccgtctatgccacttgctgctgtgaagaactcccgtgggacgttcattttttctggggcacaggcaagcccccacaggaggctttttgaggaagatgctgcacttt

SEQ ID NO: 1728 - DNA, 440 bp, Zea mays
  Clone ID: PAT_MRT4577_185727C.1
gggacaaaaaaatcccccacattaaaatgggggcatgaacggacaaaggaaaaatactggactcctcggccgccactcaaaaaaggacaagcttattgcccttaactaagggatatcttacacaaacccaagcaaagcaaaccgggcttttaacggacgaaaaacacccaacccccgggaggggggggcccctaatactaaactaaaagcggggggggtatttgggctgggcctgggcctgggcccggatcttgggcccccttcccgggttaggacccaggcccgaccttattgacaagcgccagccccttgctggggacctgcccgaccttaacgaccttgccccggatgggggcccccgtgccggcttcaacggcgcgggacaaaaggccctcaaggcaggtgtcctcttcggggagcgcggcgctccaccaggtttt

SEQ ID NO: 1729 - DNA, 249 bp, Zea mays
  Clone ID: PAT_MRT4577_185754C.1
gtgaaaacccaattgttcaactcctactttaaccaacaggcaatcgcgacgggcatgtaaccattatcacccttgttcctccaacaaccgtcacccctattacagcaattacctttgtttcattagatggcacataacatcatggcacaacaactacaacaacttgtgctaacataccttgctgaatactcttatcaacatcagttatttccattcaacctactgtctgcattgaactctacttcttat

SEQ ID NO: 1730 - DNA, 359 bp, Zea mays
  Clone ID: PAT_MRT4577_185782C.1
acacctatagtgagtcgtattaaactacggcctgcaatggtgttcttcgcgttgaaatgaacagtggtgcctatggatgttaggtcactgcgggatcgacagccacggctcatagacctacatccacgaagttcaaagatggcatcacgatctcaactggacagcgattgtatcagtacatccactcagccgtgtgacaagtcctcatcagacagggtgttctggggaccaaggtcaagatcatgcttgactgagacccgaagcggcacgttgcgcctatcaaccctcatcccgacctggtgaccatccataatccgagacgatgatgacaagcatctctctccgtgtcttggcaactg

SEQ ID NO: 1731 - DNA, 309 bp, Zea mays
  Clone ID: PAT_MRT4577_185827C.1
acggttgtggaggctaatacctcatatactggtaatcattttcatgccaaatgccactttggggcggtagatatattcaaccggaagaagctctaatatattgttccttcttcacacaactgtgatattccgcatgtgaaccgcactgactatcagctgattgatatatcaccaaatggatttgcgagccttcttacttaagatggcaccactaaagatgatcttacactcccaactgatgaaacttttgttgcccatatcaaggaagggtttgaaagtggcaacgatcttcttgtgactgtccaccct

SEQ ID NO: 1732 - DNA, 322 bp, Zea mays
  Clone ID: PAT_MRT4577_185835C.1
ctgacgcgtggtcggacgcgtgggcaaagaattccctcccctagccgccgccggcgatcgtgtccctgttaggtgccgggaccgatgaactggccgagttctatgtagagaatcggatttgcttgtatcaacacggggtccgctgcgtctggtggtggtgaatgggagaaattcatgagatctgttcctgatcaggcgtgcgagctcgggaatcaagagtttcacacatagctcctgcgatttgaatttgacgtactaatggagcctcacggtggcaaaaaggctatcagtaatcgatccatgatgtatgaagctccccttg

SEQ ID NO: 1733 - DNA, 568 bp, Zea mays
  Clone ID: PAT_MRT4577_185846C.1
ggccgctttctcttttttttttttgttggggtttttttttttttttttttttttttttttttgtgggttttttttttttttttttaaacaactaaacatgtagaaatcagagttgcatacattttttgggccctggtcccacgatcatacacaagcacatgcttacacacacgtttacatacgggaaagaagggggccacgcttttttttgcatcacacgagcgcatacatacgttcgcgcgcacaaaacggggggcgctcgatttcacttttacacacgcccgcgttgcacacggggagggaccactattcgggagggatcaattagccgaaaaagtgggggtttttttcgccgccggcctcctcggggaccttgggggccttttttttttcggggggctcggggaaggcgaaacccccggaaccgacggccgccgccgccgaaacctccttcttaatcttggggcggggcgcgtgctccgggtccttttttgcctcgggcttctcgtaaagggcgaaggccccggcgggaatggccccggcctcaccgaggggctgcttgggctta

SEQ ID NO: 1734 - DNA, 1130 bp, Zea mays
  Clone ID: PAT_MRT4577_185876C.1
ctttaacgcccgaaacgaacacctgaaactacaacatggcggatctgatcaaggcagtcgatatccgaggcggtaaaggcgagcgagatgccctcttcatcaaccctcagacgccaaagccctcgcctactgaaggacaggccctcgtccgtgtcaaagcctttggcataaaccgcatggatatagtccagcgacgcggcttttacccgcttccgcctcaagcccccgcaacgctgggcgtcgagttcagcggcaccatcgagtcccttgggcctggtgaccacggtgcctttaagcaaggtgacgaagtctttgggcttgcctacggtggcgcctacgccgagtaccttgccgtcagcacacgcatgttgctgcacaagccgtcgtccatggactttgtgacatgcgctggcatcccggaaacctggatcacggcgacacaggcactgcaccttgtgcttggcttcaccaaaggtaagtcgatcttgtggcatgctggtgcctcgggcgtgtctattgctggcatccagctgtcaaagattgccggtgcatcccaggtctttgccacggccgggtcccaggaaaagtgcgactttattacctcgaagctcggagccaccgcggccttcaactacaagacgcaggactgggcggaggagatcaagaaacacaccgacggtaacggcgtcgactatatcgtggactttgttggtgcaagctacttccagcagaaccagacggccgctgcacgggacggacgtatcgtcctcctgggtacgctgggtggtgtcaagatccccgaagccgacatctcgcagatcctgtacaagaggctccgaatcgagggcagcacgctgaggagccgggacgaggagtaccagggaaagcttcgtgaccgcctcgaagagtatctcccagactttgagtcgggcaagttgaagatccttgtggacaaggttctgccatgggaggagatccaggaggctcacaagcacatggaagaggccaagaatctgggcaagatcatatgtactatctcgtaggtaccatccataactcgaaaataggagacaactcttgacgacgccacgcttgtgttcgtcaaagcaaagaaatccatcgctttcctc

SEQ ID NO: 1735 - DNA, 277 bp, Zea mays
  Clone ID: PAT_MRT4577_18590C.1
tcgttccagcactgaacacttgattgattcagtaggtagctaggtagctgaatcacaaatggatcctaccaagttccgtccgtgcagcagacacgacacgacggggacgacaacgaacgcgggcgctcctgtgtggaacgacaacgaggggctgactgtggggccttgcggtcccatcctggtggggggctaccacctgagcgagaaggtggcgcactttgcgctcgagggcattccggagcgcgtggtgcacgcccgcggggccaccggcaggggt

SEQ ID NO: 1736 - DNA, 911 bp, Zea mays
  Clone ID: PAT_MRT4577_18595C.1
caacaatatgggttttgttaagttgattaagactaaggcatacttcaagcgctaccaagtcaagttccgccgcaggagagagggcaaaactgactacagacaacgtacaagacttatcacccaagataagaacaagtacaacactccaaagtacagactcgttgtcagaaagaccaacaagaacatcatcgcccaaatcatctacgctaccgttcaaggcgatcgtgttgtgaacgctgcctactcctctgagctcccaaagttcggaatcaagctcggtctcaccaactacgcttccgcttacgctaccggtctcttggttgccagaagacacctcaccaagatcggtcttgccagcaagtaccaaggaaaggttgaagccgacggtaacgactacaccgtcgaaccagctgaaggaccacgcccattcaaggcccttctcgacatcggtctcgctcgtaccagcactggagctcgtatcttcgctgttgccaagggtgctctcgatggtggtattaacatcccacacagcgtcaagcgcttcgccggctacaacgctgaaaccaagaagcacaaccccgaggtcctcaagaagtacatctacggacaacacgttgccgaatacatgaagaagctccaaaaggaggagccacaagcctacgaaaagcaattctcccgcttcgtaaaggccggagtcaaggctggtgacattgaaggaatctacaagaacgcccacaaggctatccgcgctgacccaacaaagaaggccaacgagaagaaggcagtcgaacacaagagatacaaccccaagagacttacacacgcccaacgtgctgaacgtgttgctaagaagaaggccatcttgggactctaaatgtcttttcttaacttacaatataaaacctatgaac

SEQ ID NO: 1737 - DNA, 1245 bp, Zea mays
  Clone ID: PAT_MRT4577_186005C.1
ccggccggggcgccatcttttctccaccatccaaaaaaagggtcccgacgatacgcctaatagacattgggcggctagccctccccagcgcagcgcgcagcgcagcccacctatcaataaccgacgagcgaggcgcgagaaccgacttgccaccggctgctcgccgtctctctctctccctcggggcgcgcgcgcgggagacaggccaaccgatcgtcaggcggccagccatgggcaagcacgggcacggcaagtgccacgacgtggaggcgtgctacccgccgggggcagcgggcggcggcaagtacccgtacatgacggagaacccgcagctgcggtgggccttcatccgcaaggtgtacgtgatcgtgtgcctgcagctgctgctgacggtggccgtcgccgcgacggtgaacctggtgcgcgccatcggggacttcttcctctcccgcaccatgggcgccatgttcgccatcatcggcgtcatcgtcgcccccatcctcgtgatgatcccgatgatcatttaccggaagcggcacccggtgaacctcgcgctcctggcgctcttcaccgtctgcatcagcttcgccgtggggctgagctgcctgacggcgaacgggccagtgatactggaggcggtggtgatcacgatggtggtggtgctggggctcaccttctacaccttctgggcggcgaagaggggctacgagttcgagttcctggggccgttcctggtgtccgcctgcctcatcctcatgctcttctccctcctgcggatcatcttcccgctgggcaggacggggaccatggtgtacggctgcatcgccgcgctcgtcttctccggcttcatcatctacgacaccgacaacctcatcagggtctactcctacgacgagtacgtcgccgccgccatcgagctctacctcgacatcatcaacctcttccaggccatcctagcggtgctcgaaggcgtcgactgatagggtcatatatataacacggccggctgaggctcatgggctgtgagcatatatacataggatcatatatatgcaatctatacatgagctaccactaccactaccgagagatgggttccaagcttgctgggcaatctgtaatccatagacgatagatagggtcgaacggcaccgccgtgattgaacattattgctacaacgaaacattgcaaatgcaattcattatcttctcttgcaactaaaaaaaaaaaaaaaaaaaaaaaaa

SEQ ID NO: 1738 - DNA, 347 bp, Zea mays
  Clone ID: PAT_MRT4577_186057C.1
atattattatttattatgaaaaaccaagaagcaccatatattccttaggattaacagagaacaaatcctgacaggagtaacagtatacatcgatccacagaccatgctggatgatacatgggacagctgagaccgaggaatgaacacagcactaacaactgacacagaacgaccttgcaataaaaaacacaaatgggcaacaacaaacaagacgaacgaagataaaccctctggactagggaaaacatcacggaagcaaacaggataactgggacgcgcgggcccaaccggtcagaacctccagttgccggcagagttgcgcgaagcacgacagcacggatgccacc

SEQ ID NO: 1739 - DNA, 2275 bp, Zea mays
  Clone ID: PAT_MRT4577_186155C.1
agctcgaattccgttgctgtcggtccaggcgttcttgctgcctcccttagctcgtaggctgcgctctagccctcgctataggctgccctcctccccgtcttcgtccgctccatcgtcccagccccctgcgcgagtgtgaggggtgcgaagctcgagtcggccaggagcgaacttctcatcatcagccaagtgtaaagagtgcgaagaagcagtagcaaaaggattccattctcgtgttcttggagtggtccatcgatcgagctccgtgaaagagagagagagagagcaagcaatggcgacagcagggaaggtgatcaagtgcagagccgccgtggcgtgggaggccggcaaaccgctgtccatcgaggaggtggaggtagcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgttcctcccggtgttcaccggcgagtgcaaggagtgcgccgactgcaccgcggggccggccgggaccaacttctcatcatcagccaagtgtaaagagtgcgaagaagcagtagcaaaaggattccattctcgtgttcttggagtggtccatcgatcgagctccgtgagagagatagcaagcaatggcgacagcagggaaggtgatcaagtgcagagccgccgtggcgtgggaggccggcaagccgctgtccatcgaggaggtggaggtggcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccatgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcacggatcatcggcgttggacatcaacccagcaaaatacgagcaagctaagaaatttggctgcactgaattcgttaacccacaggaccacgacaaacccgtgccagaggtgctgattgagctgaccaacggtggcgtcgaccgcagcgtggagtgcaccggtaacgtcaacgccatgatatccgccttcgaatgtgtccacgacggctggggtgtcgccgtgctggtgggtgtcccgcacaaggacgaccagttcaagacccaccccatgaacttcctcagtgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcacctttatcgtcagtgtgtggtcaggtttcaacccttctcagaacaaccccctcccagaaaaaaaacaaaggaagaagtttgtgtccaggtttcagaatcccctgtctgtaattaccattttgcatgacaataatgagatactgtagatattaataatgttccagaccttcaaggccaaaaaaacaaaaaaaaaaacaaaaaaaaaagcggaaaaaaaaaagaac

SEQ ID NO: 1740 - DNA, 3014 bp, Zea mays
  UNSURE (1)..(3014): unsure at all n locations
  Clone ID: PAT_MRT4577_186156C.1
  unsure (1)..(3014): unsure at all n locations
tgggccgcccggaggagccggccgggaccaacttctcatcatcagccaagtgtaaagggtgcgaagaagcagtagcaaaaaggattccattctcgtgttcttggagtggtccatcgatcgagctccgtgagagagagagagagagagagagagagagagagagagagagagagagagcaagcaatggcgacagcagggaaggtgatcaagtgcagagctgccgtggcgtgggaggccggcaagccgctgtccatcgaggaggtggaggtagcgccgccgcaggccatggaggtgcgtgtcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggcaagtcccgcttcaccatcagcgggcagcccatcttccacttcgtcgggacgtccaccttcagcgacgcagcgctgcaggcaggcgaacggaggctggacacccctgtttcggccgccttgtccaagcaaaacaatgcaacttctttccctacttgcactccaagcatacccttaattactcgccgattcctccagaaccaggactatatatacacggctcgcctcgccttcgttcctcaccaaaatctacagccaacgaactgcagagcagaaacagcgacagagatccgtcttcttcctcttcgagttcttggagcttgcgaccgacagggacggggatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaaggggcaaactccggttttccctaggatcttgggccatgaagctggaggcattgttgaaagtgtcggagagggtgttaccgaactcgtgccgggtgaccatgtcctcccggtgttcactggcgagtgcaaggactgtgcccactgcaagtcagaggagagcaacctctgtgacctcctcaggatcaacgtggatcgtggcgtgatgatcggtgatggggagtctcgcttcaccatcaatgggaaaccgatcttccacttcgtcgggacctccaccttcagcgagtacaccgtgatccatgtcgggtgcctcgccaagatcaacccagaggcgccccttgacaaagtttgtgttctcagctgtggtatctcaactggacttggtgctaccctcaatgttgcgaaaccgaaaaagggttcgacggtggccattttcggtcttggagctgtaggccttgctgccatggatggagccaagatgtctggggcatcaaggatcacgttttattgctactaaccatgcaaaatacgagaggaccagagcgccttcaacttttcatgcnccatntgctgtgcgacatgcctgccctgcaggaggagcaagcttgcaatgaagctctaatcctccatcctcatgatgcagcgcaggctctccgccttgagcatcaggtcgaacgccgtgttgatctccgagaagggcacgctgtgcgtgatgaacttctccagctccagctccttcttcatgtacatctcgacgacgttgggcaggtcggtgcggggcttgtagtttccgaagaaggtgcccttgagtgtcttctcgctgaggaagttcatggggtgggtcttgaactggtcgtccttgtgcgggacacccaccagcacggcgacaccccagccgtcgtggacacattcgaaggcggatatcatggcgttgacgttaccggtgcactccacgctgcggtcgacgccgccgttggtcagctcaatcagcacctcttgcactggcttgtcgtggtccttggggttaacgaattcagtgcagccaaatttcttagcttgctcgtattttgctgggttgatgtccacgccgatgatccttgatgcaccagccagtctagcaccttccatagcagcaaggcctacagccccaagcccgaaaatcgccaccgtcgagcccttggctggtttcgccacattcagtgtcgcgccaaggccgatcgagataccacagctgaggatgcagactttgtcgagaggcgcctcggggttgatcttggccaggcagccgacgtggatgacggtgtactcgctgaaggtggacgtcccgacgaagtggaagatgggctgcccgctgatggtgaagcgggacttgccgtcgccgatcatcacgccgcggtcgacgttgatcctgaggaggtcgcacatgttgctctcctccgacttgcagtgggcgcactccttgcactcgccggtgaacaccgggaggacgtggtcgcctggcgcgagctcggtcacgccctctccgacgctctccacgatgcctcccgcttcgtgtcctaagatcctcgggaacaccggggtttgccccttggcctcccagaagtagacgtcggtgtggcagagcgcggtgtagaggatcttgacacgcacctccatggcctgcggcggcgctacctccacctcctcgatggacagcggcttgccggcctcccacgccacggcagctctgcacttgatcaccttccctgctgtcgccattgcttgctctctctctctctctctctctctctctctctctctctctctctctctcacggagctcgatcgatggaccactccaagaacacgagaatggaatcctttttgctactgcttcttcgcaccctttacacttggctgatgatgagaagttgttccccgcccccctcgagggccccaa

SEQ ID NO: 1741 - DNA, 1812 bp, Zea mays
  Clone ID: PAT_MRT4577_186157C.1
attgggtacctcgaggccggccgggacttgcgccgctacggtccaggcgttcttgctgcctccctcgtagactagactctagaccactatatattcattgggtacctcgaggccgggcgggaccaacttctcatcatcagccaagtgtaaagagtgcgaagaagcagtagcaaaaggattccattctcgtgttcttggagtggtccatcgatcgagctccgtgaaagagagagagagagagcaagcaatggcgacagcagggaaggtgatcaagtgcagagccgccgtggcgtgggaggccggcaaaccgctgtccatcgaggaggtggaggtagcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccacgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggcggctgtaggccttgctgctatgcgaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacatcaacgccatgatatccgccttcgaatgtgtccacgacggctggggtgtcgccgtgctggtgggtgtcccgcacaaggacgaccagttcaagacccaccccatgaacttcctcagcgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcacctttatcgtcagtgtgtggtcaggtttcaacccttctcagaacaaccccctcccagaaaaaaaacaaaggaagaagtttgtgtccaggtttcagaatcccctgtctgtaattaccattttgcatgacaataatgagatactgtagatattaataatgttccagaccttcaaggccaaaaaaaaaaaaaaaaaagaaaaaaaaaaagggcggccgcgctcgaccaccatagaggatcacgcctgccgtacgcgtgca

SEQ ID NO: 1742 - DNA, 1960 bp, Zea mays
  Clone ID: PAT_MRT4577_186160C.1
gtaccctcgggatctggggatgccctccttgtcctggatcttggccttcacattgtcaatggtgtccgaggactccacctccaaagtgatggtcttccccgtcagagtcttcacaaagatctgcatcttggcggcgatggggggccgcctgcggcggcggctaggtaggttcttgctgcctcccttagctcgtagtctagactctagacctctatatatacagtactcgtccccgcggccggcgggaccaacttctcatcatcagccaagtgtaaagggtgcgaagaagcagtagcaaaaaggattccattctcgtgttcttggagtggtccatcgatcgagctccgtgagagagagagagagagagagagagagagagagagagagagagagagcaagcaatggcgacagcagggaaggtgatcaagtgcagagccgccgtggcgtgggaggccggcaagccgctgtccatcgaggaggtggaggtagcgccgccgcaggccatggaggtgcgtgtcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccatgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacgtcaacgccatgatatccgccttcgaatgtgtccacgacggctggggtgtcgccgtgctggtgggtgtcccgcacaaggacgaccagttcaagacccaccccatgaacttcctcagcgagaagacactcaagggcaccttcttcggaaactacaagccccgcaccgacctgcccaacgtcgtcgagatgtacatgaagaaggtaagccgccgcctgaagaaccttggagtacgtacctgacctgcttacggttcaaccgtatccctgactgacgatcaacatgcgatgtgtgtgtttgtgttgtgtacgtacgtaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgcaggcgctccagtcctccagcttgtgtagtacacagtagcaataaaacgttagtgtttgtcctgtgcccaccctgtattattctgttccagggtttcaccttaatcgtcagtgtgtggtcaggtttcaacccttctcaggacaaccccccgggaagaagtatgtgtccaggattcagaatcccctgtctgtaattaccattttgtatgacaataatgagatcctataggtgttaat

SEQ ID NO: 1743 - DNA, 596 bp, Zea mays
  Clone ID: PAT_MRT4577_186318C.1
cctcttgtttcattgattgttgcaatagatcgacttcttttgcaccacaaggtccacgatgtgttgcaactgcggttcaagctgcggctgaagctcaagctgcaagtgcggcaagaagtaccctgacctgtacgagaccagcaccgacgcgcacgccaccgtccacctcagcgtggccccggagaagaacgccgagcccaaggtcgtccaggccgtcgccgagtccggcgaggccgcccacgagtgcagctgcggttgcaactgcaagtgcgacccctgcaactgctgatcacattgatcgacaaccatggatatgatcattatctatataactagcgatggaggttgaacaataataagcaaagccaagctcgatgccatacatacgtatatacatgtgtgtgtgagagagagagaaacagagatcttaacatagctatctatctctgcatgtttggcgtcaggctttgtgctcatgtacgtacttgtgtacacctgcatgtcgaccgatccgattgcatctgctgtaaccatatattaatcggtccacgatgatatgatctgatacttaaaaagatactaaaaagggcggccgc

SEQ ID NO: 1744 - DNA, 873 bp, Zea mays
  Clone ID: PAT_MRT4577_1863C.1
accatgcgtacggtgattttctttcgagccctgccaaataaataaataaaaacaggatctttgagatcgcgccgggtgccaagcagatgttctccttcctgcgcgacgccggcgacgcagccgctggagaaacaccccaagctcaaggccgcggaaaagctaaaacattttataatttggaacggagtatttgacttccgcgagcagatgttctccttcctgcgcgacgccggcgacgcgccgctggagaaacaccccaagctcaaggcccacgccgtcaccgtcttcgttatggcatgcgagtcggcgacgcagctgagaagcaccggcgacgtgaaggtgagggaggccaccctgaagcggctgggcgcgacgcacgccagggcgggcgtcgccgacgcgcatttcgaggtcgtcaagacggcgctgctggacaccatcagggacgcggtcccggacatgtggacgccggagatgaaggcggcgtgggaggaggcctacgaccagctggccgccgtcatcaaggaggagatgaagaacgccgccgccgccgaggagcagacgaagaacgccgccaccgccgaggaggagattaagaacgccgcccccgccgaggagcagacgaagatcgccgccgcggctgttgatggttcctagctcccatactacgctcctctgctagcgaccgtggcacgcgcaccgctgcgttgatgggtgcttttggactgctgctgggcctgatacctaactacgaagctgttgctaatgctgctgcatttttgtttgtcgaccgcatcattgtgatgataaataaaatgttcagaaaatgcccgttaattttataaacatctaaatatatttccaattgatatc

SEQ ID NO: 1745 - DNA, 952 bp, Zea mays
  Clone ID: PAT_MRT4577_1864C.1
tacccttcgaagggccggccgggaggtccccggggaacacacagaacatactcccgctgaagcgctgagaagtagataagaataatatggggttcagtgaggcacaggaagagctcgtcctccgttcatggaaagccatgaagagcgactccgagtcgactgctcttaagttcttcctcaggatctttgagatcgcgccgggtgccaagcagatgttctccttcctgcgcgacgccggcgacgcgccgctggagaaacaccccaagctcaaggcccacgccgtcaccgtcttcgttatggcatgcgagtcggcgacgcagctgagaagcaccggcgacgtgaaggtgagggaggccaccctgaagcggctgggcgcgacgcacgccagggcgggcgtcgccgacgcgcatttcgaggtcgtcaagacggcgctgctggacaccatcagggacgcggtcccggacatgtggacgccggagatgaaggcggcgtgggaagaggcctacgaccagctggccgccgtcatcaaggaggagatgaagaacgccgccgccgccgaggagcagacgaagaacgccgccaccgccgaggaggagattaagaacgccgccgccgccgaggaggagacgacgaacgccgccgcggctgttgatggttcctagctcccactacgctcctctgctagcgaccgtggcacgcgcaccgctgcgttgatgggtgcttttggactgctgctggcctgatacctacctacgaagctgttgctaatgctgctgcatttttgtttgtcgaccgcatcattgtgatgataaataaaatgttcagaaaatgcccgttatgcgagtgccaatgctgctgcatttttgtttgtcgcccgcatcatttttgtgatgatgaataaaatattcagaaaaggccaaaaaaaaaaaaaaaaaaaaaaaaaaaagccagt

SEQ ID NO: 1746 - DNA, 155 bp, Zea mays
  Clone ID: PAT_MRT4577_186537C.1
cactcgctccatctccccgagggccgccagaggcaatttcgccctcgattcgactccgattcgtccgcccgcgaacgggattcactccgccaagcgcggatctgatacgctgcgctccgtgtcgccgctcgaatcagccatgaaggggccaaatc

SEQ ID NO: 1747 - DNA, 258 bp, Zea mays
  Clone ID: PAT_MRT4577_186561C.1
gtcagtttgtatggctcgacagcctcgacttcaagtgttagcagctagcagaaacaaaatatcaactttgaagggatttccacattttccttctctagagcatttgcgtgttgaggagaatccactacttgagatgccacacttggaagctgcttctatcctacttataggtcctactttgaagaagttcaatgaccgagatctgaaccccaacgaggctgaggtagctaagcaatatcctgctcatacagctatttg

SEQ ID NO: 1748 - DNA, 290 bp, Zea mays
  Clone ID: PAT_MRT4577_186651C.1
ctcccacattaataaaggttaatgatggcatgatcggacagaggaaaacttactgtcttcttgggctcgccactaataatagtacaagcttactgcctttaactaatgtatttcttacacaaccacaaggaaagcaagccgggctttaaacggccgaaaaacacccaacgccatgggggtgggggcgcctagttctatactagaagggggtgtggtacctgggttgtgcctgggcctggattttgggccccctcccggtgtgagtgcccagtcccgaccttattggccag

SEQ ID NO: 1749 - DNA, 1017 bp, Zea mays
  Clone ID: PAT_MRT4577_18668C.1
attagacttctggaccctcctctccacgagttccttccagagggaatgttgaggaaattgtgcgtgaattatgtgctgaaacgggagccaatgaggaagaagcccttgaacgagttgaaaagcttgcagaagtaaatcccatgcttggtttccgtgggtgcaggcttggtatctcgtaccctgaattaacagaaatgcaagcccgtgccatctttgaagctgctatagcaatgtccaaccagggtgttgaagttttcccagagatcatggttcctcttgttggaacaccacaggaattgggacatcaagtgaatgttatcaaacaaactgctgagaaagttttcgccaatgcgggtaaaactattggctacaaaattggaactatgattgaaattcccagggcagctctagtggctgatcagatagcagagcaggctgagttcttctcttttggaacgaacgacctcacacagatgacttttggctacagcagggatgatgtgggaaagtttattcccatttacctggctcagggtatcctccaacatgacccctttgaggttctcgaccagagaggagtgggcgaactggttaagtttgctacagagaggggccgccaaactaggcctaacttgaaggtgggcatttgtggagaacatggtggagagccttcatcagttgctttcttcgccaaggttgggctggattacgtttcttgctcccctttcagggttcccattgctaggctagctgcagctcaggtgcttgtctgagggtgctgagggtgcctcctcattcgcaaccggatgatcgcctgctgttggcgcatctggtgattaataatattgttacagagccatgatctgtgaagataattagtagcagggctcataaaagctacaattccatccctttttgcagttatgtaaaactttcaaactgtttatgctcaaaaactctgttcttcaatggatcatcaattatcgattatatatgtgtcaagggcttcttcttttc

SEQ ID NO: 1750 - DNA, 832 bp, Zea mays
  Clone ID: PAT_MRT4577_186916C.1
tcgaggggccggccgggcccgggaccaaaatcataagcaaccaaccaaccaactgcaaagcagaagcaggaacgagagatcaagatcgatctttctctttgagttcccggagcgatcgagtgggttaatggcgaccgccgggaaggtgatcaagtgcaaagcggcggtggcatgggaggccgggaagccgctgtcgatcgaggaggtggaggtggcgccgccgcaggccatggaggtgcgagtcaagatcctctacaccgccctctgccacactgacgtctacttctgggaagccaaggggcaaactccggtttttccaaggatcttgggccatgaggctggaggcattgttgagagcgtcggagagggcgtgaccgagcttgtgccaggtgaccatgtcctgccggtgttcactggcgagtgcaaggattgtgctcactgcaagtcagaggagagcaacctttgtgacctcctcaggatcaatgtcgaccgaggcgtgatgatcggtgatgggcagtcccgcttcaccatcagcgggaaaccgatattccacttcgtcgggacctctactttcagtgagtacacagtgatccatgttgggtgcctagcgaagatcaacccctcggcacccctcgacaaagtttgtgttctcagctgtggtatctcaactggtcttggtgcgacgctcaatgtcgcaaaaccgaaaaaagggttcgacggtggcaattttcggtcttggagctgtaggccttgctgccatgcaaagggccaagatggctggggcatcaaggatcatccgtgtggacttgaaccctgcaaataccaacaagcc

SEQ ID NO: 1751 - DNA, 830 bp, Zea mays
  Clone ID: PAT_MRT4577_186918C.1
caccatcctctgcaatcaaccaactgcaaagcagaaacagcaacaaagatccatctttctctctgagttttcggagcgatcgtgggagttgatggagaccgccgggaaggtgatcaagtgcaaagcggcggtggcatgggaggcagggaagccgctgtcgatcgaggaggtggaggtggcgccgccgcaggccatggaggtgcgcgtcaagatcctctacaccgccctctgccacactgacgtctacttctgggaagccaaggggcaaactccggttttcccaaggatcttgggccatgaggctggaggcattgttgagagcgtcggagagggcgtgaccgagcttgcgccaggtgaccatgtcctgccggtgttcactggcgagtgcaaggattgtgctcactgcaagtcagaggagagcaacctttgtgacctcctcaggatcaatgtcgaccggggtgtgatgatcggagatgggcagtcccgctttaccatcggtgggaaaccgatattccactttgttgggacctctaccttcagcgagtacacagtgatccatgttgggtgcctagcgaagatcaaccccgaggcacccctcgacaaagtttgtgttctcagctgtggtatctcgactggtcttggtgcgactctcaatgtcgcaaaaccgaagaagggttcgacggtggcaattttcggtcttggagctgtaggccttgctgccatggaaggggccaagatggctggggcatcaaggatcatcggtgtggacttgaaccctgcaaaatacgaacaagctaagaagtttggctgcaccgactttgtaaacccaa

SEQ ID NO: 1752 - DNA, 326 bp, Zea mays
  Clone ID: PAT_MRT4577_187123C.1
gccggctgctgtcaagttccatctgtttgctatcgcagacatgtatggccgcggcaagggaggcaaggacctgagtaacggcggcgcgaaacgccaccgcaaggtgctccgcgacaacatccaaagcatcacgaacccggccatccagaggctggttcgaaagggcagcgtgataagcatctccaggctcatctaccatgagacctacggcgtgctcaagatctatatcgagaacgtcatccgagacgccgtaaactacacggagcacgcccggcgcaagaccgtcacagccatggacgtcgactacgcgctcaagcactatggtc

SEQ ID NO: 1753 - DNA, 2082 bp, Zea mays
  Clone ID: PAT_MRT4577_187144C.1
ccggccgggaattccgattccacgagaggaatcgacgtaaataaataaaaaaaaaaaaatacttgcttgactacttgagcaaagcgcgtgcgtcttcggtcgtcgccgggcgccagcggccagccgcaacccacaagcagagcaaaatattccgccaaggatccgtggaccgagcagcatctggcactgagctacatatacccgttgttcagccaccaccactgtccccaagcatcaagctaggcaggcttggtcccgaagaacacccttctctggtcgtcgcatcgcagggcagctagctaggtagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggccgggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactacccgctgtcggccaccatcatgtccgagtacgccaacaagaggacccgcggcgccttcatcgcggccgtcttcgccatgcagggcttcggcatcctcgccggcggcatcgtcacgctcgtcatctccgccgccttccgcgcggcgtacccgtccccggcgtacagggacgaccacttcacctccaccgtgccgcaggccgacttcgtgtggcgggtcatcctcatgctcggcgccgcgccggcgctgctcacctactactggcggatgaagatgcccgagacggcgcggtacacggcgctggtggccaagaacgccaagcaggccgcggccgacatgtccaaggtgctgcacacggagatcctggacgagcaggagaagctggacgggatggtcgccgccgagggcgccaacagcttcggcctcttctccagggagttcgcgcgccgccacggcctccacctcgtcggcaccgccaccacctggttcctgctcgacatcgccttctacagccagaacctgttccagaaggacatcttcaccagcatcaactggatccctaaggccaacaccatgagcgcgctggaggaggtgtaccgcatctcccgcgcgcagacgctcatcgcgctctgcggcaccgtcccgggctactggttcaccgtcgcgctcatcgacgtcgtcggccgcttcgccatccagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgactgcgctccacctgtcacggcatctccgccgcctcggggaaggccggggccatcatcggcgcgttcggcttcctgtacgcggcgcagaaccaggacaagagcaagacggacgccggctaccccgcgggcatcggcgtgcgcaactcgctcttcgtcctcgccgccagcaacatgctcggcttcgtcctcacgttcctcgtgccggagtccaagggcaagtcgctcgaggagatgtctggtgaggctgaagactcagaggaggagcccgtcggcgcccgtgcggtgcggccgtcggagacccagatggtgtagagaatcgatcgatcgacgcgtgttccttcctgcactgcacatggtgggctatcatgtcctcaattgtttttttccacgttaaagtcaaccctggctgtgttttgatgtgtaaaaaaaaaaaaaaaaaagcggcc

SEQ ID NO: 1754 - DNA, 2351 bp, Zea mays
  Clone ID: PAT_MRT4577_187145C.1
cgggaacggacagagtgaactcaatctcttgggtgatgatcccccctcgcctccccctgtgtaatttcgattccgacgagaggaatcgacgtaaataaaacaaaaccaaaatacttgcttgactacttgagcaagcgcgtgcgcgtcttcggtcatcgcagtcgtcgccgggcgccagcggccagccgcaacccacaagcagagcaaaatattccgccaaggatccgtggaccgagcagcatctggcactgagctacatatacccgttgttcagccaccaccactgtccccaagcatcaagctaggcaggcctggtcccgaagaacacccttctctggtcgtcgcatcgcagggcagctagctaggtagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggcggggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactaccctctgtcggccaccatcatgtccgagtacgccaacaagaggacccgcggcgccttcatcgccgccgtcttcgccatgcagggcttcggcatcctcgccggcggcttcgtcacgctcgtcatctccgccgccttccgcgcggcgtacccgtccccggcgtacagggacgaccacttcacctccaccgtgccgcaggccgacttcgtgtggcgggtcatcctcatgctcggcgccgcgccggcgctgctcacctactactggcggatgaagatgcccgagacggcgcggtacacggcggtggtggccaagaacgccaagcaggccgcggccgacatgtccaaggtggtgcagactgagatcgtggacgagcaggagaagctggacgccgctgagggcgccaacagcttcggcctcttctccagggagttcgcgcgccgccacggcctccacctcgtcggcaccgccaccacctggttcctgctcgacatcgccttctacagccagaacctgttccagaaggacatcttcaccagcatcaactggatccccaaggccaacaccatgagcgcgctggaggaggtgtaccgcatctcccgcgcgcagacgctcatcgcgctctgcggcacagtcccgggctactggttcaccgtcgcgctcatcgacgtcgtcggccgcttcgccatccagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgcctgcgctccacctgccacggcatctccgccgcctcggggaaggccggggccatcatcggcgcgttcggcttcctgtacgcggcgcagaaccaggacaagagcaagacggacgccggctaccccgcgggcatcggcgtgcgcaactcgctcttcgtcctcgccgccagcaacatgctcggcttcgtcctcacgttcctcgtgccggagtccaagggcaaatcgctcgaggagatgtccggtgaggctgaagactcagaggaggagcccgtcggcgcccgtgcggtgcggccgtcggagacccagatggtgtagagaatcgatcgatcgacgcgtgttccttcctgcactgcacatggtgggctatcatgtcctcaattgttttttttccacgttaagtcaaacctggctgtgttttgatgtgcacaagtcgttcgcatacgtagtacgtgtgtgatggtagagcaggtgaatcgcatcgcatgtggcagtctggtagaggtccacgtgtgataatatataggcgggaaagtagctaggtgaactttacactcgtatatccaaccatatataatcggttacgcgcgtttagcaactccactactccagcaaataatctaaatcctaactcactagtttaaattcatttcttaatttagttctag

SEQ ID NO: 1755 - DNA, 2042 bp, Zea mays
  Clone ID: PAT_MRT4577_187147C.1
gtgcacaccaccaccactgcctccaagcttcaacaagctaggcagctgcaagcatctcccaaatcccagcctgctgccccgcgcgaacacacttctcttgtcgttgcattgcagggcagctagccggctacagcatccgccatggcgcgcggcggggacggcctgcaggtgctcagcgcgctggacgcggcgaagacgcagtggtaccacttcacggccatcatcgtcgccggcatgggcttcttcacggacgcctacgacctcttctgcatctccctcgtcaccaagctgctggggcgcatctactacacggacaccagcaaggacaacccgggctcgctcccgcccaacgtcgccgcggcggtcaacggcgtcgccttctgcggcacgctggccggccagctcttcttcggctggctcggggacaagctcgggcgcaagagcgtgtacgggatgacgctcatgctcatggtcatctgctccgtcgcgtcgggcctctcgttcggccacacgcccacggggggtcatggccacgctctgcttcttccgcttctggctcgggttcggcatcggcggggactacccgctgtcggcgaccatcatgtccgagtacgccaacaagaagacccgcggcgccttcatcgcggccgtcttcgccatgcagggcttcggcatcctcgccggcggcattgtcacgctcgtcatctccgccgccttccgcgcggggtacccggccccggcgtacagggacgaccacttcaactccaccgtgccgcaggccgactacgtgtggcgcatcatcctcatcctgggcgccgcgccggcgatgctcacctactactggcggatgaagatgcccgagacggcgcgctacaccgcgctcgtggccaagaacgccaagcaggccgcggccgacatgtccagggtgctccagacggagatcgtcgacgagcaggagaagctggacgagatggtcaccgccgagagcaacaccttcggcctcttctccagggagttcgcgcgccgccacgggctccacctcgtcggcacctccaccacgtggttcctgctcgacatcgccttctacagccagaacctgttccagaaggacatcttcaccagcatcaactggatccccaaggccaacaccatgagcgcgctggaggaggtgttccgcatctcccgcgcccagacgctcatcgcgctctgcggcaccgtcccgggctactggttcaccgtcgcgctcatcgacgtcgtcggccgcttcgccatccagctgctcggcttcttcatgatgaccgtcttcatgctcggcctcgccatcccctaccaccactggaccacgcccggcaaccacatcggcttcgtcgtcatgtacgccttcaccttcttcttcgcaaacttcggccccaacagcaccaccttcatcgtgccggccgagatcttcccggcgcggctgcggtccacatgccacggcatctccgccgcctcggggaaggccggcgccatcatcggggcctttgggttcctgtacgcggcgcagaaccaggacaagagcaaggcggacgccgggtaccccgcgggcatcggcgtgcgcaattcgctcttcgtcctcgctgcctccaacttgcttggctttatcctcaccttcctcgtgccggagtccaagggtaagtcgctcgaggagatgtccggggaggctgacgacgccgaggacgacgccgtcggcacccgcgcggtgcggccgtcggggacccagatggtgtagaatcgaacatggcgacgcgtgcacacgggtcctccatcctggggcccgactgggaagacaaggcgcgccggttcaagcctgccgatgctttgctgtgcagaagtagttcgtacaggtgcatgtgtgttataggcgggaaagtaagtgaacttacatgcttgtatttattatatccaaccttacgtacagcaactccagctccattgcatcatctagtccacaaatattatatatattagcagttcatatgaaaaaaaaaaaaaaaaaagcggcc

SEQ ID NO: 1756 - DNA, 2317 bp, Zea mays
  Clone ID: PAT_MRT4577_187148C.1
ccattcgtccgcgtaaataaaacaaaaccaaaatgcttgcttgactacttgagcaagcgcgtgcgcgtcttcggtcatcgcagtcgtcgccgggcgccagcggccagccgcaacccacaagcagagcaaaatattccgccaaggatccgtggaccgagcagcatctggcactgagctacatatacccgttgttcagccaccaccactgtcccccaagcatcaagctaggcaggcctggtcccgaagaacacccttctctggtcgtcgcagggcagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggcggggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactacccgctgtcggccaccatcatgtccgagtacgccaacaagaggacccgcggcgccttcatcgccgccgtcttcgccatgcagggcttcggcatcctcgccggcggcatcgtcacgctcgtcatctccgccgccttccgcgcggcgtacccgtccccggcgtacagggacgaccacttcacctccaccgtgccgcaggccgacttcgtgtggcgggtcatcctcatgctcggcgccgcgccggcgctgctcacctactactggcggatgaagatgcccgagacggcgcggtacacggcgctggtggccaagaacgccaagcaggccgcggccgacatgtccaaggtgctgcacacggagatcctggacgagcaggagaagctggacgccgccgagggcgccaacagcttcggcctcttctccagggagttcgcgcgccgccacggcctccacctcgtgggcaccgccaccacctggttcctgctcgacatcgccttctacagccagaacctgttccagaaggacatcttcaccagcatcaactggatccccaaggccaacaccatgagcgcgctggaggaggtgtaccgcatctcccgcgcgcagaccctcatcgcgctctgcggcaccgtccccatcggcttcgtcgtcatgtacgcgggctactggttcaccgtcgcgctcatcgacgtcgtcggccgcttcgccatacagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgcctgcgctccacctgccacggcatctccgccgcctcggggaaggccggggccatcatcggcgcgttcggcttcctgtacgcggcgcagaaccaggacaggagcaagacggacgccggctaccccgcgggcatcggcgtgcgcaactcgctcttcgtcctcgccgccagcaacatgctcggcttcgtcctcacgttcctcgtgccggagtccaagggcaagtcgctcgaggagatgtccggtgaggctgaagactcagaggaggagcccgtcggcgcccgtgcggtgcggccgtcggagacccagatggtgtagagaatcgatcgatcgacgcgtgttccttcctgcactgcacatggtgggctatcatgtcctcaattgtttttttccacgttaaagtcaaccctggctgtgttttgatgtgcacaagtcgttcgcatacgtagtacgtgtgtgatagtctggtagagcaggtgaatcgcatcgcatgtggcagtctggtagaggtccacgtgtgataataaataggcgggaaagtagctaggtgaactttacactcgtatatccaaccatatataatcggttacgcgcgtttagcaactccaccactccagcaaataatctaaatcctaactcactagtttaaaaaaaaaaaaaaaaaaaaaaaaaaaaaaaataaaaaaaaaaaaaaaaaagcggcc

SEQ ID NO: 1757 - DNA, 406 bp, Zea mays
  Clone ID: PAT_MRT4577_187161C.1
tcgcaactagcaacaagaaagacacaatttttttttttataatggcaagccaaaatatttcgcctcatgatgctccttggtctggctgcaagtcctcgctactgcaagccatttcacccaatgctcacaagctctctataactttccttcttaccccatacctctcaccatcgatgtcttcagtatgtgaaaatccaattcttctaccctacaggatccaacaggcaatcgcagcaggcatcttacctttatcacccttgttccttcaacaatcatcatccctattacaagagctacctttgcggcatttattggcacaaaacattagggcacaacaactacaacaactcgtgcttgctaaccttgctgcctactctcaacaacaagcagttacctttggggcatt

SEQ ID NO: 1758 - DNA, 739 bp, Zea mays
  UNSURE (1)..(739): unsure at all n locations
  Clone ID: PAT_MRT4577_18853C.1
  unsure (1)..(739): unsure at all n locations
gggtacccccgngagccggccgggnactcactcacccgccgcccccgccgacgacatgcccctccttgccgactccggacacggactcgtgaatacctttgctcctacctccgccgcagccgctgccatggactcacacgccggcgcccgaggcggctcccggagcctcctcttccgccaccgccagcctgacgaggatctggaggggggcgagggggcgatgaccctggatgagcgagtcactctgctagcgacggatcgaggaggagagcatgcagcaggactagctcaggcgcctggttgagaacaagcccgggcccatctgttactacggcctagagccctcctaacgcatgcacagtcgacaaggcattgcgaagaccatcaacaagacaagatggtacaacaccgagcgcaaggggaaaatcaggattgccgactggttcgagcagctcaacaacaagatgagaggcgacctcaagaaaatccacacagtgatgcagctacatgagacaatatttgcaaggcggtcgagatgaaccaaaacaggtgtggaggtcctgtggctacccgaggagatcaaacggagcgcctacaagcactggacaatcgccatggacattgaccagaaaaacagcgagaaacggacaacgagatgctggcaaaatatgagcagaagtgaccaggactacatgactgctggccagattttctacccttgcatgcaatgtgctgatat

SEQ ID NO: 1759 - DNA, 447 bp, Zea mays
  Clone ID: PAT_MRT4577_18938C.1
aagaatctagaaatgtctttcttatttctgggtatgcccaggcatcacacacaaaatttatggttgaactataactcactaagaaatctaaaagagggcacctccaatcatcggctgttggttgaacgctgctggggttgggaaagcaagttggttcaatggcagcggttgttgctgttgttagagggtgccagcgttaggcgcagcgtgctggtccaacggtgacaactgtggctgtttcaagaaggtggcagggctcacaccagctagctggctgaatgggagtggatggagctgctgtaaataagcaggagagttcaatgctgccagttggctgaatggaagatattgctggcggttggcaccacggagctggctgaatggtagttgctgttgccgcaaataaagaagcagattaaatgcatcttgtttgttgaatggaagaaa

SEQ ID NO: 1760 - DNA, 359 bp, Zea mays
  Clone ID: PAT_MRT4577_19019C.1
gcaacactctatagtgagtcgtattaatgcctgggccagcctgcatcttctacggccggaacatcggtctacacggacaagctgacggagatcggcgtcgtcgtggacgcgatgtggaagctgctcgacgcctggcctaacgagctgcccgcggtcgcttaagtcatccgagtttgtttttttgcaggattcttaaaagttggaccgtcctgctagtactccatgtgtcgtgttttcacattggaggacgtctgtatatgtaagaaaatcctctggcgcttgtgctcagcttgatgaaatatccttgtacggttggtacctggacccgctagagctggctggttcgtcaaattgtgttc

SEQ ID NO: 1761 - DNA, 539 bp, Zea mays
  Clone ID: PAT_MRT4577_1903C.1
accatattatagagaccaactagcaacatcgagagcacaatagtgcaccaacaatggcagccaaaatattttgcctcctatatgctccttggtctttctgcaagtgctgctctcggtgaccatttacccacaatgctcacaagttcctatagctagcctttttcccccgtcacctctcaccagcgctgtctatggattgtgaaaacccaattctacaaccctataggatccaacaggcaattcgaactggcatcttacctttatcacccttgttcctccaacaatcatcaacacctattacagcagatcacctttggtgcatttattgcaacaaaacatgaggacacaacaactacaacaacttgcgctagcaaaccttgctgcctactctcaacaacaacagttccttctcatacaaccaactagctgtattgtactctgctttttatttctaacaacaacaactaccattcaaccagctatttgctgcctacccccaagctatctcttgcatacaaccaactgcacagatttgaact

SEQ ID NO: 1762 - DNA, 365 bp, Zea mays
  Clone ID: PAT_MRT4577_19079C.1
cccgggaacgacactaattttttttttattctaatggcagggcccgaacgtaaggggacgggattacagcaaatcccgggggaaaaaaatactccacacccaaaatacgggaccaaacccaacattaacatccattattgggggttccgggaccctgaacatttgcaaactgaaaacaacaccttgttaaaaaacgcggaactggaccaacgcatccaagcgccctgaacaaacacaaacaagcacgcgacaaataaacaaagctaccatgggaaaacctcccagtctccgacccacgacgcataaacagacccccgttttttttttgttcacggggttcctccagcgcgcgcctgctgccttcc

SEQ ID NO: 1763 - DNA, 110 bp, Zea mays
  Clone ID: PAT_MRT4577_19105C.1
caagcagctggccgtcgacatgctcgctaacaagctcctctttgaggcttcggagtactcacatgtatgtaagcatgcctgctccaaggaagtcccccagcaccagcaca

SEQ ID NO: 1764 - DNA, 385 bp, Zea mays
  Clone ID: PAT_MRT4577_19228C.1
ggtttctcctccctctcttacaagtcctcctcgggttaggtatccttagcctcttgcggaggggcgatgtcggcgcttgatgtggagtaccgttgcttcgcccccggacttggctgggccaccagcaacgagtcgcttgagaatgtcttcgtctcctacggcgagatcctcgactccaaggtcatcgcctagcggtagacggggaggtcccacggcttcggattcgataccttctcctccgagaactgcatgctccacgctatcgagaacatgaacggtaaggaggtagacggccgtaacatcaccggtagccaggccgactcccgtggcgatggtgtcgatggtggtggctacggcggcgttctcgacgctgacgggcggtaat

SEQ ID NO: 1765 - DNA, 2936 bp, Zea mays
  Clone ID: PAT_MRT4577_19439C.1
ccctcttctccccccacccctccctcccccaccaaatcctcgttcattttttttccaagcgacttcgcgtgtgagggcgggagagcgcgcggggctagggtttccacgggtgatggaagcagaggctgccgcggcggtagtggcgtcgtccgcatctgcctcggcttccgcgggccggtctcgcccatctagcagcgccgcccaggtcaccagtaattcggctgtgcgagctggagaagaaaatgctgcctccctctatgttttatctgttattgactcgttaaaaaagaggattaccgcagatcgtttgacttacattaagaataggataggggagaacaagactaatatcagcagctatacacagaggacttacaatttatcaaaaaataggcaaattagtacatcaaagggtactgattcagcatcaaatttgctcacaaaaaggcaagatgatgcgctatgcaccctgcatagtcttgatattattccggttgacaaagatggtggtacttttcaagacgaaagtcctttctcttcatctaatgttatgtttggtggaaatcttggtcccaagaatgctattattagaccaattaaactaccagaagtgccaaagcttccaccttatacaacatggatatttttggacaggaaccaaaggatgacagaagaccaatctgtacttggtcgacggaggatttactatgataccagttgtggtgaagctctaatttgcagtgatagtgaagatgaagccattgaagatgaggaggaaaaaaaggaatttaaacattctgaagatcacattattcggatgacagttcaagaatgtggcatgtctgatgctgtactgcaaacgctagctcgacacatggagcgggctgctgatgacataaaggccaggacctgtgtgctgatggacatttctgctcattggtgatgctgataggtgtttgattgcaagctacatgggtgttctcaagatttagtatttcctacagaaaaacaaccagcttggagtggcgttgatgacagtgtaccctgtggtattcattgccataaactggcatctgaaccagatgctgctgctggtgctgatcacatgctttttgatgttgaggagccaactcactcatcagacaatgtgatgaaccagccaggttcaaataggaaaaagaacggctccagtggaaggaagactaaatctcaacaaagtgaaagctcttcaactgcaagagttatctcagaaagcagtgattcggaagtacatccaataagcaataaatctccacaacactcccctagtccctcaaaagttaaaattgggccgaaaggtggaatcagaaagattaccaatagacgaatcgctgagagaattcttatgagtgtgaagaaaggacaaagggaaatggcatcatctgattctaattttgttagtggatatcttttggcaagggacatgaagcttaggtctgatacacgaaatggaaataaggaattaattgtatcctcacaacagagttctccaagcacaagaagttccaaaaagaagagtacacctcaaattgggaacagctcagcttttgctgaggctcataatgattcaacagaggaagcaaataaccgtcattcagcaacagatggttacgatagttcaaggaaagaagaattcgtcaatgagaatttatgcaagcaggaggtgtacttgagatcatggaaggcaattgagcagggacttcttgtgaaaggattagagatttttggaaggaacagttgtttaattgctcggaaccttcttggtggaatgaagacgtgcaaagatgtttttcaatatatgaattatattgaaaacaacagtgcctctggagctcttagtggtgttgattctcttgttaaaggatatattaagggtactgagttgcgcacaagatcaagatattttagaaggcgaggtaaagtccgtcgtttgaagtacacctggaaatctgcaggttacaatttcaaaaggattaccgaaaggaaggatcagccttgtcgacaatataatccttgtggttgtcaatctacatgcggaaagcagtgtccatgtctttcaaatgggacatgttgtgagaaatactgtgggtgtccaaaaatttgcaagaatcgttttcgaggatgtcactgtgcaaagagccagtgtcgcagccgccaatgtccatgttttgcagctgacagggaatgcgatccggatgtttgcagaaactgttgggttgggtgtggtgatggtacattgggagttccaaaccagagaggagataattatgaatgccggaacatgaaactgcttcttaaacaacaacaaagggtcttacttggaagatcagatgtctctggctggggagcattcctcaagaatagtgttagcaaacatgaataccttggtgagtacactggggaactaatctcacacaaagaagcagataagcgtggaaagatatatgatcgtgagaactcatcgttccttttcaacctgaacaatgagtatgttcttgacgcatacagaatgggtgacaagctgaaatttgccaaccatgcccctgacccgaattgctatgccaaggttatcatggtaactggtgatcatagagtgggcatattcgccaaagaaagaatcctcgctggtgaagagttattctacgattaccgctatgagcctgacagagctcctgcttgggcccgtaagcctgaggcgtcgggagcaaaggatgatgggcaaccgttcaatgggcgtgcaaagaagctcgcccaaaacaaccgaggctgaatctgatttgattctttcattgttaggacaaatttggcagccattcaactaatacaaggaacctgtcattcataggccccaatttatttgaactcgtcattgtaactcgtatgtgcttgaattctcc

SEQ ID NO: 1766 - DNA, 3568 bp, Zea mays
  Clone ID: PAT_MRT4577_19440C.1
ccctcttctccccccactcctcccccaccaaatcctcgttcatttttttttccaagcgacttcgcgtgtgagggcgggagagcgcgcggggctagggtttccgcgggtgatggaagcagaggctgccgcggcggtagtggcgtcgtccgcatctgcctcggcttccgcgggccggtctcgcccatctagcagcgccgcccaggtcaccagtaattcggctgtgcgagctggagaagaaaatgctgcctccctctatgttttatctgttattgactcgttaaaaaagaggattaccgcagatcgtttgacttacattaagaataggataggggagaacaagactaatatcagcagctatacacagaggacttacaatttatcaaaaaataggcaaattagtacatcaaagggtactgattcagcatcaaatttgctcacaaaaaggcaagatgatgcgctatgcaccctgcatagtcttgatattattccggttgacaaagatggtggcacttttcaagacgaaagtcctttctcttcatctaatgttatgtttggtggaaatcttggtcccaagaatgctattattagaccaattaaactaccagaagtgccaaagcttccaccttatacaacatggatatttttggacaggaaccaaaggatgacagaagaccaatctgtacttggtcgacggaggatttactatgataccagttgtggtgaagctctaatttgcagtgatagtgaagatgaagccattgaagatgaggaggaaaaaaaggaatttaaacattctgaagatcacattattcggatgacagttcaagaatgtggcatgtctgatgctgtactgcaaacgctagctcgacacatggagcgggctgctgatgacataaaggccaggtatgaaattctgcatggtgagaaaactaaggattcttgcaagaaagggactgagcataatgtcaaagtggaagatttgtactgtgacaaagatttggatgcagcattggattcttttgacaatctcttctgtcgacgatgtctagtacgcttgactgtaactttcagatattcttttctaggacctgtgtgctgatggacatttctgctcattggtgatgctgataggtgtttgattgcaagctacatgggtgttctcaagatttagtatttcctgtaagttttcacaagttgaaagagttatttataaaattgtgtgtttacttgatttgtgtcttctttgtacagacagaaaaacaaccagcttggagtggcgttgatgacagtgtaccctgtggtattcattgccttttgctggcatctgaaccagattctgctgctggtgctgatcacatgctttttgatgttgaggagccaactcactcatcagacaatgtgatgaaccagccaggttcaaataggaaaaagaacggctccagtggaaggaagactaaatctcaacaaagtgaaagctcttcaactgcaagagttatctcagaaagcagtgattcggaagtacatccaataagcaataaatctccacaacactcccctagtccctcaaaagttaaaattgggccaaaaggtggaatcagaaagattaccaatagacgaatcgctgagagaattcttatgagtgtgaagaaaggacaaagggaaatggcatcatctgattctaattttgttagtggatatcttttggcaagggacatgaagcttaggtctgatacacgaaatggaaataaggaattaattgtatcctcacaacagagttctccaagcacaagaagttccaaaaagaagagtacacctcaaattgggaacagctcagcttttgctgaggctcataatgattcaacagaggaagcaaataaccgtcattcagcaacagatggttacgatagttcaaggaaagaagaattcgtcaatgagaatttatgcaagcaggaggtgtacttgagatcatggaaggcaattgagcagggacttcttgtgaaaggattagagatttttggaaggaacagttgtttaattgctcggaaccttcttggtggaatgaagacgtgcaaagatgtttttcaatatatgaattatattgaaaacaacagtgcctctggagctcttagtggtgttgattctcttgttaaaggatatattaagggtactgagttgcgcacaagatcaagatattttagaaggcgaggtaaagtccgtcgtttgaagtacacctggaaatctgcaggttacaatttcaaaaggattaccgaaaggaaggatcagccttgtcgacaatataatccttgtggttgtcaatctacatgcggaaagcagtgtccatgtctttcaaatgggacatgttgtgagaaatactgtgggtgtccaaaaatttgcaagaatcgttttcgaggatgtcactgtgcaaagagccagtgtcgcagccgccaatgtccatgttttgcagctgacagggaatgcgatccggatgtttgcagaaactgttgggttgggtgtggtgatggtacattgggagttccaaaccagagaggagataattatgaatgccggaacatgaaactgcttcttaaacaacaacaaagggtcttacttggaagatcagatgtctctggctggggagcattcctcaagaatagtgttagcaaacatgaataccttggtgagtacactggggaactaatctcacacaaagaagcagataagcgtggaaagatatatgatcgtgagaactcatcgttccttttcaacctgaacaatgagtatgttcttgacgcatacagaatgggtgacaagctgaaatttgccaaccatgcccctgacccgaattgctatgccaaggttatcatggtaactggtgatcatagagtgggcatattcgccaaagaaagaatcctcgctggtgaagagttattctacgattaccgctatgagcctgacagagctcctgcttgggcccgtaagcctgaggcgtcgggagcaaaggatgatgggcaaccgttcaatgggcgtgcaaagaagctcgcccaaaacaaccgaggctgaatctgatttgattctttcattgttaggacaaatttggcagccattcaactaatacaaggaacctgtcattcataggccccaatttatttgaactcgtcattgtaactcgtatgtgcttgaattctccatggcagctggtcctgccatccgtagagttaggtcccgtttgttttgaggaactaaaaattaatccctctattttagtcacattgagtctctagattgtcaaacggcgggactaaaacaaagactaaactatttgtctctagttcctcaagccatgacttaaagggaataaatcatataaattttatttttatccttcctttatttcagttacactaatgatgtaataattgtatgaggtattttggtcctcttagagcatctccaagtgactcttcattttttgctctctatttgactatctatttacgatttcatcaagccatgacttaaagggaataaatcacataaattttatttttatcaaaaaaaaaaaaaaaaa

SEQ ID NO: 1767 - DNA, 316 bp, Zea mays
  Clone ID: PAT_MRT4577_19480C.1
cggacgcactttccactcgagacactaccacaacaatgccaatactgtaccaacaatggcagccaaatattctgcctccttatgctccttgacctttctgcaagcgctgctacggcgaccattttcccgcaatgctcgcaacctcctatagcttcacttcttcccccgcacctctcaccaccggcgtcttcaccatgcgaaaaccccattcttcaaccctacaggatccaataggcaatgggacctgcaatcttacctttatcaccctcgtacctccaccaaccatcaatcctattactacagattagttttggag

SEQ ID NO: 1768 - DNA, 1592 bp, Zea mays
  Clone ID: PAT_MRT4577_19502C.1
gcgtgatgtatggcattgggtacctcgaggccggccgggagcgagtgatgcggtgacgtgctgctgctgttgtagtaggtggtggagcaagcccagtccccaatcccaccctgccacccaaccttgcttcttctccgatagctatttctctgctttctctccaatcttcccgggtttccctgattaaagatggctgaatcctttgttctcaataccggctcgaggatcccatcggttgggcttggcgtatggcaaatacaacctgacgctgccaacgacgccatctacgctgctgtcaaggctgggtatcggcatattgactgtgcagcagcatacaacaatgaggaggaggtgggcctggctttgaagaaattatttgaagatggtgtggttaagcgtgatgatttgtttatcacctctaagctatgggctgctaatcatgcacctgaagatgtggaagagggaatcgacaccacacttcaagatttgcagcttgactacttggacttgtacctcatccatggtccaatccgcatcaaaaaaggaactagcacgatgacccctgaaaactttctccctacagatatccctgctacatgggcagcgatggagaagttatacgactctggcaaagctcgtgcaatcggcgtgagtaacttctcttgtaagaagctgcatgatttgcttgccgttgcacgagtgcctccagcagtcaaccaggttgagtgtcatccggtttggcagcaagacaagctccggaagctatgccaatccaatggtgttcatctttctgcattctcgcctttaggctcacctggatctccttggatcaatgggccaagtgtcctcaagaaccccattgtggtctctgttgcagacaagttgcagaaaacgcctgcccaggtcgctctacgctggggaatccaaatgggccatagtgtactcccgaaaagcgccaatgagtccaggattaaggagaacattgacatatttggctggtctattcctgaagatttgatggccaagttctctgaaatcaaacaggtcaggctgctgacagctgagtttgtagttcaccctcaggccggctacaatacattggaggacttttgggatggtgaaatataaaagcatacaaatttgttcagaataaaagagccaggcgaggaaacaaccacaaaaaaggggagatcgaatgcataggccccaatacgatgaatttgggggtttacgtgattgctgaacacaagtattgtgtgactaatctgtgttttgatgtggtaaatgtaattgggttagtcacaataagagataagtgtctttgccacaagacttttggttcattggttgaagcatgatgtaaaccgtaaaggatattcatgaaaactaaggacgctatagagcaaatgtaggttgtgtgcatgcgcacagcaggcaactgcctcaagaactccgccgccggcgtcaacggcctcaacgccggtaacgccgccagcatcccctccaagtgcggcgtcagcatcccatacaccatcagcacctccaccgactgctccagggtgaactgaaccctaaaaaacaaccacggcccc

SEQ ID NO: 1769 - DNA, 810 bp, Zea mays
  Clone ID: PAT_MRT4577_19600C.1
cctcgaggccggccgggaacgaagtcgaagaagaggagtcgtaagggagcttgtactcgcggggtcagtggttggtatagtctgagtgagagtgagtcgatctagctagctgagctccgatcctcgatagctagctaggataccgccataccacaagtcttcttcacaagtgtaggagtgacagcaacaagagatcgatggcctctgccaccgggctcaaggcctgcttccttcgcaagaagtccagaatggggcgccaccaggcaggacgccgcgcctaagacgcccaccggctccatggtcgtccgcgcctacgactacgacgatgagctcgagaatgaccgctaaaatgattgttttgtcggggcggtgcatcctggagatggacgagtccaacgccacgtgcgggaagcggctggagaccatcgggatggacaacacggaggacaacagggaggcgtaccgcaagctgctggtcacggggccgggcctgggccagtacatctccagcgtcatcctcttcgaggagacgatggaccaggccgccgtcgacggacgcaagagcgtggacatcctggcggagcagggcatcgagacagggatcaaggaggacaagggccttgtcccgatcgccggctccaacaacgagtagtggtgccagggcctggacggcctggtgtaccgcgaggacgtctactaccagcagggcgcgcggatcgacaagtggcacaccgacgacagcatccctaacggtccctccgagctcgacgtcaatgaagccgcgagggggctcgcacgctacgacggcat

SEQ ID NO: 1770 - DNA, 286 bp, Zea mays
  UNSURE (1)..(286): unsure at all n locations
  Clone ID: PAT_MRT4577_19611C.1
  unsure (1)..(286): unsure at all n locations
gcggcaaatcccgccgcttcctccccacgcacccattaccatccttcccgtagcacgaggcgagccgggccgccggatatggcgccggctggcccgtacggcatagccgagtctcagcggctcgcggacctactgctgctggagggcaacgcctttgtgcggacggaacgcctgagcgccgtcatggtcgccttcaccggggccctaactctttgcccaaatggtgcagatagtggaccaaccaagcactctgctatanaacagcgagatgagtggactacagttg

SEQ ID NO: 1771 - DNA, 1538 bp, Zea mays
  Clone ID: PAT_MRT4577_19712C.1
ccacgcgtcccattgggtacctcgaggccgtccgggggtcggcctctctctctccaccacacttttttctccggacgcgctcgttcgttcgcgaaggcgccccttcctgccctcacatccgctcctccctccccgacaccgaccgacccctcgtccgctcgcctccctccccgatccccaccgccatggccgccgccgccgccgccgcgtcctcctcttcctcctccgaggttccgatcgccgcccgcacctgcgtctccgtcggcgaggtggcggtgggcgcggtggctacaggcagcggcgaccgggtggcggcggattgcggggtgtgcgccatctgcctcgacaggatagcgctccaggagacggccctcgtcaagggttgcgaccacgcctactgtgtgacctgtattttgaggtgggcatcctacaaggagaaccctctctgcccacagtgcaagcatccattcgaattcctcagcgtgcaccgctctctcgacggctgcctacatgactacctgtttgaggagagtgtttgcctccttctgagggcagcttggtttgaacctctgatcgtagaggctcacgaggaggctctggaagaagaagagtttctccaccagcagtaccaatacgatgatgacgaagatgatcttgacgaggaatcttattacatgaacaggtccccaagcatccgtattggtaacaggagatggggtgacaatgggtacatcaggggaggcaggaaagaggcgaggccagtgaatactgatgtggctgctggtccatccaggactccgaagaagaaagagaaagccgcatcctcttcggcgtcggtgtcagtgtctggttcggggtcaggatcggggtctgtatccaaggatgtcgctggaaggcgggcgaagagggcgcagaagcgagaagctgcagacaaggcagctgcagagaagcacctgaagcacctgcagaggttggggctgagaaaatcgccagagcctgtagtgcccgaggaggttgggccacaggtgaatgagtgacttaagccgccgcctagtgctatatggtgctgctaaaaacactgcagccctttgggccacaaaataatcttccactgtgaagagcttgagcgtggccttgtatcatggcagcttttcgcctcgttgtacatagtctagtttctcatcactgttttagattcagcacagaaatgcagctgctgtctgcacgactgttgcagctatgaagctgtatgtacctcactgttggtgcactattttagttattgctaatcacaggggatgcaatcggcatctgtgttgattactatggggacaaatgaggcgtggaaccaattctacaacgcaaacttgtaaccatatggaatcactcgccgttgacatgatactaatcctgttaactagaaaaaaccttgcttgctgaaccttgaaagtaatcatcgaattttgtccccaaatcgaagaatctgtgttgttgcccaaaaaaaaaaaaaaaaaaaaaaaaaaaaaaaacacccacac

SEQ ID NO: 1772 - DNA, 972 bp, Zea mays
  Clone ID: PAT_MRT4577_19785C.1
cgctcatcaacgccgacggcatcatcgaggagtccttctggcccgggaagtacgccgtcgagctcagctccgtggcgtacggcgcgacgtggcagttcgacacggaggcgctgcccaacgacctcgtcaagcgagggctcgccgtgcgccgggacggcgacggcgagctggagctcaccatcaaggactacccctacgcccacgacgggctcatgatctggaactccatcaagcagtgggtgaccgactacgtcggcgtctactacaagtccgacgaggccgtcgccggcgacgcggagctgaaggcgttctgggacgaggtgcggaacgtggggcacggcgacaagaaggacgagccgtggtggcccgtgctcaacacccgggacagcctcgtggagacgctcaccaccatcatgtgggtcacctccggccaccactcggccgtcaacttcgggcagtaccactacggcggctacttcccgaaccggccgaccaccatacggaagaacatgccggtggagtagggccgggacgaggagatgaggaaattcctctcgcagccggagacgacgctgctggacatgatgccgacgcagatgcaggccatcaggatcatgacgacgctggacatcctgtcgtcgcactcgcccgacgaggagtacatgggggagttcgcggagccgtcgtggctggtggaacccatggtgaaggcggcgttcgagaagttcagcggcaggatgaaggagatcgagggattcatcgacgagtgcaacaacaacccggagaacaagaaccggtttggagccgggatcgtgccgtacgagctgctcaagcccttctccaagccgggagtcaccgggaggggcatcccctacagcatctctatctgatgtcatcgagacctcatcctcagcattagtttcttggtatcaggctcaacagtctctcagctccatccccaataagttcaaa

SEQ ID NO: 1773 - DNA, 3094 bp, Zea mays
  Clone ID: PAT_MRT4577_19793C.1
gccggccgggtcgggaccgcgcgctcggtcgactactggctagcttgtttcagtcgtccgatctgatctacagaaaaagcaggggcagggcagctagccatgattcagatgaacatgaagcagcctctcgtgctgcccgcgcaccggggcaatgtcatcggctcgcgcctggcgtcgtcgccctctccggtggcggcggcggcggcggcggccagcaggcggaggggcgtcgtgtcctccccccgctcccggctccagcgccacatgcggctgccgaggatcagctgcagcgccaccgaggaggccagcggcgccgtgtcggccgtcaccgtggagaagatgctgacggtgacggcctcggtgcaggcggcgccggccatcggtcagatgtacttccagcgcgccctcgacgacgccggcgacttcttcggcaagacgctgctgatggaactcgtcagctccgaggtcgacgcaagtgagtagtaagacgggtctggagaagccgcgggtgacggcgttcgctcacaagacgctgcgggagggccactacgaggcggagttcaaggtgccggcgtcgttcgggcccgtgggcgcggtgctgctggagaacgagcaccacaaggagatcttcatcagggagatcaagctcgtcacgggcagcgacagcagcaccgccgtcaccttcggctgcaactcctgggtgcactccaagttcgacaacccggagaagcgcatcttcttcaccctcaagtcctacctgccgtccgacacgcccaagggcctggaggacctgaggaagaaggacctgcaggcgcttcggggcgacggccacggcgagcgcaaggcgtccgagcgcgtctacgactacgacgtgtacaacgacctgggcgacccggacaagaaccccgcccaccagcggcccgtgctgggcggcagcaagcggtacccgtacccgcgccgctgccgcaccggtcgccccaggaccaggaaggaccccgaggcggaggtgcgccatgggcacaactacgtgccccgcgacgagcagttctcggaggtcaagcagctcacgttcggggccacgacgctgcgctcgggcctgcacgcgctgctcccggccatcaggccgatgctcatcaagagggagctgcgcttcccgcacttcccggccatcgacgacctctacagcgacggcatcccgctgccggcgcagaccgggttgggcgccatccgcagcatcgtcccgcgcgtggtcaagctggtggaggacaccaccgagcacgtcctccgcttcgagctgccggacatgatagagagagaccgcttctcgtggttcaaagacgaggagttcgcgaggcagacgatcgcggggctcaacccgctgtgcatccagctcctgacggagttccccatcaggagcaagctggacccggaggtgtacggcccggcggagtccgccatcaccaaggagatcctggagaagcacatgagcggcggcgccgccatgaccgtggagcaggcgctcgcggcgaagcgtctgttcatcctggactaccacgacgtgttcctgccctacgtgcacagggtgcgcgagctgccggacacgacgctctacggctcccgcaccgtcttcttcctcacggacctgggcacgctgatgccgctggccatcgagctggtgcggcccaaatcgccgacgcagccgcagtggaagcgggtgttcacgcacgggcccgacgccaccgacgcctggctgtggaagcttgccaaggcgcacgtggtgacccacgacacggggtaccaccagctggtgagccactggctgcgcacgcactgctgcgtggagccctacatcattgccgcgaaccggcagctcagccggctgcacccggtgtaccgcctcctgcacccgcacttccgctacaccatggagatcaacgcgctggccagggaggcgctcatcaacgccgacggcatcatcgaggagtccttctggccgggcaggtacgccgtcgagctcagctcagcggcgtacggcgccacgtggcagttcgacacggaggcgctgcccaacgacctcgtcaagcgtgggctcgccgtgcgccgggacgacggcgagctggagctcaccatcaaggactacccctacgcgcacgacgggctcatggtctggaacaccataaggcagtgggcggccgactacgtcaacgtctactacaagtccgacgaggccgtcgccgccgaccccgagctgaaggcgttctgggacgaggtgcgcaacgtgggccacggcgacaagaaggacgagccgtggtggcccgtgctcgacacccgcgacagcctcgcggagacgctcaccaccatcatgtgggtcacctccggccaccactcggcggtcaacttcgggcagtaccacttcggcggatacttcccgaaccgcccgaccaccatccggaagagcatgcccgtggaggaggaggcgggccgggacgaagagatgaagaagttcctgaagcagccggagacgaccctgctggacatgctgccgacgcagatgcaggccatcagggtgatgacgacgctggacatcctctcgtcgcactcgcccgacgaggagtacatgggagagttggcggagccgtcgtggctggaggagcccatggtgaaggcggcgttcgagaagttcggcggcaggatgaaggagatcgagggattcatcgacgagtgcaacaacaacccggagctcaggaaccggtgcggagcagggatcgtgccgtacgaactgctcaagcccttctccaagccgggagtcaccgggaggggcatccccaacagcatctccatttgacccgtccgtcctctccatccaatgggggtttgccttattgcgtgcacgctagctagctgcttggaaataaaaataattaaaataaaaggtctcgtctgtactattgtattgtaccatggatcatatcgtacatgttgtgtcaatgcaaagaggcacgtttgagttaccattaggatgacattactagcagatcctttttatgttatcgtctttagaactttggatgaccaagaaatactgccagattat

SEQ ID NO: 1774 - DNA, 317 bp, Zea mays
  UNSURE (1)..(317): unsure at all n locations
  Clone ID: PAT_MRT4577_19842C.1
  unsure (1)..(317): unsure at all n locations
gttgcncncccgaaccagaacaaccagagagcggancaagaagaagaggcgcggcgccgcaacgggcggcgggagcgncgcancgaggagcggcgagcggagaaagccggcggacaaccccngcagcgagcggaagccgacgggcaacgangggnggagcgccggcccgaggacgcgggcggcggancncgccggccacgagaaggccaacccgcgcggcggcggcggggggcaccnccgcgcgagcccgcgcgacgggcgccagcaagccacggcggcagnggaccccgaagacaccccacgggagaaaggcacaa

SEQ ID NO: 1775 - DNA, 334 bp, Zea mays
  Clone ID: PAT_MRT4577_19845C.1
gctgcagcaccacaaagcaccattttttgcttaggattaacttataacaaatcctgacaggcgtaacagcatccatcgatccacagtgcatgctggctgatgcatgggtctgctggagccgaggatgaacacagcactaacaactgacacagagcgaccttgcaatcaaaaacacagatgggcaccaccaaacgtgacgacacgaagatataccctctggactagggtgaacatcactgttgcgaacgggatcacttgtcccgtcgggccccagcggtcaattgctaccgtttccgtaggagttgcccgaccccccgtcacggatggcaactgc

SEQ ID NO: 1776 - DNA, 1568 bp, Zea mays
  Clone ID: PAT_MRT4577_20026C.1
ggtaccctcggtgtcggccggggatgcgatcataccagcactaaagcccggattctcatagaactccgaagttaagcgtgcttgggcgagagtagtactaggatgggtgacctcctgggaagtcctcgtgttgcattccaccacagcatccgcagttccccgaccacaccgttcctccgaggtccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaggagcatgtgaatcttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgcccagaaaggcgatgcaggcgagggacagtaatcttcggagggggtgcaaagttgttcgagccccaatgttttagatgctctatgctgtcgaagttgtgctgtgccattattgtagctgatttcgtctccattcacttctttttccttgttagtaggctggtattggtcgaattagtaccccattgctttgtgttgccgctagtccatgtggactggtattgttcccctggatttatttggcaagcgtgtccgtgctcgctctagcgttttattgagcttttaaagtcatcgcattcttttttgattgcaatcagttattggctggatatgcggtggctgtttggatcagaagtacagccggagtttcctcaccggagcgtgtaacatgtggaaattggaaaccacgcaaacgtctctcttatttgtacccctgagtacatagggctttttttaacagcttttcaaaaaaaaaaaaaaaaaaaaaaaaatggccatacaaaaaaaaaaaataaaaaaaaaaaaaaaacaaaaaaaaaaacaatacaaataccatacctcaaactgccataacgaaagaaaaaataaaacaggggg

SEQ ID NO: 1777 - DNA, 569 bp, Zea mays
  Clone ID: PAT_MRT4577_2019C.1
aagggaaaggattttaagttcctttttcccacgttccttttttttacccccccttaaaaaacagggccttttcacacttggggccgggttttaacatttaaggtttcaccaccaaaattttttttaacacagacaacattaatcaacatttgggcccaaaataaagttaacctaccccccccgtttaaaatccgggggcaaaagcccaaatgcgaaataaacagaggaaacccgctttaggcaggcaacccacgtttgcaacaccaaaaacacttccgccggggaacaaaagcagttgaccgaggggaaatcaacaaataatcgggttgcaattgttggggttgacggtctcggttcctccaacaaaggggtcgattttgccccacaggagggaaaaaacgggggcgaggaggacggaccaaagcaccacaatggtcggggggctgttttgggggcccatgaaacccttgaggaacgggtccaggggcttgatcacccacatggggaaaaaaccttaccgaaaagggggccccagaactcgtaaccgttgttgagcgcggccgaaaacc

SEQ ID NO: 1778 - DNA, 1039 bp, Zea mays
  UNSURE (1)..(1039): unsure at all n locations
  Clone ID: PAT_MRT4577_20206C.1
  unsure (1)..(1039): unsure at all n locations
attgggtacctcgaggccggccgggacacggccccacacacttcacttcataggcgccccagcagagctcatctctgcctcctgtgtccttctccatgacagagaatctccactccaggaaaatggtacagccaaagaagtttcgtggagtccggcagcgccactggggctcctgggtctctgagatcaggcatcccctccttaagaggagggtctggctgggtacctttgagacggctgaggaggcagcgagagcatatgatgaggctgctgtgctgatgagcggacgcaacgccaagaccaacttcccaatccaaagaagcagcacaggggagcctaccccagctgcgggaagggacgcccgcagcaacttcagcagcggctcctctaccaccaacctgtcccagattctcagtgcgaagctccgcaaatgctgcaaggcgccatcaccgtccctgacctgtctccgccttgaccctgagaagtcccacattggtgtttggcagaagcgtgcaggagcccgtgctgactccaactgggtcatgacagtggagctcaacaaagatgcagcatccactgatgctgcatcacagtccacatcagcaacaactgctccaccagccacgccgatggatgaggaggagaggatcgcactgcaaatgatcgaagagttgctgagcagcagcagcccagcttcaccctcaaacggagatgaccaaggtcgcttcatcatctgaaaagcatggatcaaacagcacaagtcaccatcccagatcagagtttcgctaggtcggttggtacacaagcagttcaggttgcttcagtaatatagatatatgtctattactaaatccaacttacaagaactataaagtttgcaattgtgtgcagttctatgtacgtgaaaagctctacatacacatgttcctatcaagatactttgttacacatcaatgtcagtgatataattgcttataaaagaaataaatagattatgattgtgttactgctaaaaaaaaaaaaaaaaaaaaaccctant

SEQ ID NO: 1779 - DNA, 129 bp, Zea mays
  Clone ID: PAT_MRT4577_20284C.1
actaactacctgaggccggacatcaagcgcggccgcttctccttcgacgaggaggaggctatcatccagctccacagcatcctcggcaacaagtggtcagcgatcgcggcgcggctgcccgggcggacg

SEQ ID NO: 1780 - DNA, 244 bp, Zea mays
  Clone ID: PAT_MRT4577_20295C.1
ttttctattttcctcgcgccgccaccaacgcggccgtggcagtctcaatccctgacgggaaccatggctgtctcgcaggagtccctctctttggtgggcacgatgcgcggccacaacggcgaggtgactggttaacgcgaccccgatcgacaacttgccgttcattgtctcctcctctcgcgacaagtacctgctggtgtgggacctgactaacttggtccactccacctcggaaatacggcgc

SEQ ID NO: 1781 - DNA, 377 bp, Zea mays
  Clone ID: PAT_MRT4577_20297C.1
gtactcttcttatcttctggcgaagccacgaaacatcacaacgaaaaaactttattattcgaactataactgataaggaaatctaaaagagggcaccaccaatgatgggttgttggtagaatgctgctgggtttgtcaaagcaagttgtatgaatggcagcatgtgttgcagcttgtaagagggcgccagcgttaggcgcagcgtgctggctagaacggcaacaattgtggccgtgtcaagaaggtagcagggctcacaccagctagctggctgaatggcatcagttagttgctgctgtaaataagcacgataggtcaaagctgccagttgcttgactggaagaaactgctgtacgttggcacgcaatagctggctg

SEQ ID NO: 1782 - DNA, 378 bp, Zea mays
  Clone ID: PAT_MRT4577_20794C.1
gatggcttttcctcccccttcggttcgggttcgggttcgtgaggatctgcggggttcggaggcgtgggtgagcggatcgagatggccgcgtcagatgttgagtaccgatgcttcgtctgcgggctaggctgggccacggacgatcacttgcttcacaacgtcttgagcacctacggcgaggtcctcgagtacaagatcatcctcgatcggcagacgcataagtaccgcggattatgattcgacaccttctgcacggatgatgcgatgcagaacgccatcgagggcatgaacggtaaagagctgtactgctcgaacatcaccgtgaacgagggccagtcccgcggaggtcgtggaagcgagcgcggcggagggtactga

SEQ ID NO: 1783 - DNA, 246 bp, Zea mays
  Clone ID: PAT_MRT4577_20797C.1
cccccttctcgccttctccttctcttccctagtctagaggcgtgggctgcccaatcccttcggcccgcccgctcgacgtgatcccaccggcagccctggatccatacaagcaccgcccgtctagtgggagcaactccagcttctggaccaccaactttggtgcccgcgtctggaacaacaactctgcccttatcgtcggacggcgaggttcaatccttctcgcggactattatctattcgaaaagt

SEQ ID NO: 1784 - DNA, 249 bp, Zea mays
  Clone ID: PAT_MRT4577_20809C.1
gcgatggcggcggctgatgtggagtaccgttgctacgtcggcgggcttgcctgggccaccaggaacgagtcgctggagaaggccggcgcctcctacggcgagatcctcgactccaaggtcatcaccgaccggtagacggagaggacccgtggcttcggttatgttaccttctcctccgataactccatgctctacgctattgagaacatgaacggcaaggtgctagactgtcgtaacatcatcgttaac

SEQ ID NO: 1785 - DNA, 1915 bp, Zea mays
  Clone ID: PAT_MRT4577_21027C.1
cttggcagaaagaggggccggcacgcggccggcggcttttcaagacaccaaaaggggtttcggcatggatggatagcacacagcgagcgagcgagagcggtgagcccggccaccagcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctggagcgcctgcgagggcgcgtcatcgtgcgcatgctctccccgatgtcgcacttcgagaacgggacctgggaccacggcggcgactgcaggcgcacgcagccgctgcgggcgaaccagaccgccatggagggccgcgacctgcacttctacaccgcgcagatggaggagttccgcgccgcggagaaggccgccgccgagaaggggcggcgcctgatgctcatggacgccacggcggcgatgctgatgcggcccgacggccaccccagccgctacgggcactggcccaacgagaaggtgcagctctacaacgactgcatccactggtgcctcccgggacccatcgacatctggaacgacatgctcttccagatgctcctcgcctagcagcaagcagcaaagattaaaaaaaaaactcagcaattcggtcgccggtaaccgtgcacagattggccttcttttttttgccttgtttcgtttttttaaaaaaagaagaaaatggtgcaattttgacaagcaaggattcgaaattcgccggtaaccctccgagatcatccgttccctcctctgcttgttctgtggtgtcgaaattgctccctgtctgtcggtcggcgccgtggaaaggggcaaagcaaacaaccaaaaagggccgctcgcagtcgcagcggtggcgcctttgattctgttgtagagtagtatatggctggcgcatgcaagctgtcgaaaaaaaaaggtcacggccgtcctctgatcttcgaaccgaattgaaatgaaagttcactccaaaaaaaaaaaaaaaaaagcggcc

SEQ ID NO: 1786 - DNA, 772 bp, Zea mays
  Clone ID: PAT_MRT4577_21028C.1
ccttccgggacgcggccaccggcttattcaagagcagcaaaaggggtttcggcatggatggatagcactagctagacatcacacagcgagcgagcgagagcggtgagcccggccaccagcgccggaggccgtcgtcgtcttactagccgacgctcgacttgggcatgaattgctagccgggtgagagattgctaggtagccagctaggtacggtgtggggagttgaatcggaggtctgccgctcgaggcgggaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctcgccttcgtcggggactcgctggcgcggaaccacatgcagtcgctgctctgcctcctgtcccaggtggcgtatcccaaggacctgtcggggaacccgtcggacc

SEQ ID NO: 1787 - DNA, 253 bp, Zea mays
  Clone ID: PAT_MRT4577_21080C.1
cccggagcgcgtggtgcacgcgcgcggggcctccgccaagggcttcttctagtgcacccactacgtgacgtcggtgaggtgcgcctacttgctgcgcgcgcccgacatgcgtacgcccgtgatcgtgcgcttctagactgtgatccacgagcggtggtgcttgaagacgatgcgcgacccgcgcggtttcggcgtgaagttctacacgcgatagggcaactggaacctgctgggcaacaactgtcgggtgttc

SEQ ID NO: 1788 - DNA, 494 bp, Zea mays
  Clone ID: PAT_MRT4577_21176C.1
taatggagtctaagggtggcatactgtctagcagtagtcgttccatgatgtatgaagctccccttggctactgcattgaggacggtcgacctgccggaggcgcgaagaagttccagtctgctgcttactccaactgcgcgaagaaggcgtgctgatgtcccttttggcttcctcattctagcagtttaggatttgctttctgccactgtgattgtgaccaatgctctctggcctgctgcttgctgatcatcgaccagttccccaggcttgctccttgcgctcctccctcctccatctccagccttgcgttctgattcacctgctccaatggctgttctttctgctgctggtgcgtccccggtctccgctagtcgggccgagggctctgagacgcgccttgtgatcacattgtctgagggccctgtctttgtggaccctcatgggcgcggtttgcgtgccctctccgggggcccgtttgactgtgggccgggtct

SEQ ID NO: 1789 - DNA, 238 bp, Zea mays
  Clone ID: PAT_MRT4577_21206C.1
gaagaacaacccatgcgaatcagcctgcacttcaggggccgtgaactgagatggagggaacgctgctgcaagcggcagggatgcataaagtactatccacaatgaacattaccattccgatagccgtatcatctctgctctgagcacactctactctgatccgagctcatcccactattatgaatgtgattcacactttgactataactaactcgtctgacacatgcgagtaatattc

SEQ ID NO: 1790 - DNA, 487 bp, Zea mays
  Clone ID: PAT_MRT4577_21269C.1
agaacgcaggcccaagctttttttttttctttgttcttttttttttttgttcacattcaaccaactgtctacactgaaccctgctgctaatttgcagcaacaactattaccattaagcccgctatctgctgcctacccccagcaatttcttccattcaaccaactgacagcattgaactctcctgcttatttacagcagcaacaactactaccattcagccagctagctggtgtgagccctgctaccttgttgacacaaccacaggggttgccgttttaccagaacgctgcgcctaacgctggcacccttttacaactgtcaaaatcgctgccgttcaaccaacttgctttgacaaacccaacaaatttctaccaacaaccaataattggcggggcccttttttaaattgctgattacaaatagctcaataataaagtttttacagtgaggttagtggcttcccagaaataagaaagtacctcggcc

SEQ ID NO: 1791 - DNA, 463 bp, Zea mays
  Clone ID: PAT_MRT4577_21270C.1
agaacgcaggcacaagctttttttttttctttgttcttttttttttttgttcacattcaaccaactggctacactgaaccctgctggtaatttgcagcaacaactattaccattaagccagctatctgctggctacccccacaatttcttccgttcaaccaactgacagcattgaactctcctgcttatttacagcagcaacaactactaccattcagccagctagctggtgtgagccctgctaccttgttgacacaaccacaatggttgccgttttaccagaacgctgtgcctaaaggtggcaccctgttacaactgcaaaaatggctggcattcaaccaacttggtttgacaaacccagcgaatttctaccaacaaccaataaatggtggggcccttttttagattgctgatgagtataagctcaatagtacagtttttacactgaggttagtggcttccc

SEQ ID NO: 1792 - DNA, 271 bp, Zea mays
  UNSURE (1)..(271): unsure at all n locations
  Clone ID: PAT_MRT4577_2141C.1
  unsure (1)..(271): unsure at all n locations
ggaagtttcatttgatatgccanagtacgattgcatgcccgtttgtcgagggatgcatttgctgcactttgcccctggtggctacccggcagctgcaaaaatgctgaatctaagtagctctgctgtatctgggccatcaagaactcatgtggatcatgccgctcttaccggtgcctctcatccagcttctacggtcaagacacgcatgtgcaccatgtacaacactacagaagtgctgcagttcggggatacgtgccatttcgctcatagc

SEQ ID NO: 1793 - DNA, 1917 bp, Zea mays
  Clone ID: PAT_MRT4577_21539C.1
tttttttttcgcaaatcaggatccgtctttgggaatgctcttgaggaaagcaagttattcataaacgacaaataacttgagcaaatcgcttacaaatgataatcagataagtagagtcaacaagacaaaactgtatctggcaacgcacatcgcctcaccccagccgactacaccattattcttcagcaaaagcaaacagctccttccctcccccctcagctcaagcgataaccataagaaaacctgctacgcgactgcgtataatgcatatgcatgcaaaagataactgacaggccagtgtagcgaacttcatagcacacaacggcccgagtgagctgcaagccgtgtgctggctgcctagtaccggtagtgggcaggcttgtagggaccctcgatcggcacgctgatgtagtcggcctgagacttggtgagcttggtcagcttggcaccaagcttgcccaagtggagagcagcaaccttctcatcaaggtgcttggggagcacatacaccttcttctcatacttgccagagctcttctccttccacagttcaagttgggcaatgacctggttagtgaatgagcaggacatgacaaagctaggatggccagtagcacacccaaggttcatcaggcgaccctcagcaaggacaatgatgccagtgttgatctcggggaacacccagcggtcagtctggggcttgatggtgatgcgcttgacgccagggtaggtctcaaggccgagcatatcaatttcattgtcaaagtggccaatgttgcagacaatggcattgttcttcatcttcctcatgtggtcaaccatgatgatatccttgttgccagtggtggtcacgaagatgtcagcttcagagacaacgtcctccaagggaaggacctgaagaccctccatcagagcctggagggcacagatggggtcgatctcggtcacaatgacacgggcaccagcctgcttgagtgcagcggcacaacccttgccgacatcaccgtatccgcagaccacggcaacctttccggcgatcataacgtcagtggccctcatcagaccatcagggagcgagtggcggcaaccatacaggttgtcaaacttgctcttggtgacggaatcgttgacgttaatggcagggaagaggagggcgccggtctcctgcatctggtagagcctcttgacacccgtggtggtctcctcagagacgccgacaagcctctccttcatcttgcggtacttcttggggtcagccttgagcccgtcgcggatgatggtgagcacgatcttgaactcagcgttgtcggtggactccggatcggggatcttgccggtcttctcgtagtcctcctcggccttgacaccctcgtggatgagcagcgtggcgtcgccgccgtcgtcgacgatgaggtcggggccgcccgcctcgccccagtcgaggcagcgctcggtgcaccaccagtactcctcgagggtctcccccttccaggcgaacacggcggcggagtcgcgggcgatggcggcggcggcgtggtcctgggtggagaagatgttgcaggagcaccagcggacctcggcgccgagggcggtgagggtctcgatgagcacggcggtctggatggtcatgtggagggagccggagatcctagcgccggcgaagggcttggacgggccgaactcggtgcggcaggccatgaggccgggcatttcgacctcggcgaggtcgagctcgaggcgcccgaagtcggcctgcgagagatccttgaccttgtactcccggcccgacgaggtcttctccacggagagcgccatggcggcagaggagggagaactcgcgaattggatctgggagatggggaaatggaacgggagtgagggagaagacggccccggccggcctcgagggtcccaatg

SEQ ID NO: 1794 - DNA, 466 bp, Zea mays
  Clone ID: PAT_MRT4577_21542C.1
gaccctcgaggcctgccggggcgccgtctcctgcctactgtcgttcatttccccatctcccagatccaattcgcgagttctccctcctctgccgtcatggggctctctgtggagaagacctcgtctggacgggagtacaaggtcaaggatctctcgcaggcggacttcggccgactcgagattgagctggccgaggtcgaaatgcccgggctcatggcgtgccgcgccgagttcggcccgtcgaagcccttcgctggcgctaggatctaggggtctctccacatgaccatccagaccggcgtcctcatcgagaccctcaccgcgctcggcgccgaggtccgctgatgatactgcaacatcttctacacgcaagaccacgccgccgccgacatggcgcgcgactcggccgccgcgttcggctggaaagctgagaccctcgaatgagactggtggtgcaacgagcgct

SEQ ID NO: 1795 - DNA, 418 bp, Zea mays
  Clone ID: PAT_MRT4577_21544C.1
tgaattcggcacgaggatttccgcatgggccagatccaattcgcgagttctccctcctctgccgccatggcgctctctgtggagaagacctcgtctggacgggagtacaaggtcaaggatctctcgcaggcggacttcggtcgtctcgagattgatctggccgaggtcaaaatgcccgggcgcatggcgtgcctcgtcgtgttcggcccgtccaagcccttcgccggcgctaggatctcggggtctcttcacatgaccatccataccgccgttctcatcgagaccctcaccgcgctcggcgccgaggtccgctggtgctcctgcaacatcttctccacgcaggaccactccgccgcctgcatctcgcgcgactcggccgacgtgttcgacatggaaggagagaccctggacgaatact

SEQ ID NO: 1796 - DNA, 1941 bp, Zea mays
  Clone ID: PAT_MRT4577_21545C.1
ggccgcttttttttttttttttttcgtcaaactcggtactcaagcaaccaaaatcaacgcaaatcaggatccgtctttaagtatgctcttgaggaaagcaagttattcataaacgacaaataacttgagcaaatcgcttacaaatgataatcagataagtagagtcaacaagacaaaactgtatctggcaacgcacatcgcctcaccccagccgactacaccattattcttcagcaaaagcaaacagctccttccctccccctcagctcaagcgataaccataaggaaacctgctacgcgactgcgtatatgataatgcatatgcatgcaaaagataactgacaggccagtgtagcgaacttcatagcacacaacggcccgagtgagctgcaagccgtgtgctggctgcctagtaccggtagtgggcaggcttgtagggaccctcgatcggcacgctgatgtagtcggcctgagacttggtgagcttggtcagcttggcaccaagcttgcccaagtggagagcagcaaccttctcatcaaggtgcttggggagcacatacaccttcttctcatacttgccagagctcttctccttccacagttcaagttgggcaatgacctggttagtgaatgagcaggacatgacaaagctaggatggccagtagcacacccaaggttcatcaggcgaccctcagcaaggacaatgatgccagtgttggtctcggggaacacccagcggtcagtctggggcttgatggtgatgcgcttgacgccagggtaggtctcaaggccgagcatatcaatttcattgtcaaagtggccaatgttgcagacaatggcattgttcttcatcttcctcatgtggtcaaccatgatgatatccttgttgccagtggtggtcacgaagatgtcagcttccgagacaacgtcctccaagggaaggacctgaagaccctccatcagagcctggagggcgcagatggggtcgatctcggtcacaatgacacgggcaccagcctgcttgagtgcagcggcacaacccttgccaacatcaccgtatccgcagaccacggcaaccttaccggcgatcataacgtcggtggccctcatcagaccatcagggagtgagtggcggcaaccatacaggttgtcaaacttgctcttggtgacggaatcgttgacgttaatggcagggaagaggagggcgccggtctcctgcatctggtagagcctcttgacacccgtggtggtctcctcagagacgccgacaagcctctccttcatcttgcggtacttcttggggtcagccttgagcccgtcgcggatgatggtgagcacgatcttgaactcagcgttgtcggtggactccgggtcggggatcttgccggtcttctcgtactcctcctcggccttgacaccctcgtggatgagcagcgtggcgtcgccgccgtcgtcgacgatgaggtcggggccgcccgccggcgccccagtcgaggcagcgctcggtgcaccaccagtactcctcgagggtctcccccttccaggcgaagacggcggccgagtcgcgcgcgatggcggcggcggcgtggtcctgggtggagaagatgttgcaggagcaccagcggacctcggcgccgagggcggtgagggtctcgatgaggacggcggtctggatggtcatgtggagggagccggagatccgggcgcccttgaagggctgcgagggcccgaactcggcgcggcaggccatgaggccgggcatctcgacctcggcgagctcgagctcgaggcggccgaagtcggcctgggagaggtccttcaccttgtactcccggccggacgcggtcttctccacggagagcgccatggaggaggttggtggattggatctgccgaggagggagaggagtggtggggggaggcggcgatggagagggttt

SEQ ID NO: 1797 - DNA, 678 bp, Zea mays
  Clone ID: PAT_MRT4577_21546C.1
ggtcgtgccggggtcgtcttctccctcactcccgttccatttccccatctcccagatccaattcgcgagttctccctcctctgccgccatggcgctctctgtggagaagacctcgtctggacgggagtacaaggtcaaggatctctcgcaggcggacttcggtcgcctcgagattgatctggccgaggtcgaaatgcccggtctcatggcgtgtcgcgctcgagttcggcccgtccaagcccttcgccggcgctaggatctcggggtctctccacatgaccattccagaccgccgtccttcagtcgagacccttcaccgcgcttctgcgccgaggtccgctggtgctcctgcaacatcttctccacgcaggaccacgctctccgctcgtcatcgcgcgcgactcggtctccgtgttcgcctgggaagggggagaccctcgaggagtactggtggtgcaccgagcgctgcctcgactggggcgaggcgggcggtcccgacctcattcgacgacgacggcggcgacgccacgctgctcatccacgagggtgttcaagccgaggaggactacgaagaagaccggcaagatcccccgatccggagtccaccgacaacgcccgagttcaaagatcgggctcaccatcatccgcgaagggctcaaaggtgaccccaagaagtac

SEQ ID NO: 1798 - DNA, 447 bp, Zea mays
  Clone ID: PAT_MRT4577_21551C.1
ttccgttcgacccacgcgtgcgcctactctcgtccatttccccatctcccagatccaattcgcgagttcttcctcctctgccgccatggcgctctctgtggagaagacctcgtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgtcgtcctcatcgagaccctcaccgcgctcggcgccgaggtccgctggtgctcctgcaacatcttctccacgcaggaccacgccgtcggcgtcatcgcgcgcgacttggtcggcgggttcgcctggaaaggggagacccttgaggagtactggtggtgcac

SEQ ID NO: 1799 - DNA, 305 bp, Zea mays
  Clone ID: PAT_MRT4577_21705C.1
ctcggtccggaattccggcggcgcacgcatccgagatacatttccactgcaaccaatatgtttgcatagatggcgctcctagctctttgtacatccgccactagtgcgacccatatcccagggcacttgtcaccactactgataccattggctaccatgaacccatcgatgcagtactgcatgcagcaacacgtggttgcccacttgctagcctagccgaccctgatgctgcatcaactgctggcctaaccgcttcagccatgccagatgccaatcatgatgccaggtatgatgccaccgatgac

SEQ ID NO: 1800 - DNA, 1431 bp, Zea mays
  Clone ID: PAT_MRT4577_2185C.1
cattgggtacctcgaggccggccgggatagatttcattggaatcctcgaggccggccagtcatatctcccaagagcggcaagcctagcaatcaacaattcccccggtcgttttcacttgacatcccccgtcccatagatcgccggcgatggctccggccgttgccgcggcggcgtcggcggcgatgaggcaggcactgcgggaccggcagatcctcgatgccgtgggcactggcgctgcggcgctctcgctggcaggctcttccttcatcgtgatctgctacctcctcttccgcgagctccgcaagttctccttcaagctcgtcttctacctagccgtctcggatatgttttgcagcttattcactatattgggggggccatcgaatgcattttactgctttgcacatgactacagtgctcatttcttctgtgtggcttcttttctatggacaaccaccatatcattcactctgcatcgcacagttgtaaaacacaaaactgatgttgaagaatttggatctattttccacttatatgtgtggggaacttcactatctaccactgtattacgttcgataggaagtgactacggaagaccaggcacctggtgctggattcagcagggaagcatggcaaaggtcctacatttaataaccttttatcttccactttggggtgccattttgtacaatgggtttacatactatgaagtaaaccgcatgctgaataatgcaacgcagatggctgctggcataagtgatcaatcaaatcagtctgacattagggcaggcaggaaggcatttaaccgatggggttattaccctctaattctaatcggttcatgggcttttgcaactatcaatcgtctttatgactttgccaatccagggcacaggatagtctggctctcctttcttgatgttgggttcgctggacttatgggcctattcaattccattgcttatgggctaaactcttctgtgcgccgagctatttcagagagaatcgacacgttcctacctgagagaataaaaaggagcctccctgctttgtcaaggctgaggagtcaacaggaaaatgaactcacttctcttatcgttgagggtaactgatatgtaatggattttccatgcacacgaagctttttttttgtttatctgttcgttcttcaatctccaacaagggaatgcaacatcactgtaggagcagtgggttagtaacacgtcgaattggttccgctgtgtccattgttgatcgtcttaacacgagacctggggtttggggttcaccgctccggccggagtacataggagggctagagtaggaacagtcggtagatagactgatgttcatctgtagctaggtaagcagagtctgtttgttcagatgtacgagtataaccacctctgtacaatgcacattctagcgcc

SEQ ID NO: 1801 - DNA, 888 bp, Zea mays
  Clone ID: PAT_MRT4577_21869C.1
gggtactcaggccggcggggccgggcggatacccctccattctcctaccaaaaatcgcagcgccgcccgcaccaatctcgaagtgttcgaaggtttccagacccccaaaaggcgaagcggcgatgagttccaccggaggcggcggccgcgggaaggcgaagccagcgaccaagtcggtgtcgcggtcctccaaggctgggcttcagttccccgtcggtcgcatcgcgcggtacctcaaggccggcaaatatgcggagcgcgtcggcgccggggcccccgtgtacctctccgccgttctcgagtatctcgccgccgaggtgctcgagctggccgggaacgctgctcgggacaacaagaagaaccgtatcgtgccgcgccacatccagctggcggtgcggaacgacgaggagctgagcaagctgctgggcactgtgacgatcgcggccggcggcgtgatgccgaacatccatcagaccctgctgcccaagaaagctggtcagaagggggacatcggctctgcctcccaggagttctaatctaagcgtttcggcggaatgaggagagggaccgcccctgtttctgtctcgtccgcgtggttgtgtttcagctctgcggtttttgggggagtgctgtcgatgagttgggattgatatgggttgtggggatgtaaacaaacgcagcgcgttgtttcatgaatgaatgatggatagaaggaacatatctatcatgatttctaccctggttgcatttggatccgatttgctcctatcgtttggtccattgtatcagacctgatgatggaactttttctatcggttctatgaactctgcatcatatgatcaaaaaaaaaaaaaaaaaaaaaaaaaaaaaaaaaaaaaaaaaaaaaa

SEQ ID NO: 1802 - DNA, 224 bp, Zea mays
  Clone ID: PAT_MRT4577_22005C.1
cccacgcgtccgctccaaacgcaggagagcctctagcgccgccggtctctggagcctcggagcacaccggcgccggcgctagtgaccgatgcagcctacggattccggcggcgatggcatgtaagggagggaagggtctgctggcagccaagacgacggcggccaagagcaccgacttggacaaggacaggaagaaggccctcgtgtcacgctcctgccgaacc

SEQ ID NO: 1803 - DNA, 454 bp, Zea mays
  UNSURE (1)..(454): unsure at all n locations
  Clone ID: PAT_MRT4577_22008C.1
  unsure (1)..(454): unsure at all n locations
ctttgcccttccctccctccctctccccgtttgccgacagaggcaatttcgccctggattgggccccgattcgtccgaccgcgaccgggattacctccggcaagcgcggatctgaacgctgcgctccgtgttctcgctcgaatccgccatgaatggggccaaattcaatggcgccgtcaaagccgatgccaagctggcggcgaaaagcaagggggcggagaaacccgccaagggcatgaaggggaaagccagcaaggaccccaacaagcctaaaagggctcccaccgctttctttgtgttcatggaggaatttcgcatggaagttcatggagaagaaccctaagaacaagtctgccgctgncgtgggaaagctgctggcgacaggcggaaatccctgagcgagtcggacaaggctccctatgtagccaaggctaacaagctcaagctagagtac

SEQ ID NO: 1804 - DNA, 415 bp, Zea mays
  Clone ID: PAT_MRT4577_22068C.1
ccgacgcgtacggacaccaactacaacatacaaagcacaatattttaccaacaatcgcagccaaaatattctgctcgacttatactcctggggcgttctgcaaatattgctaccgcaaccattttcccacaatgctcacaaactcctataacttcccttcttcccccatacctctcaccaacggtgtcttcaatgtgtgaaaacccaattattcaaccctacaagatccaacatgcaatctcaacaagcatcttaccattattacccttgttccttcaacaaccgtcagccctattacagcacttaccttttgtccatttggtggcacaaaacatcagtgcacaacaactacaacaacttgtgctaacaaacctttcttcatactctcatcaacataattttttttcattcaacc

SEQ ID NO: 1805 - DNA, 1716 bp, Zea mays
  Clone ID: PAT_MRT4577_22093C.1
cctcgaggcaggcagggccgagccaagtcgggaaggcagaggcacagggagggagccgacagccgagagcaccttccgattccgcccaagaaatctccacccaatctctctgtcctctcctcccttctcatcatttcgccatgctgccatcgcacctcaacggccactccgccctcgggcgccgtcgcccgcgcctctccgccgccgccggggagtctccggcggcagcgggggtagaggcggcggctccgctggaggagcacgaccgcatctacttccaggcctactcccatctcggcatccacgagactatgatcaaggaccgcgtaaggaccgatgcttaccatgcagcgatcatgcgccaccagaaatttatcgaggggaaggttgtgctggatgtggggtgtggtactggaatactctctgtgttctgtgctcgtgctggcgcaaagcgagtgtatgctgtcgaagcctgtgaaattgttgtccaggctcgtgaaattgtaaaagcaaacaacctaactgatcagattgtggtcatccatggacgtgttgaggatgttgaccttgaggaaaaggttgatgttataatatcagaatggatgggctatatgcttctctatgagagtatgctgccaagcgtcctatttgcaagagataaatggcttaagcccgggggtcttattcttccttctcatgctacgctcttcatggcccccgtaacaaatcgtgagagatatgaagacagcgtcgatttctggcgtgacgtctatggcataaacatgtctgctcttgtgccacttgccaaaaagtttacatctgaggaaccctccattgaaacaattggtggagagaatgttataagttggccatctgtgttcaagcgcttcgattgctataattttacagctgaggaattcaaatctatcacttcaaaatacaaagtttcatcaatgatgttagctcccattcatggctttggtttctggtttgaggtggagttcaacgagcctatagagtcctctcataattttccttccagtttggatccacttgagattatacagaagaaaaggagacgatcctcagaagatatagttctgtccacagccccagaggatgagccaacccactggcaacagaccattttgtatttcccggatcctatagaggtgaagcaggaccaaattatagaaggttctgtaacagtgtcccaaagcgaggagaacccacgttttctgaatattcatctagagtgcttcacaggaggacagacattggttaaggactgcgccatgcgatgaactggtgtttttatgcttctagtggcttgatttcaggcgcgcaatggggtgttggcagggaggagctgacaatatttcagatttctttaatggaagtggagaatttgtactatttatgccaattatccgtctaatacgaaggcaggattttagtaattgtactccgtcttattctatagagtatatactggttgttgattttggatccgcacgctgtgacctaagtctcgcatccaagggtccctttggaacaaaggaaacatgaaggatttttttatgatcctatcattccattctcctgatagcgaaagaatctcctcacgtgaagagactaagcgcaaacagagttaatagtggcggcctgcctctagaaggaatccataggcttacggttacggcggtggcagtgcga

SEQ ID NO: 1806 - DNA, 611 bp, Zea mays
  Clone ID: PAT_MRT4577_22265C.1
gggtacccttttggtccggccgggctccccatatatccccactcttcgcctcctttctggagcagctagggttccgtcctcgatccgatccgccgagtgcacaccacctttccccactccgatcgaatcgatggctgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctacccaaggtaatcgagtactggaacaagcacgtacatgccggcggcggcggcggcggcggcttgaaaggcgggtccgacgacgtgggtggcggcttcggcaacaggaccggcggcttcggggaggacctcaagaactgggatgcggacttcgtcaaaggcgaccaagccacgcttttcgacctcatcttgggtggaaactatctgaacatcaaagggctggtcgacctgacctggcagactggtggtggcatgatcaagggccagacaccagaagagattcgcaagaccctcaacatcaagaatgacttcaccc

SEQ ID NO: 1807 - DNA, 1012 bp, Zea mays
  UNSURE (1)..(1012): unsure at all n locations
  Clone ID: PAT_MRT4577_22268C.1
  unsure (1)..(1012): unsure at all n locations
caatctttcgccctcttcgcgcagcagctacagagctagggttccgtcctcgatccgatccggcgagtgctcaccacctttccccacttccctccgatcgaatcgatggcggccgagggcgaaaagaaaatgataaccctcaaaagctcagatggtgaggagttcgaggtggaggaggcggtggcgatggagtcgcagaccatccgccacatgatcgaagatgactgcgccgacaacggcatcccgctccctaacgtcaactccaagatcctatccaaggtaatcgagtactgcaacaagcacgtacatgccgccgctgccgctgccgcagcctccaaggccggttccgacgacgtgggtgccgccgccgccaacagcaccgccgcctccggtgaggacctcaagaattgggatgctgacttcgtcaaggtcgaccaggccacgctcttcgacctcatcttggctgcaaactatctcaacatcaagggtctgctggacctgacctgccagactgttgctgacatgatcaagggcaaaaccccagaggagatccgcaagaccttcaacatcaagaatgacttcacccctgaggaggaagaggagatccgcagggagaaccagtgggcctttgagtaaggaggtgctggatctcttatgcctaggtttcgtcatatctactaccttgcaatgctctgcttttaaatgtcatcgtaatggttgtaagtattttgggagtcactttgcttgagaatgtgttgggtaaaactgatgtggtcaatggtcggttattactatgaaaggacatcggctgctgccctaagaggtctttaaagtcccatttgcccattaataaccaattnncaatccttgnntggatgattnntgtgtgattcnnncatcgtgaatcnntcatggtaaaatatnntttcattgttgtgatactgcctatnntcgcagtccagnnttgtattttttgttttttaaacaaaaaaaaaaaaaaaaaggggcggcc

SEQ ID NO: 1808 - DNA, 674 bp, Zea mays
  Clone ID: PAT_MRT4577_22270C.1
gccggccgggtcgggagctagggttccgtcctcgatccgatccgccgagtgcacaccacctttccccactccgatcgaatcgatggccgccgagggcgagaagaagatgataactctcaaaagctccgatggcgaggagttcgaggtggaagaggcggtggcgatggagtcgcagaccatccgccacatgatcgaggatgactgcgccgacaacggcatccctcttcctaacgttaactccaagatcctatcccagggaatcgagtactggaacaagcacgtacatggcggcgccgccgccgccgccggctcgaaaggcggttcccacgacgtgggtggcgcctccgccaaaaggaacggcggctccgggggggacctccagaactgggatggggacttcgtcaagggcgaccaaggcacgcttttccacctcctcttgggtggaaactatctgaacatcaaggggctggtcgacctgacctggcagaatggtggtggcatggtccagggcaagacaccagaagagattcgcaagaacttccacatccagaatggcttcacccctgaggaggaagaggagatccgcagggagaaccagtgggccttccagtaaggaagtggtggatctattgatgcctaaggttcgtgggggctactactatgtctactttatg

SEQ ID NO: 1809 - DNA, 587 bp, Zea mays
  Clone ID: PAT_MRT4577_22271C.1
ccggccgggatatatccacccgacaccccaccccgccgcaatccccaatatatcccccatctcttcgactcctttctggagcagctagggttccgtcctcgatcgcgatccgccgagtgcacaccacctttccccactccgatcgaatcgatggccgccgagggcgagaagaagatgataaccctcaaaagctccgatggcgaggagttcgaggtggaagaggcggtggcgatggagtcgcagtaccatccgccacatgatcgaggatgactgtgccgacaacggcattcctcttcctaacgataactccaagatcctattcaagggaatcgagtactggaacaagcacgtacatgccgccggcggcggaaccggcggcttgaagggcggttccgacgacgtgggtggcggcttcggcaacaggaacggcggcttcggtgaggacctcaagaactgggatgcggacttcgtcaagggcgaccaggccacgcttttcgacctcatcttggctggaaactatctgaacattaagggtgtggtcgaactgacctgtgagactggtggtggcatgatcaagggccagacac

SEQ ID NO: 1810 - DNA, 2293 bp, Zea mays
  UNSURE (1)..(2293): unsure at all n locations
  Clone ID: PAT_MRT4577_22272C.1
  unsure (1)..(2293): unsure at all n locations
gggggacaactgaatcagggcaggccggtatggatcgctacgtatcgcgcgaaaaccgtggttgggcacctcgaggccggccgggccggcctaaataacttatgaggccaaactaaagagggcagggcaggcgaatcgaaggaaaagtagtcaggagaggcgtttccctcgcaatcgaccatcacagatcaaatcgctgcaactagctagggtttcgtcgcctcatctctcgtggacaacggcataatgaagcaaaaaggtcggctagatataaaaaatgggagcgagcttcacaaagcagggttcaatgttagaaattagctcgtgttgccttcgaagtctatccgtgagatgcctgcccctatacatatatatttacatccacatatgtatgtgtgtggccgccgcgtggcttggctggatcaagtcatgccgggtcggggcggatcgggcccctcgctcggctaccgagaaggtgaacgggccttccgggaaaaaaacttcgaacatattgatatgttccgcattgggtacctcgaggccggccgggccggggatccccaatatatcccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgcttgcgaatgtctcgcgtaagacttatgttggtcaatggtcggttattaacttattaccatgaaagcacttcgtctgctgccctaagaggtttagtcccatttgcattataaccaattcaatccttgtggatgatttgtgtgattccatcgtgaatctcatggtaaaatattttcattgttgtgatactgccaaaaaaaaaaaaaaaaaaaaaaaaaaaaaagcggccgccccctgctctggtaatcgggaaactgcggggtccgcggctgtggcgcgggtgcccgcggttctgtacacctaccggaggtcgctctcggtcagctcgtcgtcctgtcctggtccttctcctcctcctcgtcggaggaggacgagtcactgattgccgacgaggaataatgaagtgtacaccataggtccctctcggtcagctcgtcgtcgtcgttcttctcctcgccggaggaggacgactgattcccgacgaggaataaataaagtgtacaggttgctgaatgcaacagcctttgtgcaggagaatcgattaggtgtgtgtggtttgtacgccaattctttttgtgacctctgtatatatccaatcattgcattgcatataaaaaaaaaaaaaaaaaaaaaagttgttttcctttccctggtgatgggggtggtttttttacaaaaacaaatggatgtctgcactgccctttacaatgctagtctatctactttcgaaatagtagttaaatagtagtataatggtcgtgatggttgtaccctttttggattggatgtatgtcaagctggtgggtgctagttcgtctgtctggacttgttactagttaatatctcataatacatatataaaagtggatcttttaaaaatttgcctcccaaaaaaaaaaaaaaaaaaaaaaaaaaaaaaaaaaaaaaaaaaaaaaaaaaaaaaaaaaaaaaaaaaaaaaaaaaaaaaaaggcggccgccaccgcggtggagtnccagttt

SEQ ID NO: 1811 - DNA, 253 bp, Zea mays
  Clone ID: PAT_MRT4577_22369C.1
tgctacccatatccaggcacttgtaccactactgatgccattggcttcatgaatcctggatgcagttctgcatgaaacaacaaggggttgcaacttgtatgcgtggcgccctgatgctgacaactgtggccttaccgttatccgtgcctgatgcaatgatgatgccaagtttgatgccaccgatgacaatgatgccgatgccgtaatgatgccatcgatatggtgccgctatgatgtcaccaataacgatagc

SEQ ID NO: 1812 - DNA, 366 bp, Zea mays
  Clone ID: PAT_MRT4577_22410C.1
gtacagttgtactgagctgagctgccggaggcagaatacgagaggctggcgatgacgatggcgacgaaggcggcgtgcgtgctgtcggtgtgggtgctcgtcgcatcggtcctgtactacatgggctcagcgcgcgcgcccatgtgcagctagccgtagctggagttcgactacttcgcgctctccatgcagtggcccggcaacatctgcgcctccatcagcgactgctgcgacaccaactgctgctgcagctcggagcctctccagacgtatacgatccacgggctatggccggactacgactacgggacctggccgtcgtgctgtcacggaacccaattcgagatggacaagatattgccactg

SEQ ID NO: 1813 - DNA, 640 bp, Zea mays
  Clone ID: PAT_MRT4577_22488C.1
ccgaggtggcgacaatcagaccatcaaaaagtgccagcggcctctcgcagtcgccgcaatggatagcaccttcatcatgatcaagactgacggtgtccagaggtgcctcattgatgagatcatcagccgttttgagaagaagggcttctacctcaaggacttgaagcttgtgaacgtggagaggtcgcttgatgacaagcactacaacaatctcgtctccaagtccttcttccaggggctcgagtgctacatcatctctgagcctgaggtgtgcatggtctgggaggataagagcgtcgtcacgactgtgcgcaagatcattggagccaccaaccccctgacttctgagaccgggaccatccgtggcgactttgctggcgacattggcaggaatgtcattcatggaagtgacagcattgatagtgctaataaggagattgccctgtgtgtccccgagggacctggtgattgtcagagcattcagcacccctgcatctactataatcaaacatgcatagcttcacatcacatcttgacagacagaggaagtatgtcaccacttgtgctctcacaatgatgtcgagaagattatgatctgtatcctggaaccttagttcaatgcaccgcatttctttctttg

SEQ ID NO: 1814 - DNA, 1255 bp, Zea mays
  Clone ID: PAT_MRT4577_22672C.1
agcttcgatccggactagctgcccctgccttaaatacaagtatgttgcttagttggatcatcttgatacaagtactgtgtgttgaagggcgggcctggtgcagcggtagagcctaccgtttgtaactggaaggtcccgggttcgagccccagcctctgcatattatgcgggtaaggcttggcgtttaaagatacccttccccagataccgcacagtgcgggaagcctacggcactgggtacgcccttagttagcacaagggtatttttattattgaagtccttacaaggtcatgtcgttctagtgtttctatttctttgctaccagtaggaccctctcctgatatacagcgtatcttggcaggcatagcatacaattggccaattcttcttggtggacaagctcactggacagttggacttgtagcaaccttgatggctattagtagcatcattgctgctgatacatctgctttcctttgtggaagggcatttggtcgtacccctttgactaacataagccctaagaagaccttggagggtgctttagctggcctagctggctgcgtactgaccactgtgctgctgtcgactgccttacgctggccaaggtcgcttttgagtgccacagcttatggaatcctgatcttcctgggttcgttattcggggatcttgttgaatctctgatcaagcgcgacgctggtgtgaaggactccggatcgctcattcctggtcatggtgggattcttgaccgagttgacagctacgttttcacgggggcactttgctactcttttgtcagagtggctctacccctgtacggggtctgattagagcaccggccttcttgttgttttgcctttctccttccatcagcaatgcggtcagtcaccatacattttaacatgcaacgatgagtatttgctgggatgccctagatcagttcttcatctcaagacaacgtggtcttccctccaagcgaatttggtggccactagctcgtcatcgacattgcttcttgctttgggtttgagatggcctttccagctcaaccagtttcttgcaagccttgtaactctgtgtgtacatagtttattttttcatatagagagagagtaaaaaggaaaggctaattattcatcacaaaagctgttaacagtgcattgaggcagcttatgtcaatatgtaccaaactacacttgttttaataattcaaggcactaaattccctatcaaaaaaaacaccccccccacac

SEQ ID NO: 1815 - DNA, 1517 bp, Zea mays
  Clone ID: PAT_MRT4577_22699C.1
cgttgctgtcgcgccgacacgcaagcagacccaccgacgcgtccgccgggcgggagagcagaagcaaagcgagcaacagagcagaagcaaagcgcagagctagcaagtgaccgaccgagagcaaataggcaaggcaacgcaggcaagatggtgcagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcgcagcgcgccaccaggggtggcctgctcatcgcggaggccacgggggtgtcggccaccgcgcaggggttcccggagtctcctggcatctggacgcaggagcaggtcgaggcgtggaagcccatcgtcgacgccgtccaccgcaagggcgccatcttcgtctgccagatctggcatgtgggcagggtctccaccaacgagctccagcccaacggcgacgcgcctatctcgagcacggacaagcagatctcccccgacgccaagtccggaacggcgtactcgaagccgcgccggctgcggaccgacgaggtccccgggatcgtcgacgacttcaggcgggccgcacggaacgcgatccaggctggtttcgacgccgtcgagatccacggcgcgcacgggtacctcctggagcagttcatgaaggacagctgcaacgaccgcacggaccagtacggcggcagcctggagaaccggtgccgtctcgccgtggaggtcgtggacgccgtcgtccgcgaggtgggcgcgcgccgcgtcggcatcaggctgtcgcccttcgtcgacttcgtggactgcgtggactcggacccggtggcgctcggccactacatggtgcagcagctcaacaggcatagcggcttgctctactgccacatggtggagccccgcattaccgcccacgggcgcaggcagatccctcacgggctcttgccgttccgaaaggcgtttcatggaacgttcatcgccgccggtggcggtgggtacgatcgggaggaaggcaacaaggtggtggcagaagggtatgctgacctcgtcgcgtatgggaggctgttcttggctaacccagacctgcctaggaggttcgagctggatgtggcactcaacaaatacgaccgctccaccttctacacgcaagatcctattgttggctacacagattaccctttctttgaagaagaagatggcaagaatgaggagtcagtctgatcacaactaataatgtggagggttcatcaagtttgagttcatcattatttccaccatttattattggccattatggcggagtcattgcgtcgtgttgtttcattatgtactagtgtggtgtgaagtgaaataaatctatttggtgaaattgttataaaataaattatagacttgtcggatttacctctaaaaaaaaaaaaaaaaaaaaaaagaaaaaaaaaaaaaaaaaagcggcc

SEQ ID NO: 1816 - DNA, 241 bp, Zea mays
  Clone ID: PAT_MRT4577_22775C.1
tcacgggtacataaagcttataaattgtcagggtgaaaagatgtcagttctctttcaagggtacatgtacaaatgattgatattcccaggataaatgtgcctggttctaggtgctctcgcacgcaccttttgctattgcatcaatggcattttaggctgttttaagagctgcatgctcctaaaattcttggaactgtgttttgagctttacagttgaattgttaagcacaaggttatcata

SEQ ID NO: 1817 - DNA, 444 bp, Zea mays
  Clone ID: PAT_MRT4577_22776C.1
atttagaccaactagcaacatagaaagcacaatagtgtaccaacaatggcagccaaaatatgttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttaaccttaataaccctggttcttccaccaataataacccttttaccagaagtacctttggggcctttattggcaccaaacattaagggacaaccacttccacaacttgggcttacaaaacttggtggctacttttaacaacaacaggttctttcattcaaccaactaactgcattgaactctgcttcttatttgcaacaa

SEQ ID NO: 1818 - DNA, 1931 bp, Zea mays
  Clone ID: PAT_MRT4577_22832C.1
aagtcgcattccagatctcccctgcctccgctgtataaatagaccctcaagctccctgcaacatccaccggccgggatcaaggcccaagctcagcgaccaccaagcagagcaagccagtgaggtctctcagagcgtagccagccagctacaatggcggggaacgcgctagccaactatgtccaggtctacgtcatgctcccgctggatgtcatcactgtcgacaacacgttcgagaaggaggacgagacgagggcgcagctgaagaagctgacggaggcgggcgccgacggggtcatgatcgacgtctggtgggggctggtggaagggaaggagccgggagtctacgactggagcgcctacaggcaggtgttcaagctggtgcaggaggccgggctgaagctgcaggccatcatgtcgtgccaccagtgcggcggcaacgtcggcgacgtcgtcaacatcccgatcccgcagtgggtgcgggacgtcggcaaaagcaaccccgacatcttctacaccaaccggagtgggctgacgaacatcgagtatctcacgcttggagtggacgaccagcctctcttccatgggagaactgccattcagctgtatgctgattacatgaagagcttcagggagaacatggcagacttcttggatgctggtgtcgttgtggacattgaggtgggacttggccctgctggcgagatgaggtacccatcgtatccccagagtcagggatgggtgttcccaggcgttggagaattcatatgctatgataagtacctgcaagcagacttcaaagcagcagcagaagaggctgggcatcctgagtgggatttgcctgatgatgctgggacgtacaatgacactcctgagaagacccagttcttcgcggataacggaacataccagaccgacaaggggaagttcttcctcacatggtactcaaacaaactgatcaagcacggtgataagatcttggacgaagcaaacaaggtcttcctgggatgcaaggtgcagctggcaatcaaagtctctggcatacactggtggtacaacgttccaaaccatgcagctgagctcactgccggatactacaacttagatgacagagatggctacagaaccatagcacacatgctcacaaggcatcgtgctagcatgaacttcacttgtgctgagatgagggacagtgaacagagttcagaggcgaaaagtgcacctgaggaactggttcaacaggtgctgagtgctggatggagagagggcctaaatttggcatgtgaaaatgcactcaaccgatatgatgcaacagcttacaacaccatcctcaggaatgcaagacctcaaggcatcaacaagaatggccctccagaacacaagttgcacggattcacctacctccgagtatctgatgaactgttccaggaacagaactacaccactttcaaaacttttgtcaggagaatgcatgctaacctggattataatccaaatgtcgatccagttgcaccattggaaagatcaaaggcagagataccaattgaagaaatcctagaagtagcacagccaaaattggagccatttcccttcgacaaggacaccgacctaccagtttaaacactccaatgatgcaaactacaggaagaatcacgagacacttaaaaaatcaagacaaatagtaagcctattgtcgagcagtagtctattaactaaataaaatgctgtgtggagcatattataatcgcatattgccctaataatattgtgttgttaaacctgaggcttgatggttatctgatgagttgtaataatagccttggtcttcctgttgtatgtatgtatttgagctaaggaataaaaattgtggctttgtgggttaaaaaaaaaaaaaaataaaaaaaaaaaaagcggccgtcgcgtctagaactat

SEQ ID NO: 1819 - DNA, 747 bp, Zea mays
  UNSURE (1)..(747): unsure at all n locations
  Clone ID: PAT_MRT4577_23014C.1
  unsure (1)..(747): unsure at all n locations
ggccgggnaacgcacatattattgagaccaactagcaacatacaaagcacaatggcgtaccaacaatggcagctcaaatattacgcctacttatgctcctcgggctctctgcgagcgctgctacagcgaccattatgccacaatgctcgcacgctgctatagctctccttcttcccccgtacctctcaccaacggagcattcggtatgagaaaacccaatcattcaaccctacaggatccaacaggcaatcgcaggtgggatgttacctttatcacccttgctcctgcaacaatgatcaaccctatcacagcacataccttcggagcatccattggcacaaaacatcacggcacaacacctacaacaacgtgcgctagcaaaccttgctgcctactctcataatcagcagatccttccattcaaccaactacgctcattgaactctgcttattatttgccacaacaccacctaccattcagccagctatctgctggctacccccagtaatcacttccattcaaccaactgacagtattgaactctcctgcttattaacagcagcgacaactactaccattgaaccagcttgctggcgtgagccctgctaccttcttgacacaccacagttgctgacgtactaccagcacgctgtgcctaacgctggcaccatctgacaactgcaacacaagctgccgtgcaacccactggctttgacatacccaggagccttctaccaacaacccat

SEQ ID NO: 1820 - DNA, 1227 bp, Zea mays
  UNSURE (1)..(1227): unsure at all n locations
  Clone ID: PAT_MRT4577_23077C.1
  unsure (1)..(1227): unsure at all n locations
cccacgcgtccgcccacgcgtccgaggtaatctggctcgggcctggtcctcgatggctggcaggcacatgacacatcgccccagccccaagtccaaagccgcgagaggcaggggcgcagcaaaaccctagccgccttcccgtccttttcctttcataaaccccaagccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgtgaactactccgacagtgatgctgccaaggaagctatttctgcaatggatggcaaggaaattgatgggcggcaggtacgtgtcaacatggctaatgagagacctgctgggaaccgtggtggtggtggctatggtggcggcggctatggaggtggtggctacggaggtggtggcggctacggaggtggtggctatggtggtggcagccaaagctatgatgcttgaggggggcaggatcctattaagtgcattatcaaccaagatatttgaaataatgaactttaggacttggtatgacgttttatgttaagcattgtcaggttttgctattcgtgttatgctgaattgttggaactcctagatgcagaatcttacgtattggttttggttccttcgagaagtgcaaatgcaagacgcatctatggcaattaccggtgtggtacttgtgtggacctctcctaatagtgtggcacagagccagtnnctgatcatacagcctgaagaggggtcccgagtcggtcacatggtccggttctacctccaggtgattacctagatcatatgcatagaagggnntcaattagaccaagcagggtaaagtctgttggattgtcccctgagtgttgttatgcgtcaaatcttccaaccagtggtggtgtctgtaagcccttcgaaactgcanaaagggttgagaacaatagaagatccagtcgctcctgttaaggagatcctaagt

SEQ ID NO: 1821 - DNA, 2230 bp, Zea mays
  Clone ID: PAT_MRT4577_23359C.1
gccggccgggctggggaattcagatgtgcaaccaccggaaatccccatcaaaccccaagcgcgcacccatcttctggcctttccagccgccaagccttctagaagcttcaagagctcgattcgatcggaaccctcgccatggccgacgaggcgaaggcgaagggtaacgcggcgttctcggccggccgcttcgaggaggcggcgcggcacttcacggacgccatcgcgcttgccccagacaaccacgtcctctactccaaccggtcggcggcgctcgcctcgctccaccgctactccgatgctctcgccgacgcgcagaagaccgtcgagctcaagcccgactgggccaagggctactcccgcctcggcgcggcgcacctcggcctcggcgacgcggccagcgccgtcgccgcctacgagaagggcctcgagctcgaccccagcaacgagggcctcaaagcggggctccaggacgccaagaaagccgccgccgcccctccgcgccgcgggtcgtccggccccgacgccatcggccagatgttccagggccccgagctgtggagcaagatcgcgtccgacccctccacgcgcgcctaccttaacgagcccgattttatgcatatgatgcgcgaagtgcagaggaaccccagcagcatcagtatgtatctctccgatccccgcatgatgcaggtgctcagcctcatgcttaatgtcaagatccagagacccgaggcctccgagccgtcgcagtctaccccgccgccgccgaagcagcagcagcagcagcagacgccgccttctgagacgaaggctagggatgtggagcccgagcccgaggcagagccgatggatttgactgatgaggaaaaggaccgcaagcagacgaaagctgctgctcagaaagagaaggagttaggtaacgcagcttacaagaagaaggacttcgaggtggcaatccagcattacaccaaagccttggaacttgacgacgaggatatttcctatctgactaaccgagcagcagtctacattgagatgggaaagtacgatgaatgcatcaaggactgtgataaggctgtggagaggggaagagaacttcgtgctgatttcaagatgatttcaagggcactgacaagaaaaggaacagctctggtcaaacttgctaagacctctaaggattttgatattgctatcgagaccttccagaaggctctgactgagcatcggaacccagacactcttaaaaagttaaatgaggctgagaaagcaaagaaagagttagagcaacaagagtattatgatccaaaattggcagatgaggagagagagaaaggcaacgagttcttcaaggagcaaaaatacccagaagcaataaaacactacacggaggctctcaagagaaacccgaaggatcctagggtttatagcaatagggccgcctgctacaccaagttaggagccatgcctgaaggtcttaaagacgcagaaaagtgtcttgaacttgaccccaccttcaccaaagggtatacgaggaaaggtgcaattcagttcttcatgaaagaatatgacaaggccgtggaaacctaccaggctggcttgaagcatgacccgaacaaccaggaactgcttgatggtgttaagaggtgtgttgaacagatcaacaaggccaacagaggtgaaataagccaggacgaattgcaagaaagacagaacaaagctatgcaagacccagagatccagaacattcttaccgaccctatcatgcgacaggttctaatagatttccaggagaacccaagtgcggcccaggagcacctgaagaaccccggggttatgcagaagattcagaagcttgtaagtgctgggatagttcagatgagatgatcgagcgatgcgatgattggctttgttcgttcacgtgcaccctggtcatacatatgttttaacaagcagcagcggcataagaatgaacctgttcgggggctaatcttatcccatttggattgtaagtgcattgacattggataattcatgtttgtggcactgagtttcgagtatacgctactttctaatctttgagatgtgcgcacgctacatgaactatgcgtgcgctacgaactgatcaaaaaaaaaaaaaaaaaattctaatttgtggcacttaagccagttctgcggcagaatgcggccgggacttgtatcggttgaatgaagctctaaaaacaaagataac

SEQ ID NO: 1822 - DNA, 2815 bp, Zea mays
  UNSURE (1)..(2815): unsure at all n locations
  Clone ID: PAT_MRT4577_23360C.1
  unsure (1)..(2815): unsure at all n locations
gccggccgggtccaaaaatggtgatcggctattccgtggattacaccttcgagaactgggatgcaactatgcaagcacgcagctgggctcctctcggttttataaaaacctcaaagcttttcgccttaatccccatcaaacccccggacatttctggtcgcaccctcctccggccctcccagccgccaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcggcggcgctcgcctcactccaccgctactccgacgctctcgccgacgcgcagaagaccgtcgagctcaagcctgactgggccaagggctactcccgcctcggcgcggcgcacctcggcctcggcgacgcggccagcgccgtcgccgcctacgagaagggcctcgagctcgaccccagcaacgagggcctcaaagcggggctccaggacgccaagaaagccgccgccgcccctccgcgccgcgggtcgtccggccccgacgccatcggccagatgttccagggccccgagctgtggagcaagatcgcgtccgacccctccacgcgcgcctaccttaacgagcccgattttatgcatatgatgcgcgaagtgcagaggaaccccagcagcatcagtatgtatctctccgatccccgcatgatgcaggtgctcagcctcatgcttaatgtcaagatccagagacccgaggcctccgagccgtcgcagtctaccccgccgccgccgaagcagcagcagcagcagcagacgccgccttctgagacgaaggctagggatgtggagcccgagcccgaggcagagccgatggatttgactgatgaggaaaaggaccgcaagcagacgaaagctgctgctcagaaagagaaggagttaggtaacgcagcttacaagaagaaggacttcgaggtggcaatccagcattacaccaaagccttggaacttgacgacgaggatatttcctatctgactaaccgagcagcagtctacattgagatgggaaagtacgatgaatgcatcaaggactgtgataaggctgtggagaggggaagagaacttcgtgctgatttcaagatgatctcaagggcactgacaagaaaaggaacagctctggtcaagcttgctaagacctctaaggattttgatattgctatcgagaccttccagaaggctctgactgagcatcggaacccagacactcttaaaaagttaaatgaggctgagaaagcaaagaaagagttagagcaacaagagtattatgatccaaaattggcagatgaggagagagagaaaggcaacgagttcttcaaggagcaaaaatacccagaagcaataaaacactacacggaggctctcaagagaaacccgaaggatcctagggtttatagcaatagggccgcctgctacaccaagttaggagccatgcctgaaggtcttaaagacgcagaaaagtgtcttgaacttgaccccaccttcaccaaagggtatacgaggaaaggtgcaattcagttcttcatgaaagaatatgacaaggccatggaaacctatcaggctggcctgaagcatgacccgaaaaaccaggaactgcttgatggtgttaggaggtgcattgaacaaattaacaaggctaacagaggtgaaataagccaggacgaattgcaagaaagacagaacaaagctatgcaagacccagagatccagaacattcttaccgaccctatcatgagacaggtgctaaatgatttccaggagaacccaagggcggcccaggagcacctgaagaaccctggagttatgcaaaagattcagaagcttgtaagtgctgggatagtccaaatgagatgatcaggcacacgatgcgattgtacctgcttgttcgtcccttgtgcttggctttgttagttaacgtgccctttaacaagcagcgacggcaaaagaatgaggggctaatcttttttcccaattggattgtaagtgcagttaacattggattattcatgtttgtggcactgagtctgagtataggcgccgtcttgctttattgatgctggactttgcgtgcttgtgggtgggggttggttccctagctaaagtttagttcatgtcccattaaatatttgaatataatatatatttaattaggtttcataaaaaaaaaaaaaaaagtcccctaacaaagacaagaaaagctgcctcactgctcgtacccgttgatttaaggcttgaggacttggttaaagccaaccctcccctcagcaaactggtctacgtgctcctccagtcaaactggtaaaaactgttcctttggcggtaaaacctgntacttctccgtccgtcaatttttcaatccaaaggagtctaaattagatgtttcattaccactcgccattggatctgtctgcaatgtggaatgtaaaatgacaaaggcctctttagaatgtaggcattttcgaagaagcatacagaaatttcattggaatctagggtggtcgactgtcgagggagcgtcttattcctatgaaatttcttctttattttataatatttctactttctaaatagacccttggctattgaaagctcgattgaaggattattttctgaatcctgtttttttttctatgtttttgaactaattcatgtaaaatctatgtactatttttgtgaccccctgcgttcc

SEQ ID NO: 1823 - DNA, 804 bp, Zea mays
  Clone ID: PAT_MRT4577_23412C.1
gaagaagagaaacaacaagaagtagtaatggcttcctctatgttctcctccgccgctgtggttacctccccggctcaggccaccatggtcgctccattcaccggcttgaagtcatccgctgcattcccggtcacccgcaaggccaacaacgacattacttccatcacaagcaacgggggaagagttagctgcatgaaggtgtggccaccaattggaaagaagaagtttgagactctatcttaccttcctgaccttagtgattccgaattggctaaggaagttgactaccttctccgcaacaagtggattccttgtgttgaattcgagttggagcacggatttgtgtaccgtgagcacggtaactcacccggatactatgatggacggtactggacaatgtggaagcttccctttcggttgcaccgactccgctcaagtgttgaaggaagttgaagagtgcaagaaggagtaccccaatgccttcattaggatcatcggattcgacaacacccgtcaagtccagtgcatcagtttcgttgcctacaagccaccaagcttcaccggttaatttccctttgcttttgtgtaaacctcaaaactttatcccccatctttgattttatcccttgtttttctgctttttccttctttcttgggttttaatttccggacttaacgtttgttttccggtttgcgagacatattctatcggattctcaactgtctgatgaaataaatatgtaatgttctataagtctttcaatttgatatgcatatcaacaaaaaaaaaaaaaaaaagcggcc

SEQ ID NO: 1824 - DNA, 389 bp, Zea mays
  Clone ID: PAT_MRT4577_23507C.1
acaacgtggtgctggagatccaggccaccatggggggcactcccgtgatgccgtccaagaagcccatgtggaagggcgtcgtcgtcgcctacctcgttgtcgcgctctgctacttccccgtctcgttcgtcggctactgggccttcggcgacagcgtcgacggcgacatcctcgtcacccttaacagacccaggtggctcatcgccctcgccaacatgatggtcgtcatccatgtcattggcagctaccagatctatgcgatgcccgtgttcgacatgatagagacggtgctggtgaagaagctgcgcttccctacatgcctcacgctgcgtctcattgcccgtactgtctacgttgcgttcacgatgttcatagccatcacgttttcc

SEQ ID NO: 1825 - DNA, 785 bp, Zea mays
  UNSURE (1)..(785): unsure at all n locations
  Clone ID: PAT_MRT4577_23568C.1
  unsure (1)..(785): unsure at all n locations
attgttttctatatatcccttttcaccccctccttccctgtcgcctgccttccgttctagactccttctcccctccccaaacccagagcaagcaccatggctccgattggcatgggcagcaccctccccgacggccagctcgcgtggttcgacgagagcgaccagatgcagcaggtctccatccactccttggccgccggcaagaaggtcatcctcttcggcgtccctggcgccttcacccccacctgcagcaatcagcatgtaccaggcttcattactcaggccgaggagctcaaagccaagggtgtagatgagatcctgcttgtcagcgttaatgacccctttgtcatgaaagcatgggcgaagacatacccagataacaagcatgtgaagttccttgctgatggagcggctgcatacacaaaagcacttggtcttgagcttgatcttacggagaaaggattgggtcttcgttcgaggcggtttgctctccttgctgacgacctcaaggtcaccgtcgcaaacgtcgaggaaggtggccagttcacaatctctggtgccgaggagatcctcaaggcactgtaggggcttcagcgcttcggaatcgcagcgatcacccaaaccttgtgtcatatcgatgtagtttgaacttgtctgccaaactgctagtgggaataaattgtcgatgtgcatttcttcatgtactttatgtgcggtgcaagtgacttcagagttttccggtcaaattgntggttgtgttgcaaacatctgagattgntcaggtt

SEQ ID NO: 1826 - DNA, 402 bp, Zea mays
  Clone ID: PAT_MRT4577_23569C.1
aaaaaaactaaaaatgtccttttttatttttgggaagccacaaacattatccaaaaaacttcatttttgaactataacccataagcaatctaaaaagagggcccccccaatgatgggttgttggtaaaacctttttgggtttgtcaaaacaagttggttgaatggcaacaattgttgcagttgtaaaagggtgccaccgttaggcccaacgtgcaggtaaaaccgcaacaactgttgttgtgtcaaaaaggcaacagggctcacataaactaactggctaaatgggggtaactgttgcttttttaaataaacagcaaaattcaatgctcccagttggttgaatgaaaaaaaatgctgggggtaggcaacacctacctaactgaaagggaattgttgttgcaa

SEQ ID NO: 1827 - DNA, 305 bp, Zea mays
  Clone ID: PAT_MRT4577_23653C.1
cccacgcgtgcgtccagaccatcaaacaagtgccagcgcgctttggcagacgccgagagggagagcaccttcatcatgatcaagcctgacgagatccagaggcgcctcattggtgagatcatcagccgttgtgagaagaaggtcttgtacctaaaggactcgaaccttgctaacgtggagaggtcgttcgctgagaagcactactccgatctcgagtgcaagcccttcttccagggggtggtggactacatcatctctgaccctgtggaggtcatggtctgtgagggtaagagcaggatcacaac

SEQ ID NO: 1828 - DNA, 320 bp, Zea mays
  Clone ID: PAT_MRT4577_2365C.1
cccacgcgtccgaaaaaaaatataaaaaaaaaaaaaaaaaaaaaaaaaaaaaaaaaaaggaaaaaaaaaaaaaaaaataaaaaaaaaaaaaaaaaaaaaaaaaaaaaaaaaaaaaaaaaaaaaaaaggggggggccgttttagaggatcaaagtttacttccgcgtgtttgcaaagtattaattttttttttgggtcaataaaattaaattaattggccgatgttttaaaacttgggaattgaaaaaaccctgcttttaccaaattaaatggctttgaaacaaatccccttttgaccagttggctaaatagcaaaaaggc

SEQ ID NO: 1829 - DNA, 290 bp, Zea mays
  Clone ID: PAT_MRT4577_23760C.1
gagctgagctgccggaggcagaataggagaggcaggctatgaccatggcgacgaaggcggcgtgcgtgctggcggtgtgggtgctcatatcatccggcctgtccgacctgagctcagcgcgcgcgcccatgggcagtaagccttagtgggagttggactacttgctgctctcacttcagtggcgcggcatcatatgagcatccacacggcactgatgcacgaccaacggctgctgacggtcggagcctgtctatacgattacgattcacggactatagctggactaccac

SEQ ID NO: 1830 - DNA, 353 bp, Zea mays
  Clone ID: PAT_MRT4577_23824C.1
ctgcagcaccaacaaccaggattgtgttcttacgattaactgagaacaaatcctgtccggattaacatcatccatcaatccacagtccatgctggttgacagcaatggcctgctggagccgaagatgaacaccacactaacaactgacacatagcgaccttcccatcaaaaacacacatgggccacaacaaacgagacgaacgaagataaaccctttggactagggtaaacatcacggtagcgaacaggataacttggccgcgcgggccccaccgttcagttcctccagttcccgtcggaagttccgtagccgccgccacagttgccaccgacgttatcggcaccaccaccac

SEQ ID NO: 1831 - DNA, 2185 bp, Zea mays
  UNSURE (1)..(2185): unsure at all n locations
  Clone ID: PAT_MRT4577_2386C.1
  unsure (1)..(2185): unsure at all n locations
cctcgaggccggccggggcttgcggcctttttaaccgctttttaaagctcccccgcctctcccacggcccggacttcgccttcgccctcccccgcctgcgagcgcgaggcgcggaggggctagcgcgctagcggcgccatggccctgaccgacgccaccgcgttcccctacggcctgcgggtcctcgtcgtcgacgacgaccccacctggctcaagatcctcgagaagatgctccgcaagtgttcatacgaagtcaccacatgcggtttagccagtgttgctatccaaattctccgggagaggagaaacaagtttgacattgtaatcagtgatgtcaacatgcctgacatggatggtttcaagcttctcgaactcattgggcttgagatggatctacctgttataatgatgtccatagacggagagacaagtagggtgatgaaaggtgtccagcatggtgcatgtgactacctcctcaagcctgttcggatgaaggaactccgaaacatttggcaacatgtgtataggaaaaaaatgcatgaggtgaaagagattgaaggtaatgacagctatgatgatctccaaatgtttagaaatggtgtagagggattcgacgagagggacctatttatgagagctgactctgatactatgaggaagagaaaagacgtgaataaggaccatgcagatcaggactcaagtgatggagctactgttaagaaggctagagttgtctggtctgttgaccttcaccagaaatttgtaaatgctgtcaaccaaattggatttgacaaagtcgggccgaagaaaatactggatcttatgaatgttcctggcctgacaagagagaatgtggccagtcatcttcagaaataccgcctctacttgagtaggttgcaaaagcagaacgaggaaaggataatgggtgctgctaggcaagatttcaatcaaaagggaccatcggatcatcttaacctccgaagttccttccaagagcaaccaggcaacctttccaatggatgtcagcatagttctcagaaggtcgaagctcagaccaacattctcgatcctcatctggacgacacgaagacttcaatgcccttgaaggtgccagataaaaatggaatttcagcaagtgatgctgttgaccctcacaatatcaccactgcttcacctttaagtggggtgttctcttttgaaagaatgccagtgaatcaggacaggaagctatcagaaaccatgatcttggaatgtgagtcctggagtggaagtgtgccaccaaagcagttcatgcagtatccaaagcataaccatgagcgctgcgaccttctaggagactattcttgcttgcctaaaccggacttggagcacccaattgcccctggtcatctgtatgccccaccgccagtaatttcgatgagttacaatgtggagaaagatgtcagagacttctcagatgtaaaaccagatcttcttggctgtatgaagtccttatcaccagcactgacatgtacagttgagtcggtttctgctcaacttagtgacagtgttgtgacctcaactaacactgacgtccggttttccagcgtggaggggttgtccagcattaaagattgtgactttgatcaggaaaggaacggagctattttgtttacttcagaagaggcaagtatattatgcggcactgattttacttgtctacctgaagacctgtccggctatcaacttcaaggtgtctccttcgggaataaaggattgaacagcatcgatttatatcagtgcaatgatacaatgttaatacctggactgcagaataattggtatgatgatgatgtagagtttagcagtgaaaccgtggagttcccattgctagacggaggcctgtttgcataaatgcctcatctggccctatctttcaaccatgcccttatgtcagcagggatgatgttcattggtatgttcccctatagcgcctcctgtagggctatatttaacctaacttgatcctgtggtggaaggatttaatttgtagtctcgccacttttgataattgtctgtattatagactgtgccatggcacaatgactgcaatatatactcttcacggtgatcaaaattacatatgaagactgtcaaaaaannnaaaaaaaaaaaaaanaaaaaaanaaaannnaaaaaanagggg

SEQ ID NO: 1832 - DNA, 185 bp, Zea mays
  Clone ID: PAT_MRT4577_24024C.1
tcgtctcacgcgtgcgactacttgcgccaactggcaaggacgatcgccgagtacaaccaggcctgcactgacccgttcatgaacctcaagggaatccttgtgggcaaacgggcgaccgacatctactacgacaacatggtgacggtcacctactggaggacgcacaccatgatctccgaccgcac

SEQ ID NO: 1833 - DNA, 2234 bp, Zea mays
  Clone ID: PAT_MRT4577_24055C.1
ttaagataaagtcgaagaccatagatgttatgccaaccaaggcaactctcaggtcagacaaccaggagatgtcgaaggaagagctcaggagacagcaccaggctgaacttgctcgccagaagaatgaagagactgctagaaggcttgctggggttggtactggatctggtgacggacgtggtcctgcgagggcttcaaatgagcttgttgcatataagaatgttaatgatgtaccatttgtaagagatttggtgatccaagtagatcagaagaatgaagctgtcctcttacctatttatggtagtatggttcctttccatgtttctactgtcaagagtgtgacaagtcaccaggacaaccgcacctgcactatccgtatcttcttcaatgtgcctggcatgccattctcaaatgatagcaagtttaattctcaaggtgctatctatctgaaagaaattacattccgctcaaaagatccacggcatagcagtgaagttgttcagcagatcaaaacattgaggaggcaagtggcatcaagggagtcagagagagctgaaagggcaactcttgttacccaggagaaacttcagattggaagcaacagaatgaagatgatgaggctttctgatgtgtggatacgacctgcatttggtggtcgtgggaggaagctcacaggaaatcttgaggctcatttcaatggtttcagatattctacttcaaggtctgatgagcgtgtggacatcatgtttggaaatataaagcatgcctttttccagcctgcagagaaagaaatgattactctccttcacttccatttgcacaaccatatcatggttggaaacaagaagacaaaggatgttcagttctatgttgaagttatggatgttgtacagacgcttgggggcagtagaagatcggcacttgatcctgatgagattgaagaagagcagcgtgagagggataggaagaacagaataaacatggatttccagaactttgtgaacaaggttaacgaccactggtcgcaaccacagttcaaggggcttgacctggagtttgatgtcccccttagagagcttgggttccatggtgtcccatataaagcttctgctttcattattccaacttctacatgtttggttgagctgattgagacccccttccttgtggtgagcctgagcgagatagagattgttaacctggagagggtgggctttgggacaaagaacttcgacatggctatcgtgttcaaggatttcaagaaagacgttctccgcattgactccatcccttcagcatcgcttgacgcgataaaggaatggctggacacaactgacctcaagtactatgagagcaggctgaatctgaactggcgccctatcctgaaaactataatcgatgatcctcagaagttcattgacgatggcggctgggagttcctgaacatggaggcgagtgactcagagactgaggacacagaggaatcagaccaaggctatgtgccttcagacgctgagcccgaatccgagtcagaagatgatgactctgacagtgagtccttggtggaatctgatgatgacgatgaggagtcagacgaggactcagaggaggagaagggcaagacctgggaggagctggagcgtgaggcaagcaacgcggaccgtgagcacggtgcggagtcggacagcgaggaggagaggaggcgccgcaaggcaaagaccttcggcaagtcgcgtgcgccggagcgcagcagcttcaagggagcgccgccctccaagaagccaaagttcaggtgaatgctgccttcggcaattcgctcgtgccaaagtgcagcagcttcaagggagcaccacctccaagaaggcagctctggttaatgggactccttgaagctttggcccccggagtagacgtgtctgtaggagtgtggtttgttatatctagattatctgcagtagcttagtccatctaaatgaaatgtgacagctgaactttggaagtcgcatcattggggaaacgaaatttaagtcgattgatttgttaatgccctcgttgatgtaatatttcccttgttcggtggatttccggtctgtataatatttatgcacgcttgcactttatccatggtatttgtatacccgtataaggcagcatggaggatgtttcttgcatgtggacgcattgattgatatatatatatatttaaggttcttttttttttaaaaaaatccgta

SEQ ID NO: 1834 - DNA, 455 bp, Zea mays
  Clone ID: PAT_MRT4577_24378C.1
aagggaacaagccgaggtcctttcatagaaaaaaccgaccatggaccaaaacagttttacccaaaaaattctaaagcaaaggggctcccaaaatacttacaaccattacgaggacatttaaaagcaaagcattgcaagggagtaaatatgacgaaacctaggcataaaagatcaaagggcttagcacctccttactcaaaggcccaatgggtctccctggggatctccttttcctcctaaggggggaagccattcttgatgttaaaaggcttgcggatctcctctggggttttgcccttgatcatgtcaacaacagtctggcaggaaaggtccaacaaacccttgatgttgaaatagtttgaaaccaaaatgaggtcaaaaagcggggcctggtccaccttgacaaagtcagcatcccaattcttgagggcctcaccgaaggcgggggttctttt

SEQ ID NO: 1835 - DNA, 308 bp, Zea mays
  Clone ID: PAT_MRT4577_24381C.1
tcttcagatttagggtctcaaatcatcatggctcaacttctacaacaacttgttctatcaaacctggcttggatctctcatcaacagcgggtggttccattcaacctactaggttcattgaactctgcttcttatttgcaacaacaacaactaccattcacccagctacctgctgcctaccctcagcaatttcttccattcaaccaactatcagcattgaactctcctgcttatctacagcagcaacaactactaccattcagccatcttgctggtgtaaacccttctaccttctttacacaaccaca

SEQ ID NO: 1836 - DNA, 408 bp, Zea mays
  Clone ID: PAT_MRT4577_24661C.1
cggcagccgccctttcttttttttttttttttcttatacataattttctctttttggcaacaccaaaaaccgccattttttccttaaaaataaccgaaaacaaaccctgacgggggtaacagcatccatccaaccgcagaccatgctgtttgatgcaagggtctgctgaaacccaggatgaacacaacactaacaactgacacaaaacgaccttgcaatcaaaaacacaaatgggcaacaacaaacaccacacgaaccaagataaaccccctggactagggaaaacaacacggtagcgaacaagaaaacttggccgcccgggccccacccgtcaattactccacttcccgacggaaatgccgcaacccccgccacggttgccacccccgtaaccccccccaccaccac

SEQ ID NO: 1837 - DNA, 415 bp, Zea mays
  Clone ID: PAT_MRT4577_24765C.1
gcaacatagaaagcacaatagggcaccaacaatggcagccaaaatatcgcgcctccaaatgctccttggcctttctgcaagtgctgctacggcgaccatttctccgcaatgctcgcaagctcctatagcttgccttctttccccgaacctgttaacagcggtgtattgcgtatgtgaaaacgcaattcttcaaccctacaggatccaacaggcaacagcaacttgcataagacctctatcaccatcgttccttcaacaataatcagccatattacaacagtgaccaattgtgcattcattggttgaaaacatcaaggaacaacaactacaaaaactagtgctagcacaccttgctaccaactctgagccacataagcatcgtgaacccaaccaactacgtgcattaaactctgct

SEQ ID NO: 1838 - DNA, 2277 bp, Zea mays
  UNSURE (1)..(2277): unsure at all n locations
  Clone ID: PAT_MRT4577_24964C.1
  unsure (1)..(2277): unsure at all n locations
tcgaggccggncgcgaccggcccgggccggccaccttctgccggtccggatcaccactgagtcacgactccagatctcgcaccgctcgccatggacctcctcgacgcgaggcaccgccacacgccggatttgagctcctcccaagatgccgcctccaacatggggctcccgctcgccggtgccgcctaccagccctacgtttctgagcttctttccttctccatcgagcgcctccacaaggagccggagcttttgagggtcgacgcggagcgggtgcggcgtcagatgcaggaggtggcggtggaaaactacgctgcgttcatcgccgcctccgaggcgctctccttcgtccgcgcgcagcttgagagcttcgacggccacctcgaggccatgatagaggagataccaaacttaacatctggctgcactgagtttgttgaatccgcacaacaaattttggaggagaggaagcttaatcaaacattactagccaaccacactacattgcttgacttgcttgaaattccacaattgatggacacgtgtatacggaatgggaactatgatgaagcacttgacctagaagcttttgtgagcaaaatctggaagttgcaccctgatttacctgttgtccaaggattagccactgaagtcaagaagacagtgcaatcattagtttcacagcttctccagaaacttcgatcaaatattcagttacctgagtgcctacgaattgtagcacatctgcgccgaattggagttttcagcgagtcagaattgcgcttacagttcctgaggtgcagggaagcttggctttctggaattcttgaagatctggaccaaaggaatgtttatgattacctgaaaggcatggtgacttgccacagggtacatctatttgatgttgttaatcaatatcgagcaatattcaacaatgataaatctggaaatgatgagaactatgacggcgggctgcttttcagctgggcaatgcaacaagttagtaatcacctcactactcttcaagttatgttaccaaacataacagaaggtggttctctgtccaacattcttgaacaatgcatgtattgtgcaatgggtcttggcttagtcggattggattttcgtggccttcttccaccgatctttgagaatgcggttctaaatttattctcaaagaatatgagtacggcggtcgaaaattttcaggtcattttggattcacactgttgggttccgatgccatctgttggttttgtagcaaatggtgttgtcgatgagacttctgatgatgtgactccaccttccgttttaatggagcatccacctcttgcagtgtttgtcaacggtgtttcagcagcaatgaatgagctaagaccgtgcgcaccattgagcttgaaagttgtccttgctcaggaggtggtcaagggactacatgcagtctctgactccctagtaagatacaaagctatgcggatgcttcgtggaaatgagtccgcccttttcctttcactatgccagacattcatcgaggttgcatatccttattgtgccgcatgttttggccgatgctacccggacggggcaacattgatctcagagtgtcaaggcacatttgacgctgtccgtcagttattgaccgtgccggcaagatctaacagttccagcatcgaaagaaggcagtcaggaggcatcgaacgaaggcagtcaggagccattgaaagaaagcagtctgttgagagcactgggacagcggtcactgataacgggctctcagccgatggacctgggctagagacgaacagttctgctgcaaccaccacctcaccggtagacgacggtgggagtacccatccaccagcgagtaagtagcttggacatccgtttgaatcgtcaaagtccttcatcaaggcctggtttagtcaaccagagaaaaaaatgctgcaaagttatattaatagagaattatttatagttttgttctcagtcttacagtgtacacaagatctcactggatatctgtatctcacttttttttgactcgaacaattaaacttttagctgttcattgctatagtcgatacctagagtttctaacctgaacattcaataatctgattagtagtaaaaaaaaaaaaaaaaaaggcccctagggccgtgttcatgttgactacacttttgaagtcaaagaactgattcatgagtcatatatgtaatcgacattactggacatatatttctgtctgaatctatccggctctagattaaattgagcag

SEQ ID NO: 1839 - DNA, 554 bp, Zea mays
  UNSURE (1)..(554): unsure at all n locations
  Clone ID: PAT_MRT4577_24965C.1
  unsure (1)..(554): unsure at all n locations
cagctagaagtttaattgttcgagtgatnnnnnngtgagatacaggtatccagtggtacactgtaagactgagaacaaaactatgaattattatcgatgaatataatgtttgcagcaatttcttctctggttgactaaaccaggccttgataaagagctttaacaaattcaaacggaggtccaagctacttacttcctggtggatgggtactcacgtcgtcctctaccggtggggtggtggttgtagcagcatcgttgatctctagcccaggtccatcggctgacagctcgttatccgtgactgctgtcccagagctctcaacagattgctttctttcaatggctcctgactgctttctttcgatactggaactgttagatcttgccggtatggtcaatagctgacggacagcgtccagtgtgccttgacactctgagatcaatgttgccccattcgagtagcatcgaccaaaacatgcggcacaataaggatgtacaacctcgataaatgcctggcagagtgacaggaaaagagcggactcatttccacgaag

SEQ ID NO: 1840 - DNA, 836 bp, Zea mays
  Clone ID: PAT_MRT4577_24969C.1
aactgctaaaaccacccaccttctcagtgactcacgaactcacgactccagatctcccaccgctcgccatggacctcgacgcgaggcaccgccacacgccggattcgagctcctccccacatgccgcctctgacatgggtctcccgctcgccggggctgcctaccagccctacgtctctgagctcctctccttctccatcgagcgcctccacaaggagccggagcttctgagggtcgacgcggagcgagtgcggcggcagatgcaggaggtggcggtggagaactacggcgccttcatcgccgcctccgaggcgctctccttcgtccgcgcgcagctcgagagcttcgatggccacctcgaggccatgatagaggagataccaaacttaacatctggctgcactgagtttgttgagtctgcacaacaaattctggaggagaggaagcttaaccaaacattactagccaaccacactacattgcttgacttgcttgaaatcccaccattgatggacacgtgtatacggaatgggaactatgatgaagcacttgatctagaagcttttgtgagcaaaatatcgaagctgcacccagatttacctgttgtccaaggattagctgctgaagtcaagaagacagtacaatcattaatttcccagcttctccagaaactccgatcaaatattcagttacctgagtgcctccgtattgtagcacatctgcgtcgaattggagttttcagtgagtcagaattgcgcttacagttcctgaggtgcagggaaagctggctttctggaatccttgaagatctggacaaaggaatgtttttgattacc

SEQ ID NO: 1841 - DNA, 833 bp, Zea mays
  Clone ID: PAT_MRT4577_25003C.1
aaagacggagagaacagaacaggaaacagcccgcaggcgcagctctccacctccctcctctctctctccgatccacccgctcccctcccctctccgatagctgctcgccgcgctcaatcatggcggccgacccctccgcggctgcggcgcccgccgaccccgatggcccggacgcggttcgcttcacatggaacgcctggccccggtccaaggttgaagccagccgctgcgtcgtcccgctcgccgccgccatctccccggtccgctcccccgagtccctcgcgtcgccgccccttccctacccgccactccgctgcaagccgccttgctctgcgctcctcaaccccttcgcccgtgtcgacttcaccgccaagatctggatctgcccgctctgcttctcgcgcaaccacttccccccgcactacgccggcatctccgagaacaacgtgcccgccgagctcttcacacaatgctccaccgtcgagtacctcgtcgccggacccccgggatctcctgcaccgctgccgccagtgttcctgttcgtcatcgacacctgcgtcatcgaggaagaactggagtacgtcaagctgtccatgcggaaggcggtcgcgcttctgccggagcacgcacttgttggcctggtgaccttcgggacgcaggtgcatctgcacgagcttgggttctccgagctcagcaagatctacgtgttcccggggagcaaggagatctccaaagagcagattttggatcagcttgggttatcaggcggggggcggccagggttcccaaagatgacacagcagccaggcgtgcaacaggtcaatgggatgcat

SEQ ID NO: 1842 - DNA, 1362 bp, Zea mays
  UNSURE (1)..(1362): unsure at all n locations
  Clone ID: PAT_MRT4577_25022C.1
  unsure (1)..(1362): unsure at all n locations
ttgggtacctcgaggccggccggggaaaaaatacaaaaagggggaaaaaaaaaaaaaaaatataaaaaaaaaaaaaaaaaaaaaaaaaaaaaaaaaaaaaaaaaaaaaaaaaaaaaaaaaaaaaaagggcctcggcctggggtttctctctttttcctccccatgtcattgggaccctcgagggcggccgggacgaggcgctgcggcacggaaccagcgccattagaggccacaagcccacgccacgcctccctcgttctcgcgcgcgcgcacgcatgcacgagggggcctgtcgatttgattgaacttttcaaattcagattcagaagctggccaagatgactgccggtttccagctcggcgtgatcgggtctctcacgctctccgtcgcgtcgtcggttgccattgtcatctgcaacaaagccctcatcagcaccctaggctttccattcgctacgactctgacaagctggcacctgatggtgaccttctgcaccctccacgtggcgcagcgcctgcgctttttcgagcccaaggcgatcgacgggcagacggtagttctgtttggcttgctcaacgggacctcgattggccttctgaaccttagtttagggttcaactccatcggattctaccagatgacgaagttggccataatacccttcacggtgctgttggagactatattcctgaagaaaagattcagtgagacgatcaagttttctctgctggtcttgctgctcggagttggcatcgcctcagttaccgacctcaagctaaactgcctcgggtccgttctttccggactcgccatcgccaccacttgtgtcggccaaattctcacgaatacgatacagaggaagctgaaggtctcgtcaacgcagctcctgtaccagtcagcgccttaccaagcagccattctgttcgccactggccccttcgtggaccatctcctcaccggccgcagcgtcttcgcccacagatacactttcccggttgtgggcttcatcgtcctgtcgtgcttgatcgctcgaacatatgcccatatgtattatgggaggaaaggagattngccacaaggaactacatgacccaaaacctttgaagcccttcaatgtctgatagcggngcaatcaatgacccaatgatgcaaacccccctctgtaactaatgctcctgcttagaaaggaggcaagaactttatgattgatttcatgatgggcagtgtttaagctttttgttcaaaaactgctgctgcttccatcgagcgtttgattctcgcttattctcaaccaactatggaatgatttagttcggtctggctatcccagccgtccaagggtattagttggcttgtttaaa

SEQ ID NO: 1843 - DNA, 1469 bp, Zea mays
  Clone ID: PAT_MRT4577_25025C.1
cctcgaggccggccgggacatgcggtacttcccggccccgccgggggccccaccccacgaggcgctcgctgcggcacggaaccagcgccattagaggccacaagcccgcaccacgcctccctcgttctcgcgcgcgcgcacgcatgcacgaggagctgctgcagagaagaggaggcctgtcgatttgattgaactttccaaattcagattcagaagctggccaagatgactgccggtttccagctcggcgtgatcgggtctctcacgctctccgtcgcgtcgtcggttgccattgtcatctgcaacaaagccctcatcagcaccctaggctttccattcgctacgactctgacaagctggcacctgatggtgaccttctgcaccctccacgtggcgcagcgcctgcgctttttcgagcccaaggcgatcgacgggcagacggtagttctgtttggcttgctcaacgggacctcgattggccttctgaaccttagtttagggttcaactccatcggattctaccagatgacgaagttggccataatacccttcacggtgctgttggagactatattcctgaagaaaagattcagtgagacgatcaagttttctctgctggtcttgctgctcggagttggcatcgcctcagttacggacctcaagttaaactgcctcgggtccgttctttccggcctcgccatcgccaccacttgtgtcggccaaattctcacgaatacgatacagaggaagctgaaggtctcgtcaacgcagctcctgtaccagtcagcgccttaccaagcagccattctgttcgccactggccccttcgtggaccatctcctcaccggccgcagcgtcttcgcccatagatacactttcccggttgtgggcttcatcgtcctgtcgtgcttgatcgcggtgtcggtgaacttcagcacgttcctggtgatcgggacgacgtcgccggtgacgtaccaggtgctgggccacctcaagacgtgcctggtgctgtcgttcgggtacacgctgctgcacgatcctttcaccgtgcggaacatcctgggcatcctcgtcgccatcttcgggatggcgctctactccatcttctcggtgcgtgagggcaagaagaagtccgcaggcgacgccctcccggtgtcacagatgcctgacaaggagacggagccgctgttggcgaccaaggacaacagcgacaccaaaaaggcgaacggggttgctcacgactgctaagatgttcccgtttgccgttgcttatagcctaattagtccagctctagtgttactacgacgcactgttctgaatctcagaaagtcagggaagaagtcattcctttttgtttcttataatattgtatatgtaatattcctctattgcgaattataagccgtttcaatttttttgaagagcaaaaaaaaaaaaaaaaaagcggccaaaaaaaaaaaaagcccct

SEQ ID NO: 1844 - DNA, 357 bp, Zea mays
  Clone ID: PAT_MRT4577_2505C.1
atattatcgagaccaactagcaacatagaatgtacattagtgtaccaacaatggcagccaaaatgttctggctacttatgctccttgggctttctgcaagtgctgctacagcgaccattttcccgcaatgctcacaagctcccatagctatccttttttccccgtacctctaaccagcggtgtctctccgcatgtgaaaacccaattctctaaccctacaggatccaacaggctatcacagctggcatcttacctttataaccctctggtcttccacatatcattatccctattacatcaggtacccttggggcatttattgacacacaacattagggcacaacaaactcaacaacc

SEQ ID NO: 1845 - DNA, 280 bp, Zea mays
  Clone ID: PAT_MRT4577_25172C.1
ctcacgcgtaactccacgcgtcgggtttgccagtgaataaaaccctcaaggtgaagggttatatgggagacttgtgtcgcatggacttcagtaaaactgatttctatgcctttgctcctccagatttctatactaggtttgggatcgtaggtgtgaaggccgacagtgtgatgaataagacaaagtctgattgaggaccatcaggctgcctatgttggatgaggagttcacgttccttttgtctgttccagagctgtccttcctgtgggtagaggtccag

SEQ ID NO: 1846 - DNA, 213 bp, Zea mays
  UNSURE (1)..(213): unsure at all n locations
  Clone ID: PAT_MRT4577_25345C.1
  unsure (1)..(213): unsure at all n locations
nctcgcgatggcgcgcatgcggtgccgtcaccggagcgcggcgagatggacgaggtggtatacgcggacccggatacggaagcggaagatcaggatgagaggtgggcgaggctgctgccggagctgctctgcgacgtggtgcggcgcgtctaggcgtccggcggcgagcggtggccggcgcggaaagacgtagactcctgcgcctgcctgtgc

SEQ ID NO: 1847 - DNA, 277 bp, Zea mays
  Clone ID: PAT_MRT4577_25349C.1
gccacatcgagagcaacgctcgagcacacatgcacgaagactctgtcttaggagcaactacaaaccaccgagccgcgcaagcatcatggagtaccggtcagcaggcgcagcgccgccacggcgccaggctccatgtcgaccagtgccggcaacccactccgcggcctcgagcacggccccggcggcatgaggcaccggcacgcgaactcaccggctgcatgggccctcttgatgagcacggcggcgctggcatggcaggcccgcagttccagcctgc

SEQ ID NO: 1848 - DNA, 921 bp, Zea mays
  Clone ID: PAT_MRT4577_25500C.1
ccggggagtatagcgtctgcttcgcaccaaccgaatagtcacagaaaattccgtttgcccaaacctagagctacctccgccgccgccgccggcaatcaagacagctgatggatcctatgcagtcatcggtgagaggccgcaggtcttcgttgcatgctgatgctgtcataactattggaggagtccgacctgcaccacccccacaaacatccacacaacatgtatgtcaagatgaggcaatggtcagcagcggggatccctcttggatgtctggttacagcactgattcctgccggggtggttattacacttctgcactcaacctggagggtgcatcaattagagaactgaagctgaaatatcagaagctgaaatatcggaataaacctaacaattgtaatgcggacgatcatgtcaatgctgaaagatcacccggaagaaaagctgaggagaaaaaagtgctggcgagaaagcatgaagattgtgatgatgaccctttcattgaagaagttaaaaagacgagagaagcacatcaagaaatagagagagatcgaaaggcccgtgatgataagttctatgagctagagaagattaagcttgacttgaagcgagaccgactggatacaatgataatgcaaactgacacgagtgcaatggacagtgaagcaaaacaatactttaagctgatgaaagaagagattttggctcgtcgattcaagagtaggaaagcataggtgtttccatttaatggattttagactgaagttgtttttcgttctttttaatggagttagtatttggtttgtatcttcaataatgctataatacttgtggatgctctgcattagggccagaaaaaaagctcgagctggctcgggctcgtagcagttcggctcgaaaaaaaaaaaaaaaaaagcggcc

SEQ ID NO: 1849 - DNA, 2047 bp, Zea mays
  Clone ID: PAT_MRT4577_25719C.1
cctcgaggccggccgggaaacaaaaaaaaaccacgcgtatgcgcccgcttgcgcgaaggcaaagcgtccaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactgcccctgttcgctcgtccatctgctacatcgatggagatgagggaatccttcgctataggggttatccaatcgaagaattggctgaaagcagctcgtttgttgaggtggcctaccttttaatgtatgggaacttgcctactcagagtcaattggcaggctgggaatttgctatttctcagcattctgctgttccccaaggactgttggatatcatacaatcaatgccccatgatgctcaccccatgggtgttcttgccagtgcaatgagcaccctttctgtctttcatccagatgcaaaccctgctctacaaggtcaagatctttataaatcgaagcaggtgagggataaacaaattgtgcgagtacttgggaaggcaccaacaatagcagctgctgcctacttgagattagcaggaagacctcccgtccttcctttaaatactctatcttattcagagaacttcttgtacatgctggactctttgggtgacagaacatataaaccaaatcctcgacttgctcgagctctagatattctttttattctgcatgctgaacatgaaatgaactgctccactgctgctgttaggcaccttgcttcaagtggtgtggatgtatttactgctctttctggtggtgttggagctctatatggtcctctgcatggcggcgcaaacgaggcagtacttaaaatgttaaatgagattggaagcatggaaaatattccagatttcattgtaggagtgaagaacaggaagaggaagatgtccggttttgggcaccgtgtgtataaaaactatgaccctcgtgctaaagtcataaggaaattggcagatgaggtgttctcaattgttggacgggatccacttattgaggtggccattgccctagaaaaggcagcgctgtcagacgaatattttatcaagaggaagctgtatccaaatgtggatttctactctgggctaatttatagggcaatgggattccctacagaattttttcctgtgctgtttgctattcctcgcatgggtggctggctagcgcattggaaagagtcactcgatgatcctgacactaagattataaggccccaacaggtatacaccggcttctggcttaggcactatacccccgtcagagaacgagtgctatcaagccagagtgaggaacttggtcaggttgccacctcaaacgcaactaggcgccgccgtgctggttctgccctgtagaagctgcagcgtataaacgcaccggcatactcaataaacatcgaccacttttgtgcttgaaaaggccacaaatgctttttagcttggttggagttgtaggccttttgttgtcgagtatataggcaataatgcagtgagaacaccacaccgttacaatgtaaaactgtcacgaggcatcacttgctggtgtacaccccttgcgttctctatgacttaatcacttaacttcccaaaagatgaattaagaggtacgatcgagtacccgtgttcttgcgttgacaccatgtgctcattttggtgaaattttgttgttcatttgcatggagattagtggaaacaaagatcgctgttggcgtaaaaaaaaaaaaaaaaaaa

SEQ ID NO: 1850 - DNA, 639 bp, Zea mays
  UNSURE (1)..(639): unsure at all n locations
  Clone ID: PAT_MRT4577_25837C.1
  unsure (1)..(639): unsure at all n locations
aatttgttctcgaggtgaggaatgtgataggagatagagggctagaggttgtcggcgatacatgcaagaagctacgaagacttcgaattgagcgaggggatgatgatccaggtctacaagaagagcaaggaggagtttctcagttaggcctgacagcggtagctgttggttgccgtgacctggagtacatagctgcctatgtatctgatatcaccaacggtgctctcgaatccatcgggaccttctgcaaaaatctctacgacttccggcttgtcctgctcgacagacaaaagcaggtaaccgatctgccgctcgacaacggtgtccgtgctctgttaaggagctgcaccaagctccggagatttgctctctacctgagacctggagggctctcagacacaggcctcgactacatcgggcagtacagcggcaacatccagtacatgctactgggcaacgttggtgaatccgaccacggattgatccgctttgcaatcgggtgcaccaacctgcggaagcttgagcttcggagctgctgcttcagcgagcaagcccgntccctcgcggtgctccacatgccgtcgctcaggtacatatgggtgcaaggctacaaagcctctccagcaggcctcgagctcc

SEQ ID NO: 1851 - DNA, 165 bp, Zea mays
  Clone ID: PAT_MRT4577_25961C.1
gcgggacaatcatacaacatgaactctcttgagtcacgagtttggtggaggtttggatatgccctctaacccattaaaagaactgcaccaacccccacctggacctttgtacggggggctaggggggaaaccgaaaaaagccgaggttggtcacatgtttctcag

SEQ ID NO: 1852 - DNA, 291 bp, Zea mays
  Clone ID: PAT_MRT4577_25984C.1
cgtatgaaaggtccgtaatcgcggagttcggctcaagctagcctcatagaacgcacgatagtgtaccaactatggcagctaaaatatgttggctccttgtgctccttggtctttctgtaagtgctgctacggcgacgcattttcccagaatgctcacaagctcctatagcttcgcatcttcgcccgtagctctcaacaacggtgtcttcggtatgtgagaacccagatctccaaggctacaggatccaacaggcaatcgagtctggcatgttacctttatcagccttgttc

SEQ ID NO: 1853 - DNA, 296 bp, Zea mays
  Clone ID: PAT_MRT4577_26014C.1
ggtcacaatctggatcagcttgctccagggagaaggagaaaaagggggcggtctctgaaaccctggcggacgggacgggaagatacccaaacagacagggggggaacccacaacgcgatatcacattgctgggcggggatctcgatccccacactaccaaagatctaaaaaaaattctcagctagctagcttgcgttgattgggcctgtgcggggctgagggagccgctagcctgacctgaccgccactgccgccttggctttgcttgagcggcaggccctgccgggcaatcctat

SEQ ID NO: 1854 - DNA, 352 bp, Zea mays
  Clone ID: PAT_MRT4577_26151C.1
tccccacttctcatcattcagtcagcactcgccacccacacgcctcctctcctcccgcggggccactccaactctccgatctccattaatcctcggctgatgctccgtctatggctgctcccatggtctactcctaatacctgctccaggtctacaggtctcgccttctccttcgcgcccttatctccaacaagggatgctcccctatcatgctcctcctcgcatgtcatgatgctgaaacttattacctgaatacaaaaactggtggtgcaaatggttctattagatattaagaatagtacactcatggttcatatgctggtttatagatagctatcgatcttcttgatcc

SEQ ID NO: 1855 - DNA, 308 bp, Zea mays
  Clone ID: PAT_MRT4577_26217C.1
gtgggttggcttctcctccccctccggttcgggttcgggttcgtgagagttctgcggggttcggtttcgtagggtgagcgcatcgagatggcctcgtaggatgttgagtaccgctgcttcttcagctgcctcgcctggaccacggacgaccactccatgcacaatgccttcagcacctacagcgaggtgctggactccaagatcatcatcgatcgggagacgcataggtcccgcggcttcggctttggcacacttctccacgcaggaggtacattcagaacgccatccaggtcctgaacatgacagaa

SEQ ID NO: 1856 - DNA, 373 bp, Zea mays
  UNSURE (1)..(373): unsure at all n locations
  Clone ID: PAT_MRT4577_26254C.1
  unsure (1)..(373): unsure at all n locations
ctcgagtccaagatcatcctcgatcgttagacacagaggtcccgcggctncggggttggcaccttctctacttaggaggccatgccgaacgccatcgagggcatgaacagcaaggagctggacggccgcaacatcaccgtcaacgaggcccagtcccgcggctatcgtggaggcgaccgctgcggccgatacggtggtcgacgtggaggcggccgctacggcgatggctggcgccatgatagcggcgacggctacagcggtggcggcggctaccgtgatggctgcggcggctacggtggtggtggccgcgtctacatgagcaacaaccgtggcggcgggtaccgcaactccaactggaactggaggaactgag

SEQ ID NO: 1857 - DNA, 2923 bp, Zea mays
  Clone ID: PAT_MRT4577_26256C.1
aattcggggccacgaggcgactctcggacccacgacgagttaagcccggagggaaaaaggacaaatcacacaaaggcacagggaatcgcgccaccgtgggacgcgtacggcgcaccgcccgcccgccggatctgcgccggcgacgcgcccggacgtcggatctacgccgccgcaggaggggggaggcggcgctgtggccgttctctgcccgcgagcgcccggatccgtcccgccggtgacttcatctccgctaatccaacggataggcaaaactctaatctttgtcaaccatcaagttgatgcagaggtggtgaaaacatcttctcttctccaaagactgctgactgcaagttgcaaaagtttgtcttcagcttgctgtgttctttcttccctctctggcggagtacacgagaagtttgtagatataggcactaggcagctcctttcagctcttctatgtccagggatttggactgtcctgttcagacacagatggctgtggcagtcctggaccggagcttcagcagtgaatatcctggaggcagcagaactgaggggaggcaactgagctggaagagagtctttgtgcaaactgacaatggttctgtccttggcattgagctggagagaggagaaaatgtgcaaactgtgaaaaagaagctgcagatagctctcaatgtgcccactgatgagagttcattgacctttggtgacctggttctgaatgatgatcttagcagcattcgcaatgactcaccgttgcttctcaaaaggaatcagattcaccgaagcaattccacaccttgcctctcccctactggccaggatgtttggcaaagagaccggagtggacccattgaaatacttggctgttcaagcccttcatctcggatgaagcagattgcgaaggatgtcattaaggccataatgaatggtgtcgacccagttgctattaacagtgggatgggtggtgcctactacttcaagaacatttggggagagcgtgttgcaatcgtgaagccaactgacgaggaaccatttgccccaaacaacccaaaaggttttgttgggaaggctctggggcagccaggcctgaaaagatctgtacgagttggtgagacaggcttcagggaggttgctgcgtacctcctcgactatgatcactttgcaaatgttcctcccaccatgctggtcaagataacacacaccatcttcaacgtgaatgactgtgttggctgcaaaagcaaagtattctgcaacaaatcagagtctgtgagcaagattgcatcactgcaggagttcattcctcatgattttgatgccagtgaccatgggacctcaagcttccctgtatctgcggtgcataggatcggaatacttgacattaggatcttcaacactgacaggcatgctggaaatcttctgatcaagaaggttggtcctggggctgacaatttcggagagcagacagaactcattcctattgaccacggtctttgtcttccagaatgcctagaagacccctacttcgagtggatccactggccgcagtcgtctgttcccttctccgtcgaggagctcgaatacattgcaaaacttgaccctataaaggacgcagagatgctacgcgtggagctacctatgatacgggaggcgtgtctcagggtgctggtgctgtcgacagtgtttctcaaggaagctgcagcgttcggcctctgcctgtctgagataggagacatgatgagcaggcagttcacagcaaaggaagaggaaccaagccagctcgagcttctctgcatggagacgaggaagtgggtcgaggaaagagagttatttcttcccgacgaagccggagttgaagacggcgatgatgacttcacccagttccctctcgacagcgatgccttcgaaccgccagctttctgcaagtttggcagcgtgaagacaagttccaggaatccactatccaagctggacgagtgtgacgaggaagacggagacttgtcggaagaggagggcgagcacggtgacgtcctgaccagtggtgcattgccccagaaggttcctcccatctccaagctgtcgtcgtccatgaaggggcttggcttcatcgggaaatccaaaccctaccgtacaggtggcgtccccaagggtaaggtgacaggtagaactaactacagtggcaaagccagcgagcatcagtccgggagccggagcgccaacgagctgctcccgcccagcgcgagtttcgtgaagctgtcggacatgagccgcaaggagtggagcgcgttcctcgagaagttccaggagctgctcccgagcgccctccgcacccggaagcacagcgccggcgtcggccagcgcccgatgccgaggctgggcacgtcttgccagttttgaaggtgtagaggagaagccaccaaggtaaaaaaaaatggatgtatacctccgttttagctctggtgtcgtgcaggtgcagcagtcagcaggtattatataaaaatgcttgtaggtgtatggagccagtagaagaggttgtccgagaataagatcgtcgatggcacagttgagatgagcttggcttgcaggagagtggtgtgtttgtgcatagtgttttgacatatgagatgcgttgttcttttctttttttttctttttcttttttgtatatagtgagtactcctgccgcctcgcaacaccgggctcgatctcggccgttacctgatggtggtgagtgtgcttggcatcgcctgtgttctgtctttgccgctgtaccattttggagacgcttaccataatatgaacagctgtgatatgatatcgctacagatatatgcataaataacacctgatagtctgcttcagtaaaaaaaaaaaaaaaaaaaaaaaaaaaaaaaaaaaaaaaaaaaaaaaaaaaaaataa

SEQ ID NO: 1858 - DNA, 1645 bp, Zea mays
  Clone ID: PAT_MRT4577_26477C.1
cattgggtacctcgaggccggccgggaaaaaggtgtggggctgtgggcattcaattgcttttgcttcctccgttcccccatctggccatctccccttcccctgctcccccgaagcagcaagccagcctgcccacccgcagccatcacctccgccgctctccaccatgaatcccatccaccagcacggcatcgtacccaatccttcgtgactgttgcctccgcgcatctccgggagcaatggaaggaggccgagatgtgttcttaggtgcggcggcaagggcgccgccgccgccgccgtcttgcccgtttcacggatccgctaccgccacccgctccggtggagcgcagatgctcagcttctcctccaatggcgtagcagggttgggtctgtgctcaggtgccagcaagatgcagggtgtgttgtcgagggtgaggaggcccttcactccgacgcagtggatggagctggagcaccaggccctgatctacaagcacttcgctgtgaatgcccctgtgccgtccagcttgctcctccctatcaaaagaagcctcaatccatggagcagccttggctccagctcattgggatgggcaccatttcgttccggctctgctgatgcagaaccaggaagatgccgccgcacagatggcaagaagtggcggtgctctagagatgctgtcggggaccaaaaatactgtgagcgacacataaaacgtggttgccaccgttcaagaaagcatgtggaaggccgaaaggcaacaccgaccactgcagatccaaccatggctgtttctggtggttcattgttgcacagccatgctgttgcttggcagcagcagggcaaaagctcagctgctaatgtgactgatccattctcactagggtccaacaggaatttgctggataagcagaatctaggtgaccagttctctgtatccacttccatggactcctttgacttctcatcatcacattcttccccaaaccaagccaaagttgcattttcaccggtggccatgcagcacgaacatgatcagctgtatcttgtgcatggagccggcagctcagcagaaaacgttaacaagtctcaggatggtcagctgctagtctcgagggaaacaattgacgacggacctctgggcgaggtgttcaagggcaagagttgccagtcagcatccgcagacatcttaactgaccattggacttcgactcgtgacttgcgtcctccaaccggagtcctacaaatgtctagcagcaacacagtgccagcagagaatcacacgagtaacagtagctatctcatggcgaggatggcgaattctcagaccgtcccaacactccactgagtgttcatcaggctggtctttgttgggaccacaaaataactgaagccatgttgatgtcctgagtttgctgatactaggttttcagtcgagtcttgtaactcctgttttagagctgttatatgttcacgtcatgttgcctttcattttcggttcattcagatgggtgttctaataatttctttccttcttacctgtgaaggatttgagttccaatctgagacgtgggtttgttctaacttggaggtatttatgaatattaggcacttctgatttccattgaagcgagatttctttaaaa

SEQ ID NO: 1859 - DNA, 1744 bp, Zea mays
  Clone ID: PAT_MRT4577_2654C.1
ccggccgggccgggaattcggcacgagagccaagggctagccgatcaacaacaccacactagcctctcctagtctcctatcctatctagcttccaccggccggaagaaaaaaaaaatggtggcgagcaaggccgccccgttcgacgaggtgtcctcggtggaggcgggggcctacgggggccgcgacgacgacgggcggccgcgccggacgggcacggtgtggacggccagcgcccacattatcacggccgtcatcggctccggggtgctctcgctggcgtgggccatcgcgcagctgggctgggccgcgggccccgccgtcatgctgctcttcgccgtcgtcatctactacacctccacgctgctcgccgagtgctaccgctccggcgacccagtggcggggaagcgcaactacacctacatggacgccgtccgcgcaagcctcggcggcgccaaggtcaggctctgcggcgccatccagtacgccaacctcttcggcgtcgcaatcggatacacaatcgccgcatccatcagcatgctcgccatcaagagggcggactgcttccacgccaagggccacaagcacgcgtgccgcagctccagcaacccctacatgatcctcttcggcgtcgccgaggtcgtcttctcgcagataccggacttcgaccagatttggtggctctccatcgtcgccgccgtcatgtccttcacctacgccaccatcggcctcgtcctcggcatcatgcagaccgtcgccaacgggggcttccagggcagcctcaccgggatcagcatcggcgccggcgtcaccccgacggagaaggtctggcggagcctgcaggccttcggcaacatcgccttcgcctattcctactccatcatcctcatcgagatccaggacacggtcaaggcgccgccgccatccgaggccaaggtgatgaagagggcgaccatggtgagcgtggccaccacaacggtgttctacatgctgtgcgggtgcatgggctacgccgccttcggcgacgccgcgccggacaacctcctcaccggcttcggcttctacgagcccttctggctgctggacatcgccaacgtcgccatcgtcgtgcacctcgtcggcgcctaccaggtcttctgccagccgctcttcgccttcgtcgagaagtgggcagcggccacgtggcccgacagcgccttcatcgcccgggagttccgcgtgggccccttcgcgctcagcctgttccgcctcacctggcgcacggcgttcgtgtgcctcaccaccgtcgccgccatgctgctccccttcttcggcgacgtcgtcggcctgctcggcgccgtctccttctggccgctcaccgtctacttccccatcgagatgtacgtcgtgcagcgcgccgtgcgcaggtggagcacgcactggatctgcctccagatgctcagcgctgcgtgcctcctcgtgtccgtcgccgccgcagcgggctccatcgccgacgtcatcggcgcgctcaaggtgtaccgcccgttcagcggctagttcagataggggcccaacgaggcgtgtgccgtgcacatgagtagtgccagtggtatctctactggtcggggtgctacattgactgtggggtcccgggttgttgtaacttgtaagatatagccaaatgaaaaacaaagctactgaactcgtgtggagttttgtcatgtagcaacttaaaaaaaaaaaaaaaaaaaaaaacaactcgagggg

SEQ ID NO: 1860 - DNA, 168 bp, Zea mays
  Clone ID: PAT_MRT4577_2657C.1
ggcaagtgcgatttcgatctcgcagccaccttctatcagttctgttgtgtatctagtagttgaaatgagatatgcagtttgcacttgcattggagacgaactcaggtcctcaccagataagatcttgtgatggtgatgggattgacaggttcgacaacttaactattg

SEQ ID NO: 1861 - DNA, 577 bp, Zea mays
  Clone ID: PAT_MRT4577_26641C.1
acctcgaggccggccgggatctctatgctaccatcgaccttcaagtctcgctatgtagcatcgtcaatataaatagcagccgaaatggcgagtagcactatggccctctcttccacggccttcgtgggctaggtcgtgaacgtgtcgtcgtcgttcgtcttcggggaggcccgcgtgtacgatgcgcaagacgggggtgtaggcctagctagcgttgtcgtccgggaggccgtggtatcggccccgaccgcgtgctgtacctgggaccactgtgcgaggatgctgcgagctacctgacggacgagttcccgggcgactacggctgggacaccgcggtgctgtcggtggacccggagacgttcgccaagaaccgggagctggaggtgatccactcgcgctgggccatgctgggcgcgatcggctgcgtcttccccgagatgctcgtccgcaacggcgtcaagttcggcgagggcgtgtggttcaaggccggatcccagatcttcagagagggagggctggactacctcgggaacactaacctcatccacgcggataatatccttgctatctgggcctg

SEQ ID NO: 1862 - DNA, 428 bp, Zea mays
  Clone ID: PAT_MRT4577_26783C.1
gggagcaccaaaaagcaccattttttccttaggattaacttaaaaaaaatcctgacaggggtaacagggtccatcgatccaaaatccatgctgggtgaggcatgggtctggtggagccggggatgaacacagaactaacaacggacaaaaagggaccttgcaatcaaaaacacagaggggcaacaacaaacgagacgaacgaagataaacccttgggactaggggaaacatcacgggaggaaaaaagaaaacttgggcgggcgggccccaccggtaagttcctccaattcccgtgggaattgccgaaacccccgccacggttgccaccgccgaaacccccaccaccaccaccggaaccaccggcgccaccggaagcgccgccgccaccgccgaaaccgccgccgacataaaggggcccgccaccgccg

SEQ ID NO: 1863 - DNA, 276 bp, Zea mays
  Clone ID: PAT_MRT4577_2697C.1
gattgagatctttttttttttttgcaggaccaaggggcaccattttttcctgaggagtaacttagaataaagcctggcgggggtaacagcatccatcgatccgcagtccatgctgtttgatgcatgggtcttctgaaaccgaggatgaacacagttctatcaactgacacagagggaccttgcaatcaaaaacacagatggggaacatcaaacacgacacgagcgaagataaaccctcttggctagggtaaacatttttgttgcgaacaggataac

SEQ ID NO: 1864 - DNA, 2286 bp, Zea mays
  Clone ID: PAT_MRT4577_26995C.1
atggacggatgcgattgcatagagccactatggcctaccgatgatcttctcgtcaagtatcagtacatctcagacttcttcatagcccttgcgtacttctcgattccattggagctcatatattttgtgaagaagtcgtccttcttcccatacagatgggtcctgatccagtttggtgcgtttatagttctttgtggggcaacccatctgataaacctgtggacgttcaccacacatacaaagaccgttgcgatggtcatgaccatagcgaagatttctacagcagtcgtgtcctgtgcaactgctttgatgctcgttcatatcattcccgacttgttgagcgtgaaaactagggagttgttcttgaagaataaagctgaggagcttgatagagagatgggacttataaggacgcaagaggagactggtagacatgttaggatgcttacacatgaaatcagaagtactcttgatagacatacaattttgaagactactctcgttgagctaggaaggaccttgggtctggaagaatgtgcattgtggatgccatctcgaagtggctcaagccttcagctttctcatactttgcgccaccagattactgttggatcatcggtgccaatgaatcttcctgtcgtcaatcaagtgttcagtagcaaccgggcaatcataataccccacacatcttctttggcgcgggttcgacctcttgcagggcgatatgttccaccagaagtggccgcagtccgtgtacctcttctacatctttcaaactttcaaataaatgattggcctgagctctcagcaaaaagctttgcaatcatggttttgatgcttccatctgatagtgctagaaaatggcatgtgcatgaattggagctggttgaggtcgttgctgatcaggttcgtgctgtatcttttgctatggttactataacatactacttccatccagagaaggatgtagcagttgcactatctcatgcagctattctcgaagagtccatgcgggcacgtgatttactaatggagcagaatgttgccctggatttagctcgaagagaggctgagatggctatccgtgctcgcaatgatttcctagctgttatgaatcacgaaatgagaacacccatgaatgcaataatagccctttcctccttgcttttggaaactgagcttactcctgagcagcgtctaatggtggaaacagtactgaaaagcagcaatttgttagcaacactcatcaatgatgttctggatctttccaaactcgaggatggaagccttgaactggagattaaagcattcaatcttcatgctgttttcaaagaagtgatgggtttcattaaaccaattgcatctatcaagaggctatctgtatcggttatgttggcaccagatctgccgttatgtgcaattggtgatgaaaagagactcatgcaaactattctgaacatctctggcaatgctgtaaagtttaccaaggagggacacatcacgcttgtagcttccattgtgaaggctgactctttgagagagttcagaaccccagaatttcatccaactgcaagtgatgaacatttctatttgaaagttcaggtaaaagatacaggctgtggagttagtcctcaggatctacctcatgtattcacaaagtttgctcatcctcaaagtggaggaaaccgagggtttaatggtagtggtcttggccttgccatatgcaagaggtttgttagtcttatgggagggcacatctggatcgacagcgaaggaaccggaagaggttgcaccgcaacattcgtcatcaagctcggcgtgtgtgacaacacaaacacctaccagcagcagctgatccctctagtatggccaagcagcgcagactccgatttgcgtgctccgaaagctcttccggacgggagaggatctactcccttgaaatctcggtaccaaaggagcgtatgagcctagtgtaaatgattgacggcatagtgccaagtaggggaccgattagtgccaccgtctaattttgtttgtaaccctgtcatagcaggcatatgatgtacaaatactgtaaagcaaatggagactgcggccgtgtatctgggtggcaacgctgacttgctgcattgagtggtatatacatatgctaccagcggattgaattgcttattctggggtgtgccgagcgcgcccgtgtgcgaccaccgtagctcgttgcttgttctattgtgacttgaattccatattcatcgtgtaatatgaaatccagtgcaaatacacggt

SEQ ID NO: 1865 - DNA, 3260 bp, Zea mays
  Clone ID: PAT_MRT4577_26996C.1
ttgcggctcctgccacgcccccgcctgctcaccggagcccaccccttccatcccccctccagaccaccgggccatttacactcccacccccgcgccttccaggcgcaggaaaaaaatagccagcgcatgcttagacgacttacagaacagcgccggactgccggcaccctgcctattctttctcccgttcaccccgccgtgcacgctctttttgtccctcgtgccgacgaccgaccgaccgccgccgccgccgccgccgccaaggtcttcgtaaagccactcgccggcaacgagcagccaccaggaagatgttgtgaggactgatgcaataactaagcttgctggatggacggatgcgattgcatcgagccactatggcctaccgatgatcttctcgtcaagtatcagtacatctcagacttcttcatagcccttgcgtacttctcgattccattggagctcatatattttgtgaagaagtcgtccttcttcccatacagatgggtcctgatccagtttggtgcgtttatagttctttgtggggcaacccatctgataaacctgtggacgttcaccacacatacaaagaccgttgcgatggtcatgaccatagcgaagatttctacagcagtcgtgtcctgtgcaactgctttgatgctcgttcatatcattcccgacttgttgagcgtgaaaactagggagttgttcttgaagaataaagctgaggagcttgatagagagatgggacttataaggacgcaggaggagactggtagacatgttaggatgcttacacatgaaatcagaagtactcttgatagacatacaattttgaagactactctcgttgagctaggaaggaccttgggtctggaagaatgtgcattgtggatgccatctcgaagtggctcaagccttcagctttctcatactttgcgccaccagattactgttggatcatcggtgccaatgaatcttcctgtcgtcaatcaagtgttcagtagcaaccgggcaattataataccccacacatctcctttggcgcggattcgacctcttacagggcgatatgttccaccagaagtggctgcagtccgtgtacctcttctccacctttcaaacttccaaataaatgattggcctgagctttcagcaaaaagctttgcaatcatggttttgatgcttccatctgatagtgcaagaaaatggcatgtacatgaattggagctggttgaggtcgttgctgatcaggtagcagttgcactatctcatgcggctattcttgaagagtccatgcgggcacgtgatttactaatggagcagaatgttgccctggatttagctcgaagagaggctgagatggctatccgtgctcgcaatgatttcctagctgttatgaatcacgaaatgagaacacccatgaatgcaataatagccctttcctccttgcttttggaaactgagcttactcctgagcagcgtctaatggtggaaacagtactgaaaagcagcaatctgttagcaacactcatcaatgatgtgctagatctttccaaactcgaggatggaagccttgaactggagattaaagcattcaatcttcatgctgttttcaaagaagtgatgggtttcattaaaccaattgcatctatcaagaggctatctgtatcggttatgttggcaccagatttgccgttatgtgccattggtgatgaaaagagactcatgcaaactattctgaacatctctggcaacgctgtaaagtttaccaaggagggacacatcacacttgtagcttccattgtgaaggctgactctttgagagagttcagaaccccagaatttcatccaactgcaagtgatgaccatttctatttgaaagttcaggtaaaagatacaggctgtggaattggtccacaggatctacctcatgtatttacaaagtttgctcatcctcaaagcggaggaaaccgagggtttaatggtagtggtcttggccttgccatatgcaagaggtttgttagtctcatgggagggcacatctggattgacagcgaaggaaccggaagaggttgcaccgcaacattcgtcgtcaagctcggcgtgtgtgacaacacaaacacctaccagcagcagctgatccctctagtatggccaagcagcgcagactccgatttgcgtgctccgaaacctcttccggacgggagaggatctactcccttgaaatctcggtaccaaaggagcgtatgagcctagtgtaaatgattgacggcatagtgccaagtaggggaccgattagtgccaccgtctaattttgtttgtaaccctgtcatagcaggcatatgatgtacaaatactgtaaagcaaatggagactgcggccgtgtatctgggtggcaacgctgacttgctgcattgagtggtatatactaccaaaggattgaattgaaaaaaaaaaaaaaaaaaaaaaaaaaaaaacccgcacttccgcacaggtactgccgcaggcgcgtctcgcactcgcacgaccgctggccgctcggcagacggcagtcccgctccggctccggcgctccgctgctcgctcggccagctggcctgctcatgcagacagcaggctgcagtcctacctgctttgctgcttgtcccacccggcggccggctgatgtaggctgtttgtcccggcccgccgaggtgccgacccgcccggctgccgcagtgccgctgcttccagtttgcttcctgcttgctttatttagatcattgcttcattacttgcttgactgcagactgcttgagtttaagtgcttgactgcttgttaactacacaaatgcaattggctagatctcctacaactagattcaactaaaggtacaaggtgttttaaatcgtgttataaatttttagtcttcaccgcgttagccacacctaaattttttggcgtcctcggccagtaaaagcttactagttgctgactgagggagataaccggatactatcgtctcgggatctaacctacgtagtactatttttttcaggccaactagcgaatttcctcatccttttttctcagcctgctggatatagaggaagtctgcattgttttacttgtatgctttatgaaaaaagatagaattattccttgacattcgctcagctcccaaatgatctatattattggagagtttgcgcgagaggcgagtatatacataacaatcgcttgcatggcttatcaacatgcaaatttctttgagactgac

SEQ ID NO: 1866 - DNA, 427 bp, Zea mays
  Clone ID: PAT_MRT4577_27161C.1
acgcgttcataactagcaacatagaacgcacaatattgtaccaacaatggcagccaaaatggtttggctccttatgctccttggtctttctgcaagtgctgctacagccaccattataccgccatgctcgcatgctcctatagcttctcttctttccccgcacctcttaccagcggggcacttcagcatgtgaaaacccaattacttaaccactacaggatccaacaggcaatctcagatggcatcttaactttatgaccctcgatcatccaacaatcatcaaccctattacaacagatacctttggtgcatttattggcacaaaacatcagagcacaactactacaacaacttgtgctagcaaaccttgctgcctactctcaacaacagcagtttcttccattcaaccaactaagttcattgaact

SEQ ID NO: 1867 - DNA, 306 bp, Zea mays
  Clone ID: PAT_MRT4577_27290C.1
cggacgcgtgggctggcttctccttccccttttaccaagacctcctcgggatagggggcctgagggttatgtggaggggcgatggcaacaactgatgtgaagtaccgttgcttcgacggcgggcttgcctgggccaccagcaacgaggcgctggataatgccttcgcctcctacggcgagatccttgactccaaggtcatcaccgaccggtagacggggaggtcccgcggctacagctacgttaccttcacctccgagaacttcatgctcgacgctatagagaacatgaacggcaaggagctcgac

SEQ ID NO: 1868 - DNA, 306 bp, Zea mays
  Clone ID: PAT_MRT4577_27305C.1
caactagcaacatacatagcacaatagtttaccaacaatggcagccaaaatatcctgcctggttaggctcctcggtctttctgcaagtcctactacctcgaccattttaccgcaatgctcgcaagctactataactaaccttcttcccccgtacctctcaccaactgtatcttcagtatatgaaaacccaattcttcaaccatacacgatccaacactcaatcgcaacttgcatcttacctttatcaccctagttcctccaacaatcatcaatcctattacaacatttacattcgtatcatttatt

SEQ ID NO: 1869 - DNA, 302 bp, Zea mays
  Clone ID: PAT_MRT4577_27312C.1
cggacgcttgggcggactcgtgttcttttccctaactcccgtccgcagttggccatctcccaaatccatttcgcaagtccaccctcctttgccgccatggccctttttgtgaaaaaaacctcttctggacgggattccaaggtcaaggatctttcccaggcggacttcgtccgcctcaaaattgacctgccctaggtcaaaatgcccgccctaatggcttgccgccccaagttcggcccgtccaagccttttgccggccctaggatctcgggttctttccacatgaccatccaaaccgcctt

SEQ ID NO: 1870 - DNA, 128 bp, Zea mays
  Clone ID: PAT_MRT4577_27575C.1
gtaacgcgaataccacccccgtgacttcccgatctccggcgatggtcgcgcggtgcctcggatcccccgtatctaggtggttgcgcccgtctgcgctgatcctcctggtcgcctctgatctcctctcg

SEQ ID NO: 1871 - DNA, 1917 bp, Zea mays
  Clone ID: PAT_MRT4577_27638C.1
tcgtagcccgctcgctgttgtaggtaggcggcagggttcaccatggctagttgactgagcgctggcagaaactgttgcagctgttgttgtggctggtttgcaactacgtttgccagagcaagtgggtttgatgcaagcaactgctgttgcaagtaggcggcagggttcaccatggctaggtggctcagtgctggtaggaattgttgttgctgttgcgttgcgatggtttgtattgttagatgtgccaaggattgttgtggcaacttccagcttgcgcatcgctgggtcaacaacccacatggccggcgtagccctttgaatcttgttcgcagccgtgattttatcactgtgggtgaaacgtaatcacatacctactgtaatcagccggccggccgcgcccatgacgtcgctactcttccgggatggaccaataacattttatatctggacgccccttatcgccctcgttatttacatcgctgccaccctcctctccgccgtcgccgccgccgccggggatggggggagcgcaattccccggcgacaacgacgtcgcggaagtagacgcggcccgcgacggagaggtggaccgccgtgacgtgggcaagatgaagcacgggtgcgagcattaccggcggaggtgcaagatcgtggcaccgtgctgcaaccaggtgttcccctgccgccactgccacaacgaggctacggcttccggagatcggcatacaatatgtcgtcaggatgttgaaaaagtagtttgcctactctgtgaaacaaaacagccggtgtcacaagtgtgcataagctgtggagtcaatatgggagagtacttttgtgatatatgcaaattttatgatgatgatacagacaaagggcagtaccattgcatcgattgtggcatatgcagggttggtggcaaggaaaacttcttccactgtgtgaagtgtgggtcctgctattctgttatactccgtgataaccatcagtgtgtggagaactcaatgaggcagaattgccccaatctgttatgagtatctatttgactcattacaaggaacaagagttctgaactgtggacacacaatgcacttgacatgttttgaagaaatggtggcgcataacaaatacacttgtccaatatgctctaaaaacagctcttgatttgacacatcattgggaaatgttggatcaagagatcgaagccacgatcatggcctcttgtgtatcgctacaagatttgggtgctttgcaacgattgcaacaaggtctcagaggtgaactttcacgtgattggccacaagtgcagccactgcagatcgtacaacacccgaacaacatcgcgccctgcagatttatccggaagcagctcaccttcaacagactcatccgacaacaacatatagagaagaaaccattgacagagccaatatgattgaagaaccggaggaggaaacattgtttcggggcgtgcgtgcttgccaaacttgaagactcccagccgtttattggccctcatcttgtctagattcagttcattccatgagtctttgctgttgtggcaacttccagcttgcgcatcgctgggtcaacaacccacatggccggcgtagctgtccctttgaatcttgttcgcagccgtgattttatcactgtggatgaaacgtaatcacatacttactgtaatctactatggttgaagatgtgtgcccccctgactcatgccttgtgtgcttgtgctgaactgtttatgaattcccatgctgttccgtaacactatattgccatttgtgtttccttatctgtcaagtaccgccaagtgtgcggtgaaattgtaattatttgcaatgaatagaatcttatatctatacctaataataaagactcaacatttctgccgtgttaccaacaaacccacac

SEQ ID NO: 1872 - DNA, 672 bp, Zea mays
  Clone ID: PAT_MRT4577_27663C.1
atccacatattattcgcgaccaactagcaacatacaaagcacaatactgtaccaccaatggcagataagatactcggcctacttaggctccttgtacctttctgcgagcgctgctacggccaccattttcccacaatgctaacaagctactatagctttccttcttcccccgggcctctaaccaacggtggattaggtatgtgaaaacccaaatcttcaaccgtacaggatccaacaggcacatcaaaggtggcgtgatacctttatcacgcttgtgcctccaacaaacatgaaccctatgacagcagatacctttggggcatttattgcaacacaacatcagggcacagcaactacagcaacttgtgctagcaaaccttgctgcctactctcagcaacagcagattcttgcattcaaccaactagcctgactggactctgcttcttattttcaacaacaacaactacgattcagcctggtatctgctgtctacccccagctatttcttgcattgaaccgactgaccgcattgaactctcgtgcttatttacaggaacagcgactactaccactcagccagataggtggcgtgagccctgctaccttcttgacacaaccacagctgatgtcgttctagcagcacgctgagcctaacgctggcaccctgttac

SEQ ID NO: 1873 - DNA, 2075 bp, Zea mays
  Clone ID: PAT_MRT4577_27700C.1
aaatcaggcccacgcttttgttaacaaagaattccctcatagccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctggcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactccttcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggcttgcgtgccctctccagggcccagattgactctgttctggatcttgcacggtgcacaatcgtgtccgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttttctgaggaagttgctgcacttaactgctactttggcgttctgaaatctggtggtaatgcttatgtgattggagatccagcaagacctggacagaagtggcacgtcttctacgccactgagtacccagagcaaccaatggttaaccttgaaatgtgcatgactggtctggacaagaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttacgaggttatgggcttggatgccactgctctgtcttatggtgaccttgtcaagagggtcctccggtgctttggcccctcggagttttccgttgccgtgaccatctttggtgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgagagtgcttgatgagtaagacgggcttctggggtcgatttgcttctgagttgtttattttatatcgtcgcaatttcgtggttgtcgtttggttattctgtgaagcagccaagccaagctattgttatgaaaatttgtcgtctgtaagcatgtgaacttccgacgttgccacatgctggatcagtctgaataagtaagtatgcagctctaggtggtcagctgcgtctaccacaatgagcatgtacgtatggagaaatatctgtgaacccattttgtttatgaataagatttgttttttcgagtt

SEQ ID NO: 1874 - DNA, 2932 bp, Zea mays
  Clone ID: PAT_MRT4577_27701C.1
ccggccggtaatggtctgtgatgaagtcgcccgatttggttgaggctgctgtcgtcaccaagttcctgcttgtcaggaagaacctacttggtgccgctgctctcgcatgatatctccgggtaaatctgaggccattgagagagaaaaaaaagaaaaaaaaaagccgcacgcttcttgttgccaaagaattccctcccctagccgccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgagttaaaaaaaaaaaaaaaatattcattcatacgcattccagagtccagactcatttcgaactaccccgccgctccgcctcgaccctcccctcctccccaatcccgcgcccttccaccctcccgccgaaagcccagccccgatggcgtctctagaaggcgaccggtggtcggagatcgtggccagcggccgtgcccggccgccccgcgtcggcgtcgtgtacggtcgtcgcctggtcgaggaatcgtccggcagggctaacatggagacgagggccagcttcagtggcctgcggcgcccgagcttcgtgccgcgcaagcgaaccagctgaaaccggtcgctttccatcagagggagagagagtatcttcgtcgcacctggtgcaaatcttcaacagaaaccatgtgaagcaatgaaacgaccaccgaaaccgtgcaaccgaaagaaacgtctgggtggccctcctgatttgagcaaggagaaggcatattttgaagagatcgatgcctttgatcttatggaagaaagtccttctcctaagaactttgcctcgtggaccaaaggaatggagcagaatcacataattcatgatctgcctgcaatattggagagatggaaaatttctactcttgcaagacgtgtgtcatctgaccccttgattgacattgcggagacgccaatcttacctcagtcctcagtaacagca

SEQ ID NO: 1875 - DNA, 282 bp, Zea mays
  UNSURE (1)..(282): unsure at all n locations
  Clone ID: PAT_MRT4577_27715C.1
  unsure (1)..(282): unsure at all n locations
gcggtggtttctcctccccctcttaccaagtcctgctaggattanggttccttagggctttgaggaggggcaatggggggagatgatgtggagtaccggtgcttcctcagcagccttgcctgggccaccagcaacgaatcgctggataatgccttcggatgctacggcgagatccttgactccaaggtcatcactgatcggcagacgagcaggtcccgcggcttcggccttcataacttctatttcgagaactccatgctcgacgctattgagaacatgaac

SEQ ID NO: 1876 - DNA, 1781 bp, Zea mays
  Clone ID: PAT_MRT4577_27770C.1
ggcaagcgagcaggaagagggcggggatcccgtcctcccagtctagaagatgggcgagacgagggccaaggagggggtgtcgcttagactagcgaatccatccgccaagattccgtgcacctcgaccgccgccgccgctatctgtttgtccccgcccccgcgaccgcggcagcctagcaggaggggaggatccatgtctagtttctagagcagctgcttgcgtcccttgcaaatcacatcgaccgatggggatacccagcgacgacgtggtgcaaatttcgccacgccgacgccgctggcgagcccaccgtcgtcaccgtcagctgccccgacgtgttctggctgttgccgcgcgggcggcggcccgtggccgtgccgtgggacctcctcaaggaccggttgcttcagctctgccccgtcgcgccgccattcggcttcgggtcccacgacgcgtacctcgcggcggcggctggcctgcaggacgttccgcctcccgcgccacagctcttcctgctcaagctatgctgcttcgaccggatgggactcttgcacgatgtgacacgcgttttgtgtgagctagagctcacgatccggagggtgaaggtctctaccacgcctgatgggagtgtgctggaccttttcttcatcacagatgccagggggcttctgcacacaaagagcaggagagaagaaacccaggacagactcgagagcgtcttaggcgactccttgacatgttgcgaaatagatcctgctggcgaagacatggtgtcttgctgcctccagtcctgggcctgggcttcgctgacgcctgctgttatagcacagatgtttagcacagctgatcgcgtggaggagcaaccgatcggcacaaggggtggtggtggtggtaccatcatctccgtgacgatggacaactcgcttagccctgcccacactcttattcagattcagtgtggcgaccataagggcctcctgtatgatgtcatgaggatagtcaaagactgcaacattcagatttcatatggccgattctacgcgagccaaaacggaaggtgcgagatcgatctgttcgcggtgcagtcggacgggaagaagatccttgatcagcacaggcagagagcactgtgctgtcgcctgaggatggagctccgccgaccactccatgtggcgttggtgaaccgaggtcctgacacggagctgctggtagcgaacccggtcgaggtttctgggaagggtaggccgctggtgttctacgacatcacccttgctctcaagaatcttcagagacgaatcttcttggctgagattgggaggcacgttgtggaaggcagggagtgggaggtctacagattgcacttcggtgaggagcacgagctctcgtctgcgctgcggaagaagattgtggatgcagtcaccaacatgctgatggggtgggactgatggcactgctgctgctgccgtgcctcggtctgaaacattatgcttagtgttcttccagaaactaacctatttggtgcaagcaaagaagaaacaactgatctctatctcttagatgcagcggttttcagctaatgcagagaccatgaaacctttggttatctaaacatgcactaggaaccggggtcctactacttagtgggcaccagacctgatgtatatgcatatactgaagcatgatcaagagtcatgtgtggcatatatataccattttgtctttgtcagaaaaaaaaaaaaaaaaaaaaaaaaaaaaaaaaaaactcgaagagggggcccggtac

SEQ ID NO: 1877 - DNA, 276 bp, Zea mays
  Clone ID: PAT_MRT4577_2779C.1
gatgtatgacgctcccattggctacagcattgttgacgctcgacctgcctgaggcgtgaaggggtttcagtctgctgcttactccaactgcgcgaagaagccatcctgatatctcttttggcttgctcattctaccaatttaggacttcttttctgacactttgattatgaccaatctctctggactgatgcttactgatgatcgaccagttccccagtcttgctccttgcactacttcctactccatctgcaacattgtgttctgatttaccttc

SEQ ID NO: 1878 - DNA, 844 bp, Zea mays
  Clone ID: PAT_MRT4577_28038C.1
aaaaaaaaaaaaaaaaaaaaaaaaaaaaaaaaaaaccccacccattcactcgccttgcgcttcctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaaggtctgggcgtgcgctcgaagaggttcgctctcctggccgacgacctcacggtcaccgtcgcaaacatcgaggaaggcgggcagttcacgatctctggcgctgaggagatcctgaaggcgctttagaagccgcagcaacgatcggtctagtttgaactcgcctttgaataacttgtcgttggacaaggtctagttcggtgttgtgtatggaacggtcgtcactgagtcatgcacgatttggtatccgtgtgtttatgttcgccggtttgaggaactctctgatccgtcgtgacacaaagttgatgctgagagaacgaccgagtattttttttttcctgccaaaaaaaaaaaaaaaagcggcc

SEQ ID NO: 1879 - DNA, 1190 bp, Zea mays
  Clone ID: PAT_MRT4577_28039C.1
caaaaaaaaaaaaaaaaaaaaaaaaaaaaaaaaaaaaaaaaaaaaaaaaaatacctcgccccggccggggaccggccgggaaccattgcccggcccggggcgggccgggaccccacccattcactcgcctgcgctccctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaagggctgggcgtgcgctcgaagaggttcgctctcctggccgacgacctcacggtcaccgtcgcaaacatcgaggaaggcgggcagttcacgatctccggcgctgaggagatcctgaaggcgctttagaagctccgtctcctctagaagccgcagcaacgatcggtctatagtttgaactcgcctttgaataacttgtcgttgggcaaggtctagttcggtgttgtgtatggaacggtcgtcactgagtcatgcacgatttggtatccgtgttgtttatgttcaccggtttgaggaactctctgatccgccgtgacacaaagttgatcctgagagaacgaccgagtatttttttttcctgcaatttgctgcagtcgtgcagagtgcagctttgcgcgctcctttagatgctaaaacatgagcggccatggtgggatgcgtggcaacgacgggttatgtgctcgccggccgtgcagcggtttctggtagcagccgtgctcagatgcatgcgatcagtaataaatttggagaaaaaaaaaaaaaaaaaaggcccctacagcaacgcgtgttccgagaaaaaaaaaaaaaaaaaaaaaaaaaaaaaaaaaaaaaaaaaaaaaaaaaaaaaaagcggccg

SEQ ID NO: 1880 - DNA, 454 bp, Zea mays
  Clone ID: PAT_MRT4577_28064C.1
gaccaactagcaacatatcaaagcacaatagtgtaccaacaatggcagccaaaatgttctgcctgcttatgctgcttggcttttgtgcaagtgctgctacggcgaccattcacccgcaatgctcggaagctacaatacctcgccttctttccccgctcctctcacaatcgcggcttcgggcatgcgaaaacccaagtgttcaaccctacaggatccaacaggcaattacagctggcatctaacctttatcacccttgttcctatcaacaatgatcaggcctattacataagctacctttggtgcattgattggaacaaaacatgaggcaacaacaactacaacaacatgtgctagcaaaccttgctggctactctcatgaacagcaggtgctttccattaaaccaactagctgaattgaactatgcttactattcgaaataacaacaactacca

SEQ ID NO: 1881 - DNA, 1656 bp, Zea mays
  UNSURE (1)..(1656): unsure at all n locations
  Clone ID: PAT_MRT4577_28160C.1
  unsure (1)..(1656): unsure at all n locations
ggccctctcccctgcccattcggcccgccgtcgcgtccgttcctcccttcctttccgtgtcggtctccggcgcgcccgacgtagcgcccgcatccgacggccgtgggggcatcgacggccgggcgacgcgacgcgatgtgaccatgacccgtcagtcagcagtacaaaatggcgatgatggtggatcctccgaatggaatcgggaaccaaggaaagcattactactctatgtggcagaccttatttgagatagacaccaaatatgtgccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaagctctcgagcacccttacatgtcccctctgtatgatccaagcgcaaatcccccagcccaagtgcccatcgatctggatatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgctgtgtaaatacgcgcccaataagagcggcgtccgccctagatgttgtcactatggaccattacttgttgtatgccctgtatatctgtggactgttgtggtgttgtattagttcatgacccatgaagctttgaagtnnnnnnnnnnnnnnnnnnnnnnnnnnnnnnnnnnnnnnnnnnnnnnnnnnnnnn

SEQ ID NO: 1882 - DNA, 847 bp, Zea mays
  Clone ID: PAT_MRT4577_28161C.1
catcctcctcacggcacgggactcccctcccccacctcctcttcctcccctcccgcccacggctggaggtgctcacagcgagcggagcggaggcgagggattcggccgcgcgcatggcgacgcctctctgaccgaagctgctccacccacttggccagtacaaaatggcgatgatggtggatcctccgaatggaatcgggaaccaaggaaagcattactactctatgtggcagaccttatttgagatagacaccaaatatgtgccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgcgattttggtctcgcacgtacaaacagtagcaaaggccagttcatgactgaatacgtcgtcacccgctggtacagagctcctgagctgctcctctgctgcgacactacggcacatccatagacgtctggtctggttggtgcatctttgctgagctcctt

SEQ ID NO: 1883 - DNA, 1853 bp, Zea mays
  Clone ID: PAT_MRT4577_28162C.1
gcccacggctggaggtgctcacagcgagcggagcggaggcgagggattcggccgcgcgcatggcgacgcctctctgaccgaagctgctccacccacgcggccgcgcgcgccgcgccctcccggtcctccccacccccatccctcctcacggcacgggactcccctcccccacctcctcttcctcccctcccgcccacggctggaggtgctcacagcgagcggagcggaggcgagggattcggccgcgcgcatggcgacgcctctctgaccgaagctgctccacccacttggccaggcgcgccgtcctctcctctcccctccccttatcctctcgttacaagatggcgatgatggtggatcctccgaatggaatcgggaaccaaggaaaacattactactctatgtggcagaccttatttgagatagacaccaaatatgtgccgatcaagcccattggtcgaggagcttatgggatagtttgttcatccattaatcgtgaaacaaatgagaaagtagcaataaagaagatacacaacgttttcgacaaccgggtggatgcactacggaccttgcgggagctggaactcctttgccatttccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaagctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatacgcgcccaataagagcggcgtatggatagatgttgtcactatggaccattacttgttgtatgcactgtatatctgtggactgttgtggtgttgtattagttcatgaaccatgaagctttgaagtaaaaatcccatgcatgttaagtttgtataaaaaaaaaaaaaaaaaaagcgccgactagtgagcgggggtcggtaccgg

SEQ ID NO: 1884 - DNA, 1777 bp, Zea mays
  Clone ID: PAT_MRT4577_2836C.1
cctcgaggcggccggaaaaaaatttccaaaaaaaaaaaaaaaaaaaaaaaaaaatttaaaaaaaaaaaaaaaaaaaaaaattcggccgggtttttggaagcccaagtccagagcgggccgagcccagttcatcctccacctgctccgccggctgctcttcttctcccctctcgctatatccccggggacctcacagccacatctctccactgctccgtccagcgcgtccacctcccaaacccctactcccccaggaagcaatggcttcccccacccagggccaggtcatcacctgcaaagcggcggtggcgtacgagccgaacaagccactcgtgatcgaggacgtgcaggtggcgccgccgcaggccggcgaggtccgcgtcaagatcctattcaccgcgctctgccacaccgaccactacacctggagcggcaaggatcctgagggtcttttcccttgcattcttggccacgaagctgccggaattgtggaaagtgtcggtgaaggagtaactgatgtgcagcctggggatcatgtcattccttgctaccaagcagaatgcaaagaatgcaagttttgcaagagcggaaagaccaacctctgtggtaaggtccggagtgccacaggcgtaggtgtcatgatgaatgatatgaagagcaggttctctgtaaatggaaagcccatttaccatttcatggggacatcaacattcagccagtacactgtggtgcatgatgtcagtgttgcaaagatcaacccacaggcacccttagataaagtctgcctgctcggttgtggtgttcctactggtcttggagcggtgtggaatactgcaaaggttgaatctggctcagttgttgctgtttttggccttggaacagttggacttgcagttgctgagggagcaaaagctgctggtgcttctcgagttattggcattgacatcgacaataaaaagtttgatgttgcaaagaactttggagttacagaatttgttaacccaaaagagcatgacaaaccgatacagcaggtcctggtcgatcttacagatggcggcgtggattacagctttgagtgcattggaaatgtttcggttatgagggctgcactggaatgctgccacaagggctggggaacctccgtcatcgtcggcgtcgccgcctctggccaggagatcgccacacgaccattccagctcgtgactgggcgtgtctggaagggaaccgctttcggtggcttcaagagccggacccaggtcccatggcttgttgacaagtacatgaaaaaggaaattaaggtggacgagtacattacgcacaacatgaacctggctgacatcaacgacgccttccacctgctgcacgaaggtggctgtctgcgttgtgtgctggcaatgcagatttgaaattcctaagctaagcagtttttggatgtgtcggcatagactgtcttttgttttggaactagaattcctttttgcctcgttaggcctggacccactgtataatgctatgttgctttggatggctgacgatggttaccgctgtgttgctagccatgtggtacttgatctgtatcacggttgcaaataagtgctgtttctaaaacactccctctcggtgaataaggggttgtttggtttgaggaatcattccatccaaattgaggtggtgcatcatagatctattcctcctccaaaaaaaaaaaaaaaaaaaaaaaaaccaaaaaaaaaaaaaaaaaaaaaaaaaaaaagtactctgcgttgttaccactgct

SEQ ID NO: 1885 - DNA, 642 bp, Zea mays
  UNSURE (1)..(642): unsure at all n locations
  Clone ID: PAT_MRT4577_28380C.1
  unsure (1)..(642): unsure at all n locations
tacctcgaggccggccgggccgggactccccacccattcactcgccttgcgcttcctcgccgccccagttccccaccccctgctcacccaacccgtcccctcctcgctcgcccatggactcccatcgactggtcggngacgcccatccccgacggccagcctccggtggatcgacgagaacgaccacctgcagcaggtctccgtccacgcgctcgccgccggaaagaaggtcatcctcttctgcgtccccggcgccttcaccccgacctgtagcaaccaacatgggccaggcttcgtcacacaggctgagcagctctgagccaaggtggtagacgagatcctgcttatcagcgttaagagacaccttcgtcatgaaggcgtgggcgaatacctaccccgagaacaagcacgtgaagttcctcgccgacggatctgtagcgtacaccaaggcgctcgacctcgagctcaatctcacggacaaagggctgggagcgcgctcgaagaggttcgctctcctggccgacgacctcacggtcatcggcgcaaacatctaggaaggtgcacaggactatatctccgacgctgaagagatcctgaaggcgctttacaggctacgactcctctagatgccgcgcaacgacc

SEQ ID NO: 1886 - DNA, 834 bp, Zea mays
  Clone ID: PAT_MRT4577_2855C.1
cggccgggccgggcctccctatccctcaccatctctaacaaccatccgtgggcggtgcaatctgtttgtatccgtcggtcgctcccgacgaccgagaagagctagcgccgttgctcggcggagatcacgcgccggtcgcagaggcggagtagagaagagaggatggaccacgcggcggaggcgcagcggacggacctgatgacgatcacgcggcacgcgctgaacgagcaggggcggcacccggagtcccggggcgacttcaccatcctcctctcccacatcgtcctcggctgcaagttcgtcgcctccgccgtcaacaaggccggcctcgccaagctcatcggcctcgccggcgagaccaacgtccagggggaggagcagaagaagctggacgtgctctccaacgaggtctttgtcaaggcgctcgtcagcagcggccgcacctgtgtcctcgtgtctgaagagaacgaggcggccatcttcgtcgacgcgcccctccgcgggaagtactgcgtgtgcttcgatccgctggacggctcctccaacatcgactgcggcgtctccatcgggacgatctttgggatctacatgatcaaagacaaggacaacgcgactctggaggacgtgctgcaacccgggactgacatgatcgccgctggctactgcatgtacgggagctcatgcacgcttgtgttgagcaccgggaacggtgttaatggcttcactcttgatccttcccttggggaagtcatacttacccatccccacataaagataccaaacaaagggaagatctattcggtcaatgaagggaacgccagaaactgggacgcg

SEQ ID NO: 1887 - DNA, 166 bp, Zea mays
  Clone ID: PAT_MRT4577_28783C.1
acacaacagcctatagtgagtcgtattaaactccgtagtagctagcgtacgtacgtgtgaccgattcagcgaggtcaccgtttgtgtgtcgatatatacggcgaagtcccagtttgttccgatggatcacgggaaacagcaaggcgccagacgacgagcggccggc

SEQ ID NO: 1888 - DNA, 521 bp, Zea mays
  Clone ID: PAT_MRT4577_28843C.1
atgaatgtgaacgttccttttttacacctatagcttcacaatttggttgcagcaacgctaacttcactattcacaagttgtttttcatttcccaaatctaacattgtttaaaccttgcgcatgtccacgacgcagcgaatgcagtctccggcgtgcatgtcgtggaaagcctcgttgatgccgccgagtggctgtcggtgtgtgatgaattcgtcgaccttgagcttgttgtccatgtaatcttgcacgagttgacccatttggctgcggcccttgacaccaccgaaagcgcatcctttccacacacggccagtgacgagttggaatggtcttgtggaaatctcctgtccggcagcagcgacaccgatgataatgctctcaccccagcccttgtggcaagcctcgagcgctgatctcatgacgtgaacgtttcctgtgcagtcgaatgtgtagtcgcatccaccatcggtcatgtcgatgagtctgctctgaatgttctcgccctccttgagatccttggc

SEQ ID NO: 1889 - DNA, 251 bp, Zea mays
  Clone ID: PAT_MRT4577_28858C.1
gaggaaaaacggggtttccccttaacttgcattggctggctggaaacaccaatcttttttttcgggtggtttataattccaaaaaaccccctccctgggttttgcaacaacgggaaaactgacacaggttggtttttttacaaaaaccccatttcttaattttgcaacagcggaaaaactgtcacaaggttgggtgcccaatttttttgtgttcaacaagggccatgcataggaatcccattattactttt

SEQ ID NO: 1890 - DNA, 334 bp, Zea mays
  UNSURE (1)..(334): unsure at all n locations
  Clone ID: PAT_MRT4577_28915C.1
  unsure (1)..(334): unsure at all n locations
cccgttctcgcattttccttctcccgcctagtttatatgcgttagctacccaatcacttcggaccggcggttctacgtgatcccaccggctgacatggatccatacatgcacgcggcgtctaacgagagcaactacagctagtggaccaccaactccggcgcccgcgtctggaacaacaactatgtcctcaccgtcggacagcgacgagcaatcctgcttgaggattatcatctaatcgaaaagctcgctcacgttcacagacaacgtatacctgaacgcgtcgtgcatgcacagngagacagcgccaatggcttctttgagggcactcatgat

SEQ ID NO: 1891 - DNA, 2211 bp, Zea mays
  Clone ID: PAT_MRT4577_29116C.1
cccgaggcaatttgagagattccctttgagaatttgtaaaaaaccacacctctggacataaacgacgtaccggccccctccgttttttttttttttttttttttttttttttttttttagtcccgaatcaatctgagagattccattagagaatataaaaaaaacacaacgctggacatcaacgacaatgactgactgactgaccgaccgaccacgagctttaagagttctaattaaaatgacttgagacagacacacactacatccatcaagttctaattaaaatgggctaagcaaaacgaccacgagcttttaggcctcctcgtccgcgtaggccggctccagtatggccgcctccgcctcctgcacctccttctccgtcttgcgccccttcttggacttgtagtacacgctcatgaacgtgcccaccgccccgtacttttggcggcagtgctcgtagtgcgacgcgtcgaacatgcgccagaagtccttctcgttcagctccgacaccgcgtactgcggctggtagctgtggttctcgatcagccactgctccagcctgtgcacagcctccgcgccgttgaactcctcccccctcagcaccgccccgggggcgtagtacacgcccacgtccgtgaacatctgtgcgtagctcgtgtcgccctgcctgtgctggtgctcgaacccaggctccgggtacaccatcgtcttcaccggcagcttgtacagccggtgagggcacagccacagaggatacacctccatctcgcggtgcacgaactccagcgcatccccaaccttgtacagcggcaccagcatgtcctggatcacatggttgtcgtggtagtagttcctgatagcctcgccctgggtcgccttcagcagggacaccttcggtggcatcagccagcccagcaggaacctgaaccagaactggtcgccgaagggcaggatcagcttcccctcccagtacaggcaccgggtgtgccggtggtagtactccctcgtcgggatgtactccacaaactcgcccctcttcagcgccgtctgagcgtgctggtagaaccagggcttaaaccaccaccccacgcagttgatcttgttgcccttcttcttcgcctcttctttggaagcgtacacgcccgtcatcatgacaccctcgctctctgtgtacaccatcccttcaacaaagtcagggacctttgccgggtcaccgtccctcggcgcgaaagaatccgcgtaggcctgcgcgatctcctttagaccccccttgactggagtgtaggtgagcttcatgtactccttgatggggatcagcttgatctccgcagagacaaggaaccccagtgttccctgggaccagggaatgccatagaaaaggtcagagtactcgttgtccttggtggctctgacgacccggccatctgcgagaacaacctccatcgcgacaaccgtgtcggagaaaaggccatagaggtgagagctcccctcgatgccgtaaccgttgatcagcccaccaacagtgaggtcgtcgagctcggcgacgaccgcaagggcaaggttcattgggcaggtagctctggttatctgacccatgttgacaaggggctcgaccttggcaaccatcctctctttgtcgatctcaaggatgttcctgaaggaagaaaggtcgacctcgaaatgcctcgcacgcttgtagtccacgttgcgcatgccaacagcgatccagggcttcctggccgtgcaaacaagaccgtccttcttcgggttcctctgcttgagccgcttcacgaccttctgcacgttctcgtcgtgctgcttctggcgcttcttctccgacttcatggcggaccacatgtcgcccaggaagatgttgaagtagatcagagttgaaataggaaggaccacgaagatcacgaggatccatcggaacttcaccaagtagtccaccaaaaccttcttcctcttacggcgcaccaaaggttcgtgcacgtccgccatgggtggtggttgctacggctctgatccggccggcgggcgggcgcaagggcctccttctccgcctccctaccaccagcagcagtaggcggagcggaggtgggcgagagatgcagatgctgcctgcggcttccctctttcccggcgcgggagagagggagatgctgtcaaaagcgaacaggcctcacatgcccccgtccggacgaaaagcga

SEQ ID NO: 1892 - DNA, 385 bp, Zea mays
  Clone ID: PAT_MRT4577_29121C.1
tgacgagagggggagagagagagtctaggaaggagggagagagcacgggggcttgatcgaagatggatggcggagcaaaggtggtgaaaaacgcctcggcggcgcgtggaggctggggcggtcccaaaaagaagccgggctctcgctccatgaaggcctgcctccacttccccgtacgccgtatcggacgatacctcaagcacggtcgctactaccagcgtgtccgcacccgcgcccgcgtatacctcgctgccgtacttgaatacctcggcgacgagctcctcgagttggcggcgaacgcaacgcgggacaacaagaagaaccggatcatgccgcgacacatactgatggcgatccgcaccgattactagctcgggaagctact

SEQ ID NO: 1893 - DNA, 1266 bp, Zea mays
  UNSURE (1)..(1266): unsure at all n locations
  Clone ID: PAT_MRT4577_29151C.1
  unsure (1)..(1266): unsure at all n locations
tgggtncnncctcgaggcctggccggaaaaaaaaaaaaaaaaaaaaaaaaaaaaaaaaaaaaaaaaaaaaatcacccgcgtccgccaccgccgccgcctttcgtaccgcggcccctaaacccctttcctcgttcccctccgtctctcagttaggcacaatgatgctagctaataagcttgggggtctgctcaagaatgctacgagttcaaatatgtctgtgtaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgggaggaccgaccaagcaagcagctgcatgtcatccaagctcttcggtggttggtatggtggtggtgggacggtggctatggtggtggtgggggctatggtggtggtgagagaatagagggtaaaatacggtggcggcgactatggtggcaaccgcaacaggggtggtggtggtgattatggagttgctggtggnaggtggaggcacctttactgctggaggtagcgacagctttgccaacagtaactnttggttctgacagtagttttgggggaaacggtgctggtggctttgatgcaaccggcggttccacaggcgatgatgggttctctggcacacctgatgataactttggtggtaacaagaatgaagaaaccatggatgatatcttcaaggacgatgagccggacagctacgccgacaagaggagctagtttgtgccctctccaaagagtgctcatcaatacgattccagaacgatatgtattggctagtgtttgctgttaacatcatagcggcctgtatgttcaaataatggagcgagtatttctgatgagtttgagttgtcgggggctgtggaactttcaaacatggcgatacgttataatgtcgttttgctagatgctatgctttcatcgtggcttggaaatcggggtcttgtcaagtttcagctcacagacggatctgtaaatggtactgaaccctacaaaaaaaaaaaaaaaaaaggcccctagggccgtgacaaaaaagcagtaaaaatgaagtgtgaaagtttaatttcagt

SEQ ID NO: 1894 - DNA, 1272 bp, Zea mays
  UNSURE (1)..(1272): unsure at all n locations
  Clone ID: PAT_MRT4577_29152C.1
  unsure (1)..(1272): unsure at all n locations
ccggccgggtacctcgcgtccgcccccgccgccgcctttcgtccagcccctaaacattctcattcctctcatagctcggtgcttacggcttgcctggatccctgcgaggtggacctttttggtctgtgtcgctcggcttcgtgtctccgaacttctacgatggtttagcacaatgatgctagctaataagcttggtggtctgctcaagaatgctacgagttcaaagcaaatatgtctgtctaccaagcaatcagatgcatgtcatcatccaagctctttgttggagggatttcttatggaactgatgatcacagtctcagagacgagtttgccaaatatgggcaagtcattgaagctaagattatccttgaccgtgagtctgggaggtctagaggttttggctttgtaacttacacgtcttctgaggaggctgcagctgccattactgccttggatggaaagactctcgatggacggagcatacggattaatcatgctaacgagaagacaggtggcttccgtggcggcggtggctatggtggcggcggctatggtggtggtggaggctatggtggtggtggcggccactatggtggtggtggtggcagcggtggatacggtggcggcgactatggtggcaactacagcaacaggggcggtggtgatgattatgaagttgctggtggaggtggaggcacctttactgctggaggtagcgacagctttgccaacagtaactttggttctgacagtagttttggtggaaacggtgctggtggctttgatgcaaccggcggttccacaggcgatgatgggttctctggcacacctgatgataactttggtggtaacaagaatgaagaagccatggatgatatcttcaaggacgatgagccggacagctacgccgacaagaggagctagtttgtgccttctccaaagagtgctcatcaatacgattccagaacgatatgtattggctagtgtttgctgttaacatcatagcggcctgtatgttcaaataatggagcgagtatttctgatgagtttgagttgtcgggggctgtggaactttcaaacatggcgtgcatccacgttataatgtcgttttgctagatgctatgctttcatcgtggcttggaaatcggggtcttgtcaagcttcagctcagacggatctgtaaatggtactgaaccctacattttatgttttctgtggatgctctgcgtatgtgacnnnnnnnnnnnnnnnnnnnnnngtgagtttatttca

SEQ ID NO: 1895 - DNA, 513 bp, Zea mays
  Clone ID: PAT_MRT4577_29288C.1
cgaatgtcttttggttcttgcggaagcaggtcctgatgggatcgtttttgaaacaattcccaacaaattggaagctcaggcttacgttgaacttcttgacgaatgtaacatcagtatccctgcatggttctcatttaattcaaaagatggagttcacattgtgagtggagactcgttaattgaatgtgctactattgctaatgggtgttcgaaggttggtgcagttggaataaattgcacacctccaagatttatccatggcctgatactcttcattcgaaaggtcacagataagccaattctgatatattccaacagcggagaaagatatgatgctgagaaaaaggagtgggtggaatcaactggcgtgtcagacggtgattttgtttcctacgtaaacgaatggtgcaaagatggggctgtcctcattggcggctgctgcaggacaacttcaaacaccatcaaggccattagtagatcacttaaccaacgccactcttcgttgatttacct

SEQ ID NO: 1896 - DNA, 348 bp, Zea mays
  Clone ID: PAT_MRT4577_29321C.1
aggacgcgtgggactagttttagatcgctgcgcatgtaaaactagggcatcggcgcaagccgttcggcttgcccttcacgaacgcttggtccttcttcttgtatgtccactgcgacctttacagatccgctcctccagctagggttagcggtcctctgaagcgatggcgatcaagccgaccatggcggttgaacaagatcgggtacgacaagaagctgcgcagtctgctcgatgagtacaccaaggtgctcatagccctcgccgacaacgttggatccaagcaggtccataacatccggccgggccttatggacgactcggtggtgctcatggggaagaacacgctca

SEQ ID NO: 1897 - DNA, 331 bp, Zea mays
  Clone ID: PAT_MRT4577_29410C.1
gtcacccctgactgctcgacgacctctgcgtcctatcctaccccacccgtccatcgccccctccctccggtctgcgctcccacagcctcacctctgcgccccggtcgattcgcgtcgccactcgttggaaggaacgatggagcagaccttcatcatgatcaagcccgacggcgttcagctgagcctgatcgcggacatcatcagtctgcttactgaagaaagggttctaccttaaggggatgaagatcatgaacgtggagaggagcttcacgcaacaacagtacgctgacttggccgacaacgcctgtctttcgcgggttggtggagaaca

SEQ ID NO: 1898 - DNA, 380 bp, Zea mays
  Clone ID: PAT_MRT4577_29677C.1
cagctagcagcatacaaagcacactagtgtaccagcactggctgccgggccatattgcctgcatatgctcctcggtctaatctgcaagtgctgctacagcgaccatgttcccgcagtgcatcgcaagctcctatagctgcccttcgtgccccgtacctctcaccagcggagtcgttatctatgtgaaaacccagttgttgaaccctacaggatccatcacgcggtcacagctgtgcatattacctttatcacccttgttgctccgacaatcatcagtcctattacatcagttgcctttggtgcattgattggctcatatcatcaaggcacagcaactacgacatcttgtgctagcaaaccttgctgcctactgtcaagaa

SEQ ID NO: 1899 - DNA, 579 bp, Zea mays
  Clone ID: PAT_MRT4577_29685C.1
gagtgtgaagacgccgtcgctgtcatcgtccatagccaccgcacgagactgagatgcggagctttggcaagacccacaagagcaatggatacttcaagctttccaggagaagttcacgagaaggcgcgctggcaagacagactacaggttcaggataaggctgattaacctggacaaaaacaagtacaatacaccctaatacggatttgctgcgcgatttaccagacaaggacatcacagcacaaatcatctctgctagtatagcacgcgatatggctcttgcttctgcttactcgcatgaggtgccacgatatggtcttgaagttggactgaccaactatgcagctgcctactgtactgggcttctgatggctcgccgcgtgctcgagacccgtgggttagataaggaatatgagcgttatgttgaggacactggagaggatttctctgttgagccaactgatgagaggatgcctttccgtgctctcttgaatgatgatctgattaggactacgactgacaagcgtgactttgtggccctcaagggatgtttggatggaggtctgggtatttgtcaca

SEQ ID NO: 1900 - DNA, 871 bp, Zea mays
  Clone ID: PAT_MRT4577_29912C.1
cggccgctcaggcggcgggcgggagtctctccccgtactcccaacccacgctccaaatagccccttggagcgggggatctgctctgctctcctcctcctcctccttccctcctgaagtcagcctccagccatggcggatctgcagacgccgctggtgcgaccaaagaggaagaaggttctggtggactacctggtgcagttccgatggatcctcgtcatcttcgtggtgcttccggcctcggcgctcatctacttcaacatctacctgggcgacatgtggtccgccatgaagtcggagaagaagcggcagaaggagcacgaggacaacgtgcagaaggtcgtgaagcggctcaagcagcgcaaccccaagaaggacggcctcgtctgcacggccaggaagccgtggatcgccgtcggcatgcgcaacgtcgactacaagcgtgtcaggcacttcgaggtcgacctctctgccttcaggaacatccttgagatcgaccccgagaggatggtcgccaaggtcgagccgctcgtcaacatgggccagatatccagggccacctgccccatgaacctctccctcgccgtggtggcggagctcgacgacctcaccgtcggcggcctcatcaacggctacggcatcgaggggagctctcacatctacgggctcttctccgacacggtggtcgcgctggagatcgtcctggctgacggccgggtcgtccgagccaccaaggacaacgagtactccgacctcttctacggcgtgccctggtcgcagggcactctcgggttccttgtttcagctgagatcaagctcatccccatcagggagtacatgaggctcacctacaccccggtgaagggccccctg

SEQ ID NO: 1901 - DNA, 1802 bp, Zea mays
  Clone ID: PAT_MRT4577_29971C.1
ctcgaggccggccgggagctagcagcgtccctgctgctccgcgccacacctctccgcttcattcctatccgtctcccctgctctatcgtcgtcctcctccgtcgggccggaggagcgtctctttgtcggcgcagcgtgcagagcaccgcagattcagagacacgatgatgtcgcgacagtgtgcaaaccgcatctttcttaccggaggttccagcttcctccatggcctcaaatctagagttgcatccagtaggagtcacggcaccgtcagactcaactggcgctgcgtgagaactaatctctggagggccgagcgccttggtgtcaaggctactccgtctgagcatatcattgcagtactgcaagcgtcagatattttcagtggcatcaggaaatggagcaagttgcaattggtcgccatgacaggggtgatggcatgtgtagttctggtagtcccttcttctgatgcagtcgatgctctcaagacatgcacttgcctgctaaaggaatgcagaatagagctggctaaatgcatagcgaacccatcctgtgcagcaaacgtagcatgcttgaacacgtgcaacaatcgacctgatgaaactgaatgtcagataaaatgcggagacctgtttgagaacagtgtagtcgatgaattcaatgattgtgctgtttcacgcaagaaatgtgttccaaaaaaatccgacgtcggcgagttccccgtccccgatccatcttcgctggttaagagcttcaacatggcagattttaatggcaaatggtacatttcaagtggcttaaacccgacgtttgacacattcgattgtcagcttcacgagtttcatgtcgagggagacaaattgatcgcgaacatcacatggagagtccgcaccccagactctggcttctttaccaggtcaaccgtgcagcgttttgtgcaggacccatcgcagcccggcatactctacaaccatgacaatgagttcctgcactatcaagatgactggtacattatctcatccaaggttgagaacaaggatgacgactacatatttgtgtactatcgtgggcgaaatgacgcatgggatggttatggtggttctgtattgtacacaagaagtaaaactgtacctgaaacaataataccggagctggaaagagctgcaaagagcgtaggtcgggacttctcgacgttcatcatgaccgacaacacctgtggtcctgagcctcctcttgtggagagaatcgagaaaactgtggtggaaggagagaagaccatcgtcagggaggtgaaggagatcgaggaggaggttgaggagctggagaaggaggaggcgtcactgtttcagaagctggcagaaggtctcatggaggtgaaacaggatttcatgaacttcttgcaggggctgagcaaggaggagatggagctgttggatcagctcaacatggaagcgactgaagttgagcaagtcttcagccgtgcactaccgttgaggaagctaaggtagctgcagagcaaaggacttggagaaaacaagccatcaagtactggccgaaacggattctatttgccacagcagtacccacagtagagattgttgaacagatacaacaaacatttttaattttcttttctttttcttttcttttcttttcttttctttgtttacccttttctgtggtcaaaacacatgcctacgttagccctatttgtaaagcatcaagagacaacgtaactttttcttgccaaacagagaaaaaaaacaagtgtacttaagactaaaaaaaaaaaaaaaaaagcggcc

SEQ ID NO: 1902 - DNA, 327 bp, Zea mays
  UNSURE (1)..(327): unsure at all n locations
  Clone ID: PAT_MRT4577_29996C.1
  unsure (1)..(327): unsure at all n locations
gttggcttgatcttgccatgcccgacgaactcgaatcggtcaggctgcgcggccccgcgcgctggcggcggcgacggcatcctcgatatcgcgtgggccttcgacggaatgatcttcatcctcgactactgcaccgccggcatctcaggtgtgcacatcaacccgtccgtgaccttcggcctgttcctggccaggaaggtgtccctcgtccgcgcgctgctctacatcgtggcgcagtgcctgggcgccatctgcggcgtgtgcctcgtcaagggcttgcagagcgcctactacgtgcgctacggctgcnggcgcaacgagctcagc

SEQ ID NO: 1903 - DNA, 745 bp, Zea mays
  Clone ID: PAT_MRT4577_30206C.1
tgccccaacccatgtattaccagggtgtatttgcttcaacggcgtatacacaaatgcatacagaacaagattagaagctgcaagcccagctgccaagccattagccttccaggccaacaaagctgttcctgcaactccaacacttgtagcccacatcgcagcatgtgcaggactaatgcgaccagatggcagggggcgtcgcattgtccttttcattttagcatcattttttatctcaaacacctggttgagggtatttgcagatgctgcaaccatcattgtaccggcacatgtgcaacaaaggccggcaatgtccacgatgttgccactaccaagcacatagccagcccccgaagttgccacaacaagagcactgaggcgggctttcgagagctcccagtagcacttcccgtagtgccgcagcgagtcggagatggatccggtatgctgagaaacggataccgctgccgctgcttcttccacgatggtgttcgccgcggcggtagacggggtggaagaggaggaggtacgcgccgaagcgattggagcgagcgacgtggccgggtggtggatggggtcgaggaggaggcgcgagcggagagccctcgcggcggaggcggctgtagagccgcccctccacatggcggctgcaggtgcgggcggcggcagcgacgaaacccggtggtggccggtgggaatggaaacacggcgtgtgacgcccggccggtcccgacctaccccgagg

SEQ ID NO: 1904 - DNA, 2402 bp, Zea mays
  Clone ID: PAT_MRT4577_30207C.1
ccagcaggctacatatttacgatagtcaagttcactgttacaaaatataatatacatcaaagtcgttataggttactggttacataaatgtatgagcaccacagtttgcagccttgtagcatgaatatagaaggaccaaaataacatgcgatgcgatccgcaaacgcaaaatacacaagagcgggttgtggttgtgcagtcactgactacggttagacctagggggtaacagcacgcactggcaaagcatcctttcttccatcatttatatttcaggacatcgaattttacttgaaaagcgtaatgtttcgggacatcagcacatccgtgtcgattgaatcatcagaatgaacatcaacagcactttttacatttgtaggtgagccgcaaaaggctcaatccacacacacacaaaaagtattctataattttaacaacagatgcaccataccaaggactcttcttgatggcagaaaactcatgtaagccaaaaatgcatgaatacattgctccaactaccccacggctgcaggaagaaccagaggaggttttcaacttttcatgactcgtatatgggtaccggtaggaaagggaatggagccacagaagcataggaaactggagggcgtgattgcacacgagcgtgtcttggcgtttctgtcttgctctttcttcgtcctgcagatcagccccacagaactccgtccagctcatttttctcagccaggtcgtgcgccttgtgttcacttggtaggatgcagagagtccggacatgaaggcagggagatacagcaggctaccatagtcctcgcggtcttcgggcttggttccaggacgtcagaacaaatgaatagagctcgcgatggtaaggcctaatgttaggattgaagcttcaaaactgaaccactcggatgtgagcccccagttgtacgcaaataaccccaaaggtagcatgtacagacaatttcttagcgacacccatgcagttcttctaccggtagggtcagcaaaagaaaacattcgataccctccagcaaggtaatcatttcgacataagtacgcgagagccataaaatgaggtatttgccaaaagtacaatgcggcagggagtatcatcgcgtttagtgacagttcagttgaagctgctgcccaccccagaagtggtgggatggcaccaacgactgccccaacccatgtattaacagggtgtatttgcttcaacggcgtatacacaaatgcgtacagaacaagattagaagctgcaagcccagctgccaagccattagccttccaggccaacaaagctgttcctgcaactccaacacttgtagcccacattgcagcatgtgcaggactgatgcgaccagatggcaggggacgtcgcattgtccttttcattttagcatcattttttatctcaaacacctggttgagggtatttgcagatgctgcaaccatcattgtaccagcacatgtgcaacaaagtccagcaatatccacgatgttgccactaccaagcacataaccagcccccgaagttgccacaacaagagcactgaggcggactttcgagagctcccggtagcacttcccatagtgccgtagcgcgtcggagatggatccggtatgctgcgaaacggatacagccgccaccgccgccgcttcttccacgatggtgttcgccgcggcagtggacgaggtggaagaggaagaggtacgcgccgaagaaataggagcgagcgacgtgaccgggtggtggatggggtcgaggaggaggcgcgagcggagggccctagcgacgaaggcggtggtggcgccgcccctccacatggcggctgcaggtgcgggctgcggcgacgacgaggcacggtgggtggccgactggcccggtgggaatgggctcccggccggcccgcccagcgagcttacgtacgcgtgcatgcgacaaatacctccagttgctcgtgtagccgcttctgaacttccagttgcatctttagtgcctcattgatttgcaatcctctaaacacatttcagaatatggtacataatccatgttcgagagggaatcactcaaactttcttgtcgtccttaaaacctttagcatgagagtctggtatatactttgcaaggcgatacttctacacaagcaccaaagaaatgaaaatattggctgcaatcaagcatcttgtaatgaaaatgtaatcttgtaaagtgtgtacctgttgacactgcatagaatttcaaccaaatgtgcatacatatagataaagatgcaatactccgattgtcagaagttacttgttctgtcagttttagcaacccatctgctagtgaattctgaatagattccaatgaggtttgaaactcaccagcattatttccaaaacgaacgcgtggg

SEQ ID NO: 1905 - DNA, 599 bp, Zea mays
  UNSURE (1)..(599): unsure at all n locations
  Clone ID: PAT_MRT4577_30429C.1
  unsure (1)..(599): unsure at all n locations
cttgttgccaaaraattccctyccctagccgccgccgccgcycgtctcccttadargtgccgggacccaagaactggccgagttctaggtagaraatcggttttgcttgtctcarcacggggtytkytgcntctwgtggtggtgaaggggagaaawtcgttaaawctgttccsgatcargcgtkckadctccggaatyargggtktcacacatagcttcgtcgatttgaatttkatgtactaatggagtytaaaggtggcaaaaagtctagcagtagtcgttccatgawgtatgaagctccccttggctacagcatttaggacgtkcgacctgccggaggtttaagaagttccagtcttctgcytactccaacttcyccaagaagccatcctgatatcccttttggcttcctcattctagtagtttaggatttcttttcttacactttgattcttaccaatctctcttgccttctgcytcctgaaaaacgaccagttccccartcttkctccttgcacycctccctcctccatctccagcattnttttcttattyaccttctccaattgctgttctttcttctgctgaagcktccccgg

SEQ ID NO: 1906 - DNA, 833 bp, Zea mays
  Clone ID: PAT_MRT4577_30483C.1
cattgggtacctcgaggccggccgggggacgggagaaaatctccaaacgcagcagagcccctcgcgccgccggcctcttcagcctcgcagcacaccgccgccagcccgagtgaccgctgcagcctaggtttccggcgccgatggcgggtaagggagggaagggtctgctggcggccaagacgacggcggccaagagcaccgacaaggacaaggacaggaagaaggcccccgtgtcgcgctcttcccgcgccggcctccagttcccggtgggtcgtatccaccgccagctcaagtcgcgtgcctctgcgcacggccgcgtcggcgccaccgccgccgtctattccgccgccatcctcgagtacctcaccgccgaggtcctcgagctggccggcaacgccagcaaggacctcaaggtcaagcgcatcaccccgcgccacctgcagctcgccatccgcggggacgaggagctcgacaccctcatcaagggcaccatcgccgggggcggcgtcatcccgcacatccacaagtcgctcatcaacaagaccgccaaggagtgaatcaaggccgtgctgctgcttctgcctgactacagtcccatctcgttctgtacttgtgcaatctgagtttaagtgcatgttggcacagttctagtaaactcatcctgttcacctatgcttctatcttgttaatttaagctctattccgcgagctttttggattaaaaaaaaagagattaacgggttcgtaaaattagtacgtcgaaccttgcaattggccccgattgtttggttcaaaaaataaaaaaaaaaaaaaaagcggcctcgagctccagc

SEQ ID NO: 1907 - DNA, 289 bp, Zea mays
  Clone ID: PAT_MRT4577_3049C.1
ccttctccttctccccgctagactagaggcgtttgctccccaatcccttcgggccgaccgctcgacgtgatcccaccggcagccatggatccatacaagcaccgtccgtctagtgggagcaactacagcttctggaccaccaagtgcggcgcccccgtctggaacaacaactatgccctcaccgtctgacacttgaggaccaatcctgcttgaggattatcatatactccaaaagctggctcagttcgacagagaacgtatccctgaacgtgttgtgcatgcacggcga

SEQ ID NO: 1908 - DNA, 1766 bp, Zea mays
  Clone ID: PAT_MRT4577_30592C.1
cattgggtacctcgaggccggccgggctccgtccgcccacgccgccctgccgcgcgctaccgtgaccaccgcaccaccaccacaagcgctggacgcgagcggcccagcctgccgcagcgcggatagagggataggcctcgacgccgattccgttggagctccgcgacccttggctcccagcctcactttctcgctcgccgcgctaccctaccccgcagagacacgtcccgtcccgtcccgtcccaccctgtgccagccagctcccgaccggcgcccgacccgcgggatcttgtctaatataccgtgcgcgcgggagcagcagctggttcgtcgtgcccgcgcgctctctgcactccgtgtccgtgatcaccaccacaccgctatcctgctagctaggtagctgaattcggagccaggctcgagcgagggggggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactctggaggacgtgctgcaacctggcaagaacatgctcgccgccggatactgcatgtacggcagttcctgcacgctcgttctgagcactggaactggtgtcaatggcttcacgctcgacccttcacttggggagttcatactaacccatccagacatcaagatacctaagaaggggaagatctattcagtcaacgaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttttccccatgtcgttcctaatggagcaggcaggaggccagtccttcacaggcaaagaacgggctcttgatctggtcccaaccaagatccacgacaggtccccgatattcctcggaagctacgacgacgtggaggagatcaaagcgttgtacgccgagcaggcgaagtcgagctcggcttcatcctaagtgagggtgtaaatcgacttttcctggcttaatttgttgctgttacctgatccagacattccgttttcgtttcccttggtgtcgtcgtaagtgtgacattcagtgcaatatgtatagcaactaagggactccgtaaaagttacgtacgtacatacatacatgcatctctagcgcataaaaaaaaaaaaaaaaaagcggccaaaaaaaaaaaaaaaaaaaagcggccccactgcgattatatattgtccgtttgagttccgagagtgttctgctttctgactcggg

SEQ ID NO: 1909 - DNA, 182 bp, Zea mays
  Clone ID: PAT_MRT4577_30632C.1
cctatagtgagtcgtattaaaacgcagcacatccaagtgtcagcgatagacctcagccctcatgcattgccgatcgccgacgtaccatcgcgccaacgagagagagggatggagatgatgacgaggatcctcagcggtgcgcgccgcgctgtcggcatgtcgggaaccgcggtgggggcgtc

SEQ ID NO: 1910 - DNA, 940 bp, Zea mays
  Clone ID: PAT_MRT4577_30763C.1
aggagccctatatcacggtccttgcccaccgccccccctcatcacccgcgtccgccaccgccgccgcctttcgtaccgcggcccctaaacccctttcctcgttcccctccgtctctcagttaggcacaatgatgctagctaataagcttggtggtctgctcaagaatgctacgagttcaaatatgtctgtgtaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgagaggacaggtggcttccgcagcagcggtggttatggtggtggcagctatggtggtggcggctatggtggtggtagcggtggctatggcggcggtggcagtggtgactatggtggcggcagcggtggatatggtggcaactacggcaacagggctggtggtggctatggtggtggtggtgattaatggaggtgcaggtggggtatataccagtttgtaattagcttcaaaataatgttcccctcgcctttatttgctgttcaagtccctgtaataaccgagaacgttaattgtagcagtgtgttttttatatgattaaataagtactatgttgtataaggctagtgcaactgtgcaggttactctatattcttactctatatcactatttatggtctactcatcaataaatagattggttgataatataaaaaaaccacctcccctcccagggcggccgccgacttagcgctgtcgacccaggaatt

SEQ ID NO: 1911 - DNA, 1046 bp, Zea mays
  UNSURE (1)..(1046): unsure at all n locations
  Clone ID: PAT_MRT4577_30764C.1
  unsure (1)..(1046): unsure at all n locations
cctcgaggccggccgggctctaatactttctagtgtcaagttcaacatgatacatggttgtgggtttttatttgtgcatctagtgcatatttctacgtgtgaattgagatgatcttatgtgatgtgatgatgactagattaactttcttggatattagatgatatttaagttaaactttgttgtaaaaaaaaaaaaaaaaaaaactcatcacccgcgtccgccaccgccgccgcctttcgtaccgcggcccctaaacccctttcctcgttcccctccgtctctcagttaggcacaatgatgctagctaataagcttggtggtttgctcaagaatgctacgagttcaaagagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgagaggacaggtggcttccgcagcagcggtggttatggtggtggcggctatggtggtggtggtggcggctatggtggcggtggctatggcggcggctatggtggtggtagcggtggctatggcggcggcggcagcggtgactatggtggcggcagcggtggatatggtggcaactacggcaacagggctggtggtggctatggtggtggtggtgattatggagttgcaggtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1912 - DNA, 931 bp, Zea mays
  Clone ID: PAT_MRT4577_30766C.1
cattgggtacctcgaggccggccgggaggagccctatacaccatccttgcccaccgcctcccctcatcaccagcgtccgccaccgccgccgcctttcgtaccgcggcccctaaacccctttcctcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgagaggacaggtggcttccgcagcagcggtggttatggtggtggcggctatggtggtggtggtggtggctatggtggcggtggctatggtggcggctatggtggtggtagcggtggctatggcggcggcggcagtggtgactatggtggcggcagcggtggatatggtggcaactacggctacagggctggtggtggctatggtggtggtgaggacgtaagtagcttcagaataatgttcccctgccctttatttgctgttcaagtccctgtaataacccagaacgttaattgtagcagtgtgtttttcacatgattcaataagtactatgttgtataaggctagtgcagctgtgcaggtgactcgatattcttcctctatatcccaatttgtagtcgcctcatcaattaataaatagcattgcttgataataaaacgttagaaaaaaaagaaa

SEQ ID NO: 1913 - DNA, 285 bp, Zea mays
  Clone ID: PAT_MRT4577_30805C.1
cattggtcaaagatttcaacatcatcgccatcaagggactgggaaaatttgccagacctgcagggcaacagtttttttttacttggagctacagggattaagagtaaggctaacagtaacccctttagggggagggggcccaggggaaaattccaacaatgagacaaaaaaacagcagtgcaattaggcggttagcgcacaatacacatgaactggggatttggcaggagttttttgagatgtccacgggcgggcgtatatttctgctgggattgggggggccct

SEQ ID NO: 1914 - DNA, 607 bp, Zea mays
  Clone ID: PAT_MRT4577_30807C.1
caccccatccattcactcgccttgcgcttcctcgccgccccagttccccacccactgatcacccacccgacccctcctgctcacccatgactcccatcgctgacggcgacgccctccccgacgaccagctcgggtggttcgacgagaaccaccatctggagcatgtctccgtccacgcgcgtcgctcccggcaagaaggccatcctcttcggcgtccccgggagccttcaccccgacctgaagcaaccagaatgtgcgaggcttcatcacacaggctgaccagctatgaggcaatgctgtatacgagatcctgcttatcagggcataacgaccccttcaccatgaaagcgtgggcgaagcaccataccccgagaactagcacgtgaagatcactcccgacgggtctggagcgtacaccaaggcgctcgacctcgaggtcgatctcacggacaaacgtctgaccgtgccctcgaagaggatgggtctcctgggcgatgtctcacggtcacggcggcaaacatcgaggaaggcgggtagttcacgatctccggcgctgtggagatactgaaggagctttagaagctcggtctctgctagaaggcgtagc

SEQ ID NO: 1915 - DNA, 120 bp, Zea mays
  Clone ID: PAT_MRT4577_30836C.1
ggcagatgaaggatattacgtacacaagcgccgactagaactagacccaagtcggttacttcgtatatcactcaatagcggctagagcgtatatgcatggttgttgtagactgctcgtaa

SEQ ID NO: 1916 - DNA, 270 bp, Zea mays
  UNSURE (1)..(270): unsure at all n locations
  Clone ID: PAT_MRT4577_3100C.1
  unsure (1)..(270): unsure at all n locations
cggacntggggantggncnanaananacggcaaacgcgaccacagacagagcgcgttcaaaggctttttttnntgagantacacnggagganactgtgagatggcggtcacgatcacctgggtgaaggcgaggcagatcttcgacagccgcggcaaccccaccgtcgaggtggacgtgggcctcagcgacggcagctacgcnaggggggccgtacccagcggcgcatccactggaatatatgaggccttggagttgagggatggaggatc

SEQ ID NO: 1917 - DNA, 316 bp, Zea mays
  Clone ID: PAT_MRT4577_3101C.1
ggttggggtttttttttgtgggggaaaaatgcaggggtaaaacttgttttttcttttcttgaaaaccttggctggcatttaactaattcaaaatttggaaaacaaaaaagagggggggggttgctaccggctcaaaccttgtttgacaaacagcaccttgaattcctccagagctgtttcagtcccccctaaacgctggggaaacccgacatgggcatttgcttcttaaaaatgaacccacacattttggggggggcaattttttttttttacaagcaattttgtcgcaccttttttttttcatcatcatggggaa

SEQ ID NO: 1918 - DNA, 414 bp, Zea mays
  Clone ID: PAT_MRT4577_31081C.1
agaaatgtactttcttatttctgggaagccacaaacatcagacaaaaaactttattattgaactataactcataagaaatctaaaagagggccccacccatgatgggttgttggtaaaacactgctaggtttgtcaaaacaaggtggttgaatggcagcaattgttgcagttgtaagaaggtgcccacgttaggccccgcgtgctggtaaaaccgcaaccactggggttgggtcaagaaggtaacagggcttacaccaacttacttgcttaatggtagtagttggtggtggttgaaataaaccggaaaattcaatgcttgccattgggtgaatggaaaaaattggtggggggtagccaccaggtagctgcttaatgggaattggtggtggtgccaattaaaaaccaaattcaat

SEQ ID NO: 1919 - DNA, 1401 bp, Zea mays
  Clone ID: PAT_MRT4577_31087C.1
cacgcccgcgcccactcacgcccggccctgccccgcgccctcatcgtctcctcccggcctcccctcaaagcccaccgccgctgcccccacgccacccaccccacccccccgcccctaccgcgcggtgcccgagacccagaggccagacccctttcttcacctccttcccatcgcaatcgcaagcccccggctccggcgctcggcggtcggccaggttcgggagatcacttcgtcgcggcgaggagggagggggtcgccgttagcgcgcggcacttggatgagaagggcagcggtggaggaggatgcggaaggcgtacagggactccatcaaggtgctcgaagctgacatccagcacgccaacaccctggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacaacaaccatgtcgactcatgagaggaaagccagcatcaaagaattctatgctgtgatatttccttctttgctgcaactgcaaagggggatcactgatgtcgaggacaagaagcagaaggccgtatgcatggagaagtacagaaagaaagatgaggatggacgggacaccttatctgatattgatgttgagagggaagaggagtgtgggatttgcatggagatgaacagcaaagttgtgttgcccaactgcacccatgctatgtgtatcagatgttaccaggactggagttcaagatcgcagtcctgcccattctgccgtgacaacctgaagaagacctgtcctagtgacctgtggatctatgttgaggaccaagatgtggttgacatggagacggtgtcgagcgagaacctcagacggctgttcatgtacataagcaagctgcctctgattgtcccagacgtcatcttcagcgtgtatgattcccacatcaaatgacttccgacgcgaccttcccgacgaccttcagccagtgcccagctccagttaatcttatgcccccatgtcctccattttcatgctttgctcaagcttttggaagtgcctgaactgatttggaaccgcaagccttccggtggtgctttagaaacttgtttagtgcctgcatgcatccttaatcatatgcagccactctgtacatatctgacttggctcagttaataggggactgtgcttgccccaaatggaggcagggccgtttgtgtctttctcatgtttccattagcgaagcaacgcaaagttctggggggcaaaaaaaaaaaaaaaaaaacacaaaaacattggaaggtttcaaaaaaaaacccaaccc

SEQ ID NO: 1920 - DNA, 191 bp, Zea mays
  Clone ID: PAT_MRT4577_31117C.1
tgaaggtctgcagcagctggttgtcgtacttgcagtactgggggtctggggctactgcttattccgatacacctgcgggaagaacttctacacgaacgggttcatggacgtcacgcctccttacatacccattttatatacgcagatgacaccggctttgccaccaacccccactcttatcctactcagca

SEQ ID NO: 1921 - DNA, 321 bp, Zea mays
  Clone ID: PAT_MRT4577_31126C.1
ctggcttctactcccctttttactcaagtactcctcgggttagggctccttagggttatgtggaggggcgatggccgcagctgatgtcgagtaccgttgcttattcagcggccttgcctggggcaccagcaacgagtacctggtgaatgccttggactcctacggcgagatcctcaacttcaaggccattatcaaccggaacacagagaggtatggcggctatagctatattaccttctcctgcaagaactccatgctcgacgctatcgagaacatgaacagcatggagctcgactgccgctacattaccgataaccaggc

SEQ ID NO: 1922 - DNA, 406 bp, Zea mays
  Clone ID: PAT_MRT4577_31337C.1
aaaaatgttctttcttatttttggggagccacaaacatcagataaaaaactttatttttgaactttaactcataaaaaatttaaaagagggcaccaccaatgatgggttgttggtagaacactgctgggtttgtcaaaacaagttggttgaatggcaacaattgttgcagttgtaaaagggtgccaacgttaggcgcaaccggctggtagaacggcaacaactggggttgtgtcaaaaaggtaacagggctcacaccaactagctggctgaatgggagtagttgttgcttctgttaataaaccggaaagttcaaagcctctagttggttgaatggaaaaaattccttggggttggcagcaagtccctggctgaatgggaattttgttgtttccaataaaaaacaga

SEQ ID NO: 1923 - DNA, 1329 bp, Zea mays
  Clone ID: PAT_MRT4577_31410C.1
attcgcttctccgtcaacttcacttcctcgtcgacgcctccgtcccaccaaccatgccggcggccatggcggctgcggcggcgcagaggctcctcgcggcgagcacgaaaatcatcggcgttgggcgcaactacatagcccacgccaaggagctcggcaatccggtccccaaggagcccgtcctgttcctgaagccgacctcgtcgtttctccacgctggtgtggccaccgccgccgtcgagatcccggagccgctcgagtcgctacaccacgaggtcgagctcgccgtcgtcatctcccggcgcgggcgcgacgttcccgaggcgtccgccatggactttgttggaggttatgcacttgctttggacatgacagcaagggaccttcagtctgttgctaagtctgcaggccttccatggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatactaacaggtactcctgagggtgtgggtcctgtccgagtaggtcagaagattacagctggtataactgacctaattgatgttgagttcgatgttcagaggcgcaatcggtcattttccacatgatgcaataagcaagaaagtaatggtgaatacaaagtgcagtactcgtcctcgaccttgaatcgcattactggacctggagccattgcagatagctcttgagccttaccttgatttaatttacctgggttttgagagactatctatgaatatgctaactcgttcgtaaacagcgacttgaaacagcttccgagtggggtgcacggccgatctatgtaacgtacgcgcataagaaatggtgtcctacaaaatgccttccacttgcttgaaacgatatgtagatggacagcgacgacgaacaccttaactccctctcgctagatatcgagccagcttagttcggttcgactgagcttgagctgactcgttaaggtaaagagatgacttggttcgttaaacaattgagtcagagaattagcttggctcgtttgcaagtttgggctggctcgtttacctcgcgagtaaaaaaatacatgtatatataaaatagtatagtcaattgctagttaattttatacaaatttaacattagaaaagagtaattatactcataatttcatatatattacatcttttaaaccct

SEQ ID NO: 1924 - DNA, 1075 bp, Zea mays
  Clone ID: PAT_MRT4577_31412C.1
cattgggtacctcgaggccggccgggccggaggcgaaaagaaccaactttcttctccgtcacctgactcacacctccactcacctccggtccaccaacctctgccggccatggcggctgcggcggcgcagaagctcctcgaggcgagcacgaagatcatcggcgtcgggcgcaactacatcgcccacgccgaggagctcggcaacccgatccccaaggagcccgtactattcctgaagccgacctcgtcgttcctccacgctggcgtggccaccgccgccgtcgagatcccggagccgctcgaatcgctacaccacgaagtcgagctcgccgtcgtcatctcccggcgtgggcgtgacattcctgaagcgtccgccatggacttcgtcggaggctatgcacttgctttggacatgacagcaaggggccttcaatctgttgctaagtctgcaggccttccatggactttggctaaagggcaagacaccttcactccaattagtgcagtagttccaaaatcatctgtcactaatcccgacgatctcgagctatggctaaaggtagatgatgaactaaggcagaaaggatcgacaagtgacatgatattcaagatcccttttctgatcagctatatcagctccatcatgacattaatggagggtgatgtgatactaacaggtactcctgagggtgtgggtcctgtgcgagtaggtcagaagatcaaagctggtataactgacctaattgatgtcgagttcgatgttcagaggcgcaaccggtcattttccacatgattcaataagcaagaaagtaacggtcaaccgcttgaagattgctgctcgtgtcacgcgttcctcttgggtattcattcttccttgcgttgcagcgagattgcttcggcccatgagatgcgagtttagcctgtgcccactcatggcttaagcaaaatacctactggccaatgttgtatacttgtactggtgatatattactatgtaaaatagaaacaaaagttttgtttttcaggtttttataaaccgaaattttaagataatttaaggcacttgttagccgtc

SEQ ID NO: 1925 - DNA, 1471 bp, Zea mays
  Clone ID: PAT_MRT4577_31418C.1
attgggtacctcgcggccggccgggcggctcaatcacctcattttcttaaaaaaaatctcaatcgcaacaacacaaaaaaggcccgcaatatcgattagcgagagtcgttcctccaccaaaccaattcgcttctccgtcaacttcacttcctcgtcgacgcctccggcccaccaaccatgccggcggccatggcggctgcggcggcgcagaggctcctcgcggcgagcacgaaaatcatcggcgttgggcgcaactacatagcccacgccaaggagctcggcaatccggtccccaaggagcccgtcctgttcctgaagccgacctcgtcgtttctccacgctggtgtggccaccgccgccgtcgagatcccggagccgctcgagtcgctacaccacgaggtcgagctcgccgtcgtcatctcccggcgcgggcgcgacgttcccgaggcgtccgccatggactttgttggaggttatgcacttgctttggacatgacagcaagggaccttcagtctgttgctaagtctgcaggccttccatggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatactaacaggtactcctgagggtgtgggtcctgtccgagtaggtcagaagattacagctggtataactgacctaattgatgttgagttcgatgttcagaggcgcaatcggtcattttccacatgatgcaataagcaagaaagtaatggtgaatacaaagtgcagtactcgtcctcgaccttgaatcgcattactggacctggagccattgcagatagctcttgagccttaccttgatttaatttacctgggttttgagagactatctatgaatatgctaactcgttcgtaaagtatctttttgtcccaattttgattgatggagctttaagcttgcttttctgtatgcaataaaaaaacttatcacatttttctttcaaaaaaaaaaaaaaaaaaagcggccccgcttgaagattgctgctcgtgtcacgcgttcctcttgggtattcattcttccttgcgttgcagcgagattgcttcggcccatgagatgcgagtttagcctgtgcccccgcatggcttaagcaaaatacctgctggccaatgttgtatacttgtactggtgatatattactgtgtaaaatagaaaaaaagttttgtttttcaggtttttataaaccgtatcaaataattccaggccacttgttagccgtctccctttacagccatctgtcttgtcaccttttgtgagaaggttccttgtcaataaacaaataattcccct

SEQ ID NO: 1926 - DNA, 603 bp, Zea mays
  UNSURE (1)..(603): unsure at all n locations
  Clone ID: PAT_MRT4577_31447C.1
  unsure (1)..(603): unsure at all n locations
cagccagtgncaaaagaagtgacgaattccccgcagccagtaaaagaaagctgcaggnaagggggtcaaactaaaccaagggnaaatgttataactccgcgagtgaagccagagatcaacacacactcagcacccattctggcaggcaacttaccggatccgtccgagagatcttggcaaacgaagccatcttcagccaaactttcgtacaagcttccaatgccagttgatgacaaggatcccagatctgcaggtgctcagagaccacatcattcacagcagctggagagtaagcctcgtgtctcagcgaatccgtggcattcgtctccactgacgaaagacttcaggccgggtggccacgtgaaaacgccaccaagtgcggagggggcctcggcgttctcccagccggtctctgatttcaagaagatgaagaggcagttctattctggtccaatggcaagcggaccagggttaagcatgccatcttcgctgaacgatcgcagatcatccgcggcacaagcacagcatcttgtgatgccaggaaatttgcaaggcctcttctggcagccgtcatctgcgtccccaaaagttccccccaagatg

SEQ ID NO: 1927 - DNA, 349 bp, Zea mays
  Clone ID: PAT_MRT4577_31461C.1
attgagaccaactagcaacatagattgctctttcgtgtaccaacaatggccggggagagattttgcttccttatgctccttggtctttctgcaagtgctggtaccgcaaccatttttccacaatgctcacaagcttctatagcttcctttcttgccccatacctgtcaccagcggcgtcttcagcatgtgaaaacccaattcttcaaccgtacatgatccaacaggcaatcgtagcaggcatgttacatctatcaccctcggtccttctacaaccgtcagccctattacagcagttacctttggtgcatttttttgcacaaaacatgaatgcgcatcatctacaaccac

SEQ ID NO: 1928 - DNA, 352 bp, Zea mays
  Clone ID: PAT_MRT4577_31624C.1
cggacgcgtgggaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaaaaattggggggggcctttttaaagaatcaaagttaactaccccttgcttgcaacttataactttttttttaggggaactaaaataaatttaattgccggcggtttaaaaacgtcggaattggaaaaaccttgccttaaccaaattaaatggcttggaaaaaaatccccttttggcaagttgggttattacaaaaaaggcccgaacgaatcgcctttccaaaaatttgcca

SEQ ID NO: 1929 - DNA, 2400 bp, Zea mays
  Clone ID: PAT_MRT4577_31653C.1
cctcgaggccggccgggggcccatttctaccaccaggcccgaggcccgaggtccgaggcccgagctcccttctcttacggtctctcctcctcgtctgtgactgtgcgccggcgccgccatcgcccgtcgaccagcgccgtccgcccgctcgaaaactgagacgcacgcgccgacggcacgctgcccgcgcatcgccgtggcctgctccagtctgtggaaaagtgacgaaccaactcggggaattctagtctcgaggccgccacctccgtctccgcctccgcctccagccctccaccgacttaactgtctggaactggaagtgtaccactactattcaattggccctagccctcgcatagcacgatgccgccgccgctgcttgagttcgcgatcctcgccactgcctgcaggttcagcaagccccttaccgttctcaggaggcttggcgttcttggcccaccaaccgttcgacgcaatgccgcagaggcgttcgtgccttcaccgtttcgccaggttgtcgttcagagtggaaagcttcttgggacaccaaggttctgccacaccactgccggcatgtcagaatgtctcccggacgtctacgccagtcaggtactgaaggttctcaagtccaccagtgctgacaacgcggatctcagcggtgctcttcatcagttcgcggtccacatggatgaggatattatcctcatggtcctccagaagcagcggtccaactggcaggtcgccctggcattcttcaactgggcggcaacccctgccggggtatgcccacgggtcaagggcctacaccgagatgctggacattcttgggcggatgaagaaggtcagacacatgaggcagctgtttgacgagattcctgaggagcgacgtcaggtggtcgtgacgaataagatgtttgccgtgctgttgaaccggtacgctggtgcgcacaaggtgcaggaggcgatagaggtgttctacttgaggaaggattacgggtttgagcttgacttggtcgggttccagatactactgatgtcgctgtgcaggtataagcatgtcgaggaggcggaggcgctgttccgtgagaagaaagatgagttcccgcatgtcacaaagagctggaacattatactaaatggttggtgtgtcaagggaagcctgagggacgctcaaaggatttggaatgatatcattgcatctaaggttgaacgagacctattcacctttggtacgttcataaacgcattggccaaaaatggcagaattagtgccgcggtgaagctgttcaaacagatgtgggagaaagggatcaatcctgatgttgcgatttgcaattgtatcatcgaccagctgtgcttcaagaaaaagattccagaagcacttgagatttttggtgagatgaatgaccggctttgtcaagccgatgtggctacctacaacactttgataaaatacatgtgtaagataaaaaggatggagaaagtttatgaacttttggatgacatggaagcaaagggctgccctccaaacaataggacatactcctacattctgaagacgactgagaaacccaaagatgtcattgccttgatgcagaggatggagcgaaccggctgcaaattggattctgatatatacaacttgatattgaacctttatatcaaatggaaatatgagaaggggatgcaacagatatgggatgagatggagagaagagggtcaggcccagatcagcggtcgtttactattatggttcatggtcttcattcccaaggcaagctcgatgaggctctgcagtattacacaacaatgaagtctagagggatgattccagaacctaggaccaagatactggtgaaagctatgcacatgaagaaggacggggctgccactgaagatgactcggcaagtatggcagggaagcatctaaaattggatcatcgttcaagactattcaatgttcatagatagtctgcttccaggtctttgttctataatctgagcaggggatgctgtccatataggtttatgggttgaaagaaagaaaaacagttcttttttctatgggtgtctaaatcacaatggctgcaccttgggctaaaaagaatcatcagcatagattcattggcaatatgatttctcagtaacttttgctcagactttcagtgccaggatcatcagtcagctgtgaaaacgttttcctagcaggtgaaattgggagttcaaggtgcgtaccgatatccaaatttatttaatgtgttgcgcaagaaacaaacaaatgtggtgggagcacttaaattctacaccttttaatgtggaatggcaaagttttatttattagattaaacaaggatatggatatttttatctagaacctaaataaaaacggcttgttctct

SEQ ID NO: 1930 - DNA, 366 bp, Zea mays
  Clone ID: PAT_MRT4577_32127C.1
ctagcaccatagaatgcacactagtgtaccaacaatggcagcccagtagggcgcctacttatgctccttggtccttctgcaagtactgctacggcgaccattttcccgcactgcttgcatgctcctataccttcccttctttcaccgtacctgtcaccagcgtggtctaccgaatgtgaaaacccatttcttaacccctacaggatccaacaggcaatcacacctggcatattacctttattacccttgttcctacaccaatcataagccctattacatcagctacctttggcgcatatattgacacaaaacatcaggccacaacatctactacaactcgtgctagcaaaccttgatgactactct

SEQ ID NO: 1931 - DNA, 347 bp, Zea mays
  Clone ID: PAT_MRT4577_32138C.1
ctttcccatcatttccattcttcaaatctaaggcagctccgatagacaggtgaacgtcccaatcattcaatcaaaaggaagataagttggtgcttaaaaacaagtcttctaagtggcacgaacaactgcagtgttggtgccttaatttccgtgggcgggtcactggtgccttggttaaaaacttccaattggtggcttcttaggaccattgaccaaaaaaccaagaaagtgacaaggtgattcttcaattccgaaagatccgaaaaaatttgttcaccatggactaccgttatccaatatcggcatttcaagctttttcaatttgtctgaacaatttttataccaaa

SEQ ID NO: 1932 - DNA, 181 bp, Zea mays
  Clone ID: PAT_MRT4577_32366C.1
cgcgctggacgtcgcaacaccctaaagtgagtcgtattaagcacttgacgatcagatcgaatcgcacgaattcctctctttgggggtagccgcgtagcgcccgctcagtcgccggcgaccacggcggagaaattgcggggtcacctcgcctgtgtgtcgtgattacgcgagggagcgagcg

SEQ ID NO: 1933 - DNA, 420 bp, Zea mays
  Clone ID: PAT_MRT4577_32400C.1
atctccctgctcctgcgcctgcttcttgatccagccaagtctgggatcgccatgtcggactctgaggaggagcactttgaatcgaaggccgacgccggagcgtgcaagacctatcctgaacatgctgacaccgtccgtaagaacggcttcatcgtcattaagaacctgccctgcaaggatgtggaggtttctacctctaagactggtaagcatggacttgcgacatgctactttggcgccatatacatattgaacggcaaaaagctggaagatattgaatcttcatcacacaactgagatattcctcatgtgaaccgtactgagtactagctgattgatatatcataggatggatttgtgagcctacttactgcacatggcaacactaaaggatgatcttagacttctaactgattagac

SEQ ID NO: 1934 - DNA, 224 bp, Zea mays
  Clone ID: PAT_MRT4577_3242C.1
tatgacattacaacagcctatagtgagtcgtattaacactctccgtaggagacgagcctgggtcacctgcgccgccgcactgagcccacgtctctatcagtcgcatagtcaggtcatgtgaagaccgagcggaggaagcgagcaacttttgtaagcggattccgcgacgtcgacggcgtgcgactaggaggaatggatgtggtgggcgtggagagtgagtcagg

SEQ ID NO: 1935 - DNA, 1460 bp, Zea mays
  Clone ID: PAT_MRT4577_32479C.1
ccggccgggagcccgtggttacgtcagcgcccgcgtactgctcccttcttcctcgttgctccgcccccttttgtcgtcgcgtcctcctctcgaggcctcggcagtcggcacgaggacgcgcgatcccgtcaccgctcacctccttctccaaacactgactccgcttcccgtccccatcccgctgcgcaagatcgggaggggacgaagagaggtcgaccgggaggagatgcaccgagaccgaggcgtctctgcggcagcgatacccggtgaccggaagcggatcggcgagcctatggacagatcgtctccatctacgtcgtgggggttctccggagggcgcgagaaggagcggatcggcgtgggcaagcagccggagatgcctcgctccggcggcggatccaccgccatgtccaagagcaagctctctgacgcagaatcagaaactgacagcgaagaatcagatgtgagtggttctgatggggaagatacttcgtggatttcatggttctgtagcttaaagggcaatgaatttttctgtgaggttgatgatgactacatacaagatgatttcaacctctgtgggctaagcaaccaagttccatattatgactatgcacttgatctgatattagatgttgaatcttcccatggtgatatgttgacagaagagcaaaatgaacttattgaatcagctgctgagatgctctatggattgattcatgttcggtatattattacaagtaaagggctgtccgcaatgctggataagtacaggaacgttgagttcggcagatgccctcgagtgaattgcagcggccaaccatgccttcctgttgggcaatcggatgttcctcgttcaagtacggtgaagatttactgccctagatgtgaagacatctacactccaagatccaaatatctaagcaacatcgacgggacttactttgggacaacattcccccacttgttcctgatgacatacccgcatttgaagccccagaagccgctgcagcaatacgttcccagggtatttgggttcaaaatccgtaagccatgacaaatttgaaggttgaatgtataaaaggttcaaatagcgccctgttatctgctggccccgcagtgttcacacgacacgtcatcggaatacacctgacccgcggctgacctccctagtctggtttcttgctctggcctgaaattctgattgatgcttgtggtttgtttagcctagtgaatcaatccatatttttttacgatcatacgtattatggctttaatggtttaacaaccatctatatttttgttggcacggttcatattcgttttttactctgattgtttactcgttaaaaaaaaaaaaaaaaactatggattgcatctgtaacaatccaagaacaaatcagttattgtgtgccgcatttacttagattgtcaaaataggagtatgatgatggcatctt

SEQ ID NO: 1936 - DNA, 290 bp, Zea mays
  Clone ID: PAT_MRT4577_32699C.1
acaaaattattcagagaatcttacacaatcatcatgccaagaagaaaaagcaggaatacaagcttatgagaatttcataccctaatttcttctattctggcatcctcataaaaaaatgtatgtatggttgttggataattgacttctatcaaaaaactaaaatgcctactttgaacctcaatgatcttcatactgctaaaattcaatttgaacgaataagaatagggcttgttatacgtccattttgatgaaaattgatcattgaatgcaactgtaataattaccttcca

SEQ ID NO: 1937 - DNA, 490 bp, Zea mays
  Clone ID: PAT_MRT4577_3269C.1
gtgggttggcttctcctccccctccggtatcgattcaggttcgtgaggatctccggggttcggcttcatggacgagcggatcgagatggctgagtgagatgttgagtaccgctgattcgtcggcggcctaacctgggccacggacgaccactccctccacaacgccttcagcacctacggcgaggtcctcaagtgcaagatcatcctctatcgcgagacgcagaggtcccgcggcttccgcttggacaccttctccaccgaggatgcgatgcggaacgccatcaagggcatgaacggcaaggagctggaccgccgcaacatcaccgtcaacgaggcccagtcccacagcggccgtggaggctgcggcggtgggtacggtggtggccgcggacgcggcggctacagtggtagcgggcgccgtgattgcagtggcggctacggccgtggcgactgctacggtggcggcagcggataccgtggtggtggccgc

SEQ ID NO: 1938 - DNA, 426 bp, Zea mays
  Clone ID: PAT_MRT4577_3282C.1
ggtccggggttccggcgacgacgtcacgcgcttcgcatgcgcctggagaactgttaaagcttccatgtgactgggcactgatatcagatccggaattgaggctctatgcgcagctctatgcataggatgaatatgcgttcctcaaagattatgctgaatcacacaagagactctgtgagcttggcttcactcattcgcagcacacgaccatccaaatcagatcttgcaaccgtcgtcgtgcttgcacagattgcctctggcgtagcagttgctgcaggcacagttatggctggctacttgtacgaggcttccaagatggtcaagtacagggcgacattcttctccacatagactctgctttagtaagtatgaagatcgaataacaggaccatatctgaggatcgaatagcgcatcatataaatgag

SEQ ID NO: 1939 - DNA, 732 bp, Zea mays
  Clone ID: PAT_MRT4577_32931C.1
cgcaaatgttgtaaagtaaaaccctgtgcattgcagtttctcaaacgatccacaagatcaatgatctgcttaaacaaatgcattttctcaaacttagtcattgtttgccgcccaggcttaatcagttccctcaggctagatccctcagagtgggattttgtaacatttccactagtactgaaaagcatgtccactctggccatagaatcatgaattgaggtaggaatagtcggaatcttgtccaaagggtctctgggtcttgcattagcttgcacttggatctcctcccgtgcacgttggcacacaacccctttaccttttgatttgcttttaagcggtgaccctagaaccccagatgggggtgccacagtcttacttctcatctgatcaagaatcctattcgagaagctgcttactttaagagcgttgtcctgattagaccaaggggacaagagaatctgctggctgtgaaatggcgtcttgaactcattattcacatatccgacacgactcgtaggtgcctcattgccagacacatcgttgttccttgagatgatattgttggcaaggctcgtcgccagattttccctgctagaagcatcaccagccctcgagcttgcaatgtcgccatagctcagtgcggcgttttccctgctggccaaatagctggttctccgggccatccgtgtgaagttaccccacaggcccttaataacagcctcgtgccgaatt

SEQ ID NO: 1940 - DNA, 242 bp, Zea mays
  Clone ID: PAT_MRT4577_33067C.1
atgcacctttcactctttggggggaagccacaaacatcagcaaaaaaactctatcacttgaactataactcataagcaatctaaaagagggcaccacccatgactgggtgctggtagaacgctgttgggtttgccaaagcatcgttgtttgaatggcagcacttgtctcagttgcaagagggtgccaacgctacgcgcagcgagcatgtataacggccacaactgttgctgtgtcaagaaag

SEQ ID NO: 1941 - DNA, 1892 bp, Zea mays
  Clone ID: PAT_MRT4577_33348C.1
cgccaaacggaccaagaatttccacgcagatttcaacagagatgatgggctcgcccgccggtgctggtgcactcgcccatgtctcgcgcgtcgcaccgccgaggacggcgccccgattcgtcctccttatttaggcaccgtcttttgtcccccccatccgccccgagccgaaccaaggcgccatgagctccccggccgtgcgccgcgtcgtactcctctcgtcactcctctgcgccggagcgctcggtttcttgccctgctcccatgccgccgcggtggcgcccggctacgtcgccgtctccgccgccagcttcgtgccgtcctcaacgtgcagctcccccgaccgagttccgccgcaccggcggaacggcacgtccgccgtgctgcggctgacgcacaggcacgggccgtgcgccccctcgcgggcgtcctcgctagcggccccgtcggtggctgacacgctgcgcgcggaccagcgccgggcggagtacatactgaggagggtgtcggggcgcgcgcctcagctgtgggactccaaggcggcggcggcggtggcgacggtgccggcgagctgggggtacgacatcggcacgctcaactacgtggtgacggcgagcctcggcacgccgggcgtggcgcagaccatggaggtggacaccggcagcgacctgtcgtgggtgcagtgcaagccgtgcgccgcggcgccgtcgtgctacagccagaaggacccgctcttcgaccccgcccagtcgtcgtcctacgccgccgtgccgtgcgggggccccgtgtgcgcggggctgggcatctacgccgcgtccgcctgctcggcggcgcagtgcgggtacgtggtcagctacggcgacgggtccaacaccacgggcgtgtacagctccgacacgctgaccctgtcggcgagcagcgcggtgcagggcttcttcttcggctgcgggcacgcgcagagcgggctgttcaacggcgtcgacgggctcctgggcctcggccgcgagcagccgtcgctcgtggagcagacggcgggcacctacggcggggtcttctcctactgcctcccgacgaagccgtccaccgcggggtacctcacgctgggcgtgggcgggccgtcgggcgccgcgccgggcttctccacgacgcagctgctgccgtcgccgaacgcgccgacctactacgtcgtcatgctgacggggatcagcgtcggcgggcagcagctcagcgtgcccgcgtcggcgttcgcgggcgggacggtggtggacaccggcacggtcgtcacccgcctgcccccgaccgcgtacgcggcgctgcggtccgcgttccgcagcggcatggcctcgtacgggtacccgacagcgccgtcgaacgggatcctggacacctgctacaacttcgccgggtacggcaccgtgacgctcccgaacgtggcgctcaccttcggcagcggcgcgaccgtgacgctgggcgccgacgggatcctgtcgttcgggtgcctcgcgttcgcacccagcggcagtgacggtggcatggccatcctcggcaacgtgcagcagcgctcgttcgaggtgcgcatcgacggcacctccgttggcttcaaacccagctcctgctaactcatggattaacagtcggcgacttgggatcactactagtagtagtatatgcacgtacgtagacgagagtgcagagatacatacaaagttactgtacatgatgatagtaaagataaacttgcaggagagcgtataccatacacagcacacagcagtagcggtggaagttctttcgttggtggaattaaggggctaactagagacgtaagcgtgacgcgttacaacgcgttcggcattgcccggcgagttattaaaaaaaaaaaaaaagcggcc

SEQ ID NO: 1942 - DNA, 857 bp, Zea mays
  Clone ID: PAT_MRT4577_33495C.1
ttgggtccctcgaggccggccgggcgacactcctcctctactgcatatcacaattcacagcgctcaagttctcgcgcccagagccaaatttttctccactcaatcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaagggccggtacgcgcagcgcgtgggcatcggcgcccccgtctatctcgccgccgtgcttgagtacctcgccgccgaggtgctggagctggccggcaacgcggcgaaggacaacaagaagacgcgcatcgtcccgcgccacgtgctcctggcgatccgcaacgacgttgagctcggcaagctgctggctggcgtcaccattgcgcacggcggtgtcctccccaacatcaacccggttctcctgcccaagaaggtggcggagaaggcgtctagcggcggcagcaaggagagcaagtcccctaagaaggccgccaagtccccaaagaaggcagccaagtccccgaagaaggcttagaaattagtcactccactagcgctctgctgtagcatgttcgtgtttagatctgtggatgttatgtgttccggcctaatttcctctttgccttgtggcttctgatatgttcatcggcatgtttgccgtgttgtgtttccttgttctgattttgcaattcatcatcttgttgaatgaacttactatcgggaaatgaagcataataacgatgcaaaatgattgttctgaaaaaaaaaaaaaaaaaactcttc

SEQ ID NO: 1943 - DNA, 911 bp, Zea mays
  Clone ID: PAT_MRT4577_33496C.1
acaaagcttgtctagctcagttggcagagcacaaggctcttaaccttaaggtcgtgggttcgagccccactgtgaacatattttttatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacgacgttgagctcggcaagctgctgtctggcgtcaccatcgcgcacggcggtgtcctccccaacatcaacccggttctcctgcccaagaaggtggcggagaaggcgtccagcggcggcagcaaggagagcaagtcccctaagaaggccgccaagtccccaaagaaggcagccaagtccccgaagaaggcttagaaattagtcacttcactagcgctctgctgtagcatgttcgtgtttagatctgtggaacttatgtgttccagcctaatttcctctttgccttgtggctcctgatatgttcactggcatgtttgccgtgttgtgttccttgttctgattttgcaattcatcatcttgttgaattaacttactatcgggaaatgaagcataataacgatgaaaaatgattgttcttaaaaaaaaaaaaaaaaaaagcggcc

SEQ ID NO: 1944 - DNA, 241 bp, Zea mays
  Clone ID: PAT_MRT4577_33565C.1
ccggattcccggtcgacccacgcgttcgaggaattccttcccctagccgccgtctccgttgctcgtctccctgagaggtgcctgtaccgaggaactggccgagtactaggtagagaatcggtttttcttgtctcagcccggggtctgctgcgtctggtggtggtgaacgggagaattttgtgagatctgttttggatcatgcgtaccatctcgggaatcacgggtgtcacacgtatcttcg

SEQ ID NO: 1945 - DNA, 229 bp, Zea mays
  Clone ID: PAT_MRT4577_33624C.1
gatctccaaatttctcaggggagccagtgctttactgtgctacacgcccttggtgcaagacctgaggggccaccatacattacaatcactggtctagatgactcaaattctggttatgccacaggaggcgggcttgatataatcgtgaggacgctgtgtgatgtagctcacacatgtggcctcaccttagagctcaatgccggtccagctggtagccatgaggctgagc

SEQ ID NO: 1946 - DNA, 1164 bp, Zea mays
  UNSURE (1)..(1164): unsure at all n locations
  Clone ID: PAT_MRT4577_33776C.1
  unsure (1)..(1164): unsure at all n locations
gtcggtcgaggagtagggttctagcgcctatctggtttctccctgcgccgccgccgtggacaaccggagcgtagtgggaggggatgatggagggaggtagccgcgcggatgggcggaatccgaaccagctccggccgttcacctgcaccgggaacccgctccaccgcgcccacggctccgcgcggtgggcgcagggcgacaccgtcgtgctggccgctgtgtacgggcccaagccgggaacccggaagggcgagaaccccgagaaggcctccatcgaggtcgtgtggaagcccaagaccggccagatcggaaggcaagaaagggaatatgagatgacactcaagaggacgttgcagagcatctgcttgctcacagttcatcctaacaccaccacctctgtcgtgcttcaggttgtgggtgatgatggttctcttatgtcatgtgcaattaatgcttcttgtgctgctcttgcatttgctggaatccctatgaaacatcttgctgtcgcgattagctgtggagtgatggacaatggtgtggttatcttagacactagcagagcagaagagcagcaagctaggtcgtttgctcacctggtgtttccgaactcgcgcaagtcagtcgaatcgaaggacccgacacagcgagatgaggagtccgagcgaggattgataacttgcatcacgcatggagcaatgtctgaggatgactatttcaactgcatagagaggggtgtcatggcgtcctcgaggatctcggatttcatgaggaagacactgcagaaggaggtgtccagggatgcctgacctgagtagcaaatgtattagcatgaccgagaagctgaggcgatggcgatggcaatggtgtgtagacagcagctgggtctctagtttagacggcatgtagtcgtgttagaatgaaggaggcaagggtgcggtggagtggaggtcaatcggcgtgtgatgccacgcactagcttagctgcggatggtttggtggacttttgaggaacagataatgagattgtatgcacggcacgctgaaattttacttgaacgccgcccgattaaaacaatatccatactgtacgtgtgtcggtgagctgcnnnnnnnnnnnnnnnnnnnnnnnnnnnnnnnnnnnnnnnnnnnnnnnnnnnagggcca

SEQ ID NO: 1947 - DNA, 580 bp, Zea mays
  Clone ID: PAT_MRT4577_33813C.1
ggccgcccttttttttttttttttttttttttttttttttttttttttttttttttttttttttttttttttttttttttttttttatttttttcggaaaaacattatcaacattggatttataaggggcaaaaaaggcggcggcccacaggctataagcttgggtcagggccgggaaccgatcgacacatggacccacattattggccgcaagaacaattaagggccccattatgacatatcatcatatataaaataaaaccggcggggttattattccgccacgggaatttatatatagaggccaaacgggaatttgggggagtctgcaaaggcaatggcaatgcaaaggagggtcacagcgcaaagggcttgggggaaacgtcaaacatttcccagcaaaacagggtagggtcctgcccccccctgaagttgaccaccttgcgggcgggggcccaggccccctgcaactggtggttgcaacccccggcgttggtcaagaagggtttcatggaggggagcaggcggccctaggggaccccctggggctcgcattccacccccttgataaaactggggg

SEQ ID NO: 1948 - DNA, 2473 bp, Zea mays
  Clone ID: PAT_MRT4577_33820C.1
ggacgttttggactctgattagcatattgattttgccactgctcagacattagatttgggtgccacattgtgcaggagttctggctggacaagggcggtggaggtctatgtatgtcaatttcttcaagggcgctttcaataacaggcattgatgataggaggtattggaacttcattgccagtgatgaatcaagattccgcacggttgcgtacctctcgcaaatctggtggtttgaagtgagaggggaggttgaattcttcttcccagaaggcacgtacagcctattctaccgcattcatctcggccgaccattcaagcgtcttggccggcgagtctacagctcggagcacgtccacggctgggacatgaagccggtgcgtttccagatgtcgacctccgacggacagcatgttcagtccaagtgctacttgagcgatcccggtatctggatcaaccaccatgtcggggacttcgtcgtgaaggactcgagcaggccagtgaacatcatgttcgcgatgtaccctctttttcacctctacaccgcagcgtccccgtcaaccctgttcatgctccgctgcttgcaccagatactaggcttgctctcatcctttcaacccctcgtcttccacggcttctacgccttgccttgctgctgatgctactccatttcctcccccggtacagcctgacccaacaaacgcacccccaagctaccaacgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagcctttttcggcagggcatctgctagagccggccggttgaagcaggggagcgagaggaggagggcagccgaacaggagcgtcgcagtggtggttaagcagcagcaacgacgacgacgacgacgacgctgagaggtttccccgttcccgacggcacgtccaccgaggcggcgccatcacgatgggtcctctggcgccgctgaggtgtaacccgccgccgccgttctccaagtcgccggggtccctgctgctgctgtccaagtcgctcaccctctactgctgagccgagccccctcctcgatcggttccatgggcgccgtggcctcgtcggcgggtggggcccggggaggcgatggcacggtgctgggcgacctgccggagaactgcgtcgcggaggtgctgctcaggctggacccgctggagatctgtcggttggcgcggctcagccgcacgttccgcggcgccgcgtccggggacggtgtctgggagtccaagctaccgaggaactacgcgcgcctcctcgccgttgctgcggccggcgatggggaaggtgggcaggccgccgcgtcggcgccgggggcagagctgctgcccatcagcgaacgtgtacgcgcggctttgccgtcggaaccgtttcgacggcggcaaaaaggagttctggctggacaagggcggtggaggtctatgtatgtcaatttcttcaagggcgctttcaataacaggcattgatgataggaggtattggaacttcattcccagtgatgaatcaagattccgcacggttgcgtacctctcgcaaatctggtggtttgaagtgagaggggaggttgaattcttcttcccagaaggcacgtacagcctattctaccgcattcatctcggccgaccattcaagcgtcttggccggcgagtctacagctcggagcacgtccacggctgggacatgaagccggtgcgtttccagatgtcgacctccgacggacagcatgttcagtccaagtgctacttgagcgatcccggtatctggatcaaccaccatgtcggggacttcgtcgtgaaggactcgagcaggccagtgaacatcaggttcgcgatgattcagatagactgcacgcacacgaaaggcggcctctgcgtggattcggtcgtggtgaaaccgcagcacctcgcgcagaaaaaagcgccctggacttacgtctagactcgtcgaacaagttgctgctgctgtctagggaggagggatatgatccatagtttccttttggattgttctactaccagatgtgcgttttgtttacagaagtgcggttttttacatttgcacttatacgcgtattttgcagtcatgtaatgtaattgaaggggtaagtgatttttttagttcctcttgtcccccctaggaacatgttggacctctgtaaattgttcgtttgaactttgaaatgtacatcggctgtgttctgcctatcacctggccccccaaacaaaaaaaataaaaaatataaataatataattataatataatttataaataatttaatttaatattatatttttttttattttatatttttatattttatgatatt

SEQ ID NO: 1949 - DNA, 363 bp, Zea mays
  Clone ID: PAT_MRT4577_33852C.1
cacacgccacgccagcgtcttgttccttatccaggattccaagctgagaccatgagaccacgacggggctcacactgtgcacgctctacggccatccatggcgccttatccagcattacacctgcagcagcaggtccacctccggcacgccagcaagccaacgaatccagctccggttcatcatcacgggcatggaaaccccaagcccgacgctgtggcggcgtcgctccggcgaggcgccccggccgacgctcgcggcctccgggcgctaatcaaggcgctgtcgtcgtctgcgtcctccaccagcaccgtggcggcagtgcacgcccacgcaaccaagatcgggctggaccgcgagcgtac

SEQ ID NO: 1950 - DNA, 1424 bp, Zea mays
  UNSURE (1)..(1424): unsure at all n locations
  Clone ID: PAT_MRT4577_33901C.1
  unsure (1)..(1424): unsure at all n locations
taccctcgcggnccgtgccgggnaaaaaaaaaaaaaaaaaaaaaaaaatcgaggccggccggggcatatccaacgcgccggggcatatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttcgacgatgacgccgagtatgatgccaccgataatgatgccaagtatgataccaccgatgatgatgccgagcatggtgtcatcaatgataatgccaaacatgatgacagtgccacaatgttactctgattccatctcgcacattatacaacaacaacaattaccattcatgttcagccccacagccgtggcgatctcacccatgtttttacagcagccctttgttggtgctgcattctagatataagcatttgtgttgtacccaataatgaagtcggcatgccatcgcatgcgactcattgtttaggaataaaacaagctaataatgacttttctctcattataatgtaaaaaaaaaaaaaaaaaaagcggccccacagccatggcgatctcacccatgtttttacagcagccctttgttggtgctgcattctagatataagcatttgtgttgtacccaataatgaagtcggcatgccatcgcatgcgactcattgtttaggaataaaacaagctaataatgacttttctctcattataatgtatatctctccctgtcgcggttcctgaacaattggtcctcctctaccttacaaaacatcagcccatacaacagttgtgcgctgctctcagctctctgattgctgcttcttattttcttccagcgctgcgtccccatnttttatttttttttttttttcnttttgtggggggggggggggnctttttttttttttttttttccttttttttttttcttntntttttgttttccctgcccgggcggcccttttttgggggggtttttgcggttttccctcccccttggggcccgctcgggcttccttttggggggcccttttccccctttttcgcgtcggcgggcctttccctggccgtctttt

SEQ ID NO: 1951 - DNA, 1220 bp, Zea mays
  Clone ID: PAT_MRT4577_33903C.1
acccaataatgaagtcggcatgccatcgcatgcgactcattgtttaggaataaaacaagctaataatgacttttctctcattataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggatattattctctaggaagcaagggaacatcgccatggcaggatgtttgcattgtttgcgctcctagctctttgtgcaaccgccactagtgctacccatatcccagggcacttgtcaccactactgatgccattggctaccatgaacccatggatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccgtggcgatctcacccatgtttttacagcagccctttgttggtgctgcattctagatagaagcatttgtgttgtacccaataatgaagtcggcatgccatcgcatgcgactcattgtttaggaataaaacaagctaataatgacttttctctcattataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaggggggcccccccgggggttgggaaattcccaccccccggggggcccttagattaaggggcccattccccccaaaaggggggggtttaaaaatactgaaggggcccgggttaaaaaacgggctggaaaaaccccgggggccaaattattttccttggaaaaaaacccccttggggaaaaaaaaaaaaaaggcccgaaaaaaaaccccgaccgctttccggggccccaaaggggaaaggaaccccccttaaaggggcccttaataacggggggggggggggttaccccccagg

SEQ ID NO: 1952 - DNA, 1729 bp, Zea mays
  UNSURE (1)..(1729): unsure at all n locations
  Clone ID: PAT_MRT4577_33904C.1
  unsure (1)..(1729): unsure at all n locations
ccaaaaacaataaaatttaatatccgcaaaagaaataaattgagaatcgtacttaggcatccgaggtcaaaacattgtaatgattctttgcgttgaagcttatataacatcaaaatcccacactgaatctgtgctacatgtttagcaacagcaaaacctaagctcaaattacgactcttgtgataaccaaaggacatagccgatcatcccaaacaacatatgtaacagctgggcagctcaaggaccaaaccgctttttacagtagaaatataacaaaaagtattgatggacctgatcaacagccaatggctaacggtgtaagatacatttcaatgccccgggggaaacctacttcccagctgaatcaggtgagccatccccggaagaaaccaaaccttttttgcctccacgattagggctaccaaacaacgcgtgggcgcgtgggatcgccatggcagccaagatgtttgcattgtttgcgctcctagctctttatttgtgcaaccgccactagtgctacccatatcccagggcacttgtcaccactactgatgccattggctaccatgaacccatggatgcagtactgcatgaagcaacagggggttgccaacttgttagcgtggccgaccctgatgatgcagcaactgttggcctcaccgcttcagccgtgccagatgccaatgatgatgccgggtatgatgccaccgatgccgatgatgccgatgccgagtatgatgtcatcaatgatggtgccgactatgatgtcaccaatgacgatggctagtatgatgccaccgatgatgatgccaagcatgatttcaccaatgatgatgccgagtatgatgtcttcgatgataatgccttcgatgatgatgccgaccatgatgtcaccaatgatgatgacgagtatgataccaccgatgatgatgccgagcatggtgtcaccaatgatgatgccaaacatgatgacagtgccacaatgttactctgattccatctcgcacattatacaacaacaattaccattcatgttgagccccacagccatggcgatcccacccatgtttttacagcagccctttgttggtgctgcattctagatataagcatttgtgttgtacccaataatgaagtcggcatgccatcgcatgcgactcattgtttaggaataaaacaagctaataatgacttttctctcattataacttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagttttgacatggggccgcccccccctaagggggaattttggggagctcccccccccctgggggccgttcgggccttcttttggggggcccaattggccctttaggggggggggtttccaattcattggccggggtttgaaaccctcttgcctgggaaaaaccttggggtcccccccccttaattccctttgggnccttcccccttttnggccggtgggccgttttccgaaagaggcccccccccggccgcccttccccccttgtggcgcccccctctttgggcctggggcccccccccctttcggggccccttttttccgcgggggggggggggggggtccccccccgngggggccccttccctttggccgggccccccgtggccccccctccgntnngnttttcttctcctttttttt

SEQ ID NO: 1953 - DNA, 725 bp, Zea mays
  Clone ID: PAT_MRT4577_33908C.1
gacccacgcgttcggcacacgttcggccacaccttcgctttatggagcaagggaatcacattggcattgcaggcgagaagtttgcattggttgggcttctaactttttgtgcaaacggcaattatggtaaccatattccaagggacctggtaacaattctggtggcaatgggttacaatgaacccatggatgcagtactgcatgaagcatcagggggttgccaacttgctagcatgaccgaccctgaagctgcatcaactgttggcctcaccgctacagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttcgacgatgacgccgagtatgatgccaccgataatgatgccaagtatgataccaccgatgatgatgccgagcatggtgtcatcaatgataatgcctaacatgatgacagtgccacaatgctactctgattccatcttgcacattatacaacaacaacaattaccattcatgttcagccccacagccgtggcgatctcacccatgtttttacagcagccctttgatggtgctgcattctagatataagcatttgtgttgtaccc

SEQ ID NO: 1954 - DNA, 371 bp, Zea mays
  Clone ID: PAT_MRT4577_33937C.1
gaaagaccggggcggaccacacccttcgggcccaactagcaacatacaaggcacattattgtaccaacaatggcagctaaaatattttgcctccttatgctccttggtctttctgcaagtgctgctacagcgaccattttcccacaatgctcacaagctcctatagcttcccttcttcccccgtacctctcaccaacggtgtcttcggtatgtgaaaacccaattctataactcctacaggatccaacaggcaatctcagatggcattttacctttatcaccctagaaccatctactatcatgaaacctattaccgtagttgcttttggtgcatctatgggcacagaacatcaacgcccaacaccttcgat

SEQ ID NO: 1955 - DNA, 1663 bp, Zea mays
  Clone ID: PAT_MRT4577_3398C.1
cattgggtacctcgaggccggccggggaatcccctcctccgccctccgcctcctcagtgctccggcgcctagcgacctgctcctgcccccgccgccgccgtgcacgcacagccggagcaggagcagcgctgcccgcctttaccgttgcccatggagaactctgccgccgccgccgccgaacggccgcgcctcacccgcgcagccgccaagcgctcagccgtcgtcacggctgtggccgtcgccgccaagcgcaagcgcgtcgcgctcagccagctgcccacgctccccaacgccgtgctcggcgcgcacgacgacgacgacgacaagcccgtcaggaagcagcgcctcctccccgccgccaagcccaagcgccgcctcgctgttgactacatcgcggcggtgcagatcgacgtcacgcccaacatgcgtggcatcctcatcgactggctcgtcgaggtcgccgaggagctcaagctcgtctccgacacgctctacctcaccgtctcctacatcgaccgcttcctctctgccaaagttctcaacaggcagaagctgcagctcctcggcgtctccgccatgctcatcgcatccaagtatgaggagatcagcccgcccaacgtggaggatttctgctacatcaccgataacacctacaccaagcaggaggtagttaagatggagagtgatatactgaatgtcctcaagtttgaggtgggcagtcctaccgccaagacgttcctgaggatgttcatcagatctgcccaagaagacaacaagaagtatcctagcctccagttggagttcctggggagctacctttctgagctgagcttgctggattatggcttgattcgctccttgccgtcacttgttgcagcctcagccgtctttgttgcaaggctgaccctggatccacacacccatccctggagcaagaagatgcaaacgctaacaggctataagccatctgagttgaaggactgtgttgctgccatacataatttgcagctcaaccggacatgtcaatccatggtggcgatccgggagaaatacaggcaacaccgattcaagggtgtatcagctttgctacctcctgttgagatccctgcatcatacttcaatacactgaaggagtaggtgttccttgataatctaagagagccaagcacacagctttcctcaagcaagatgtgcaatgctaaggttgttagggtactgaggttcttggatgctgcatctaggcttggcttggagcattcagagttgatttgtttgaagttcaaactcaatagaaagttcggtgtatcaaatcttgtacttgtgtatcataattatacattacaaccaggtgcctttatttattgggggcacaattccaaagttttcattcattgcctcttactacatattctccttttttattcatgtagttctagtacagaacacagtatttagtgttcagttatatcagagggtagcttagggatgtattagaccttgctaccttgtcttggtaaacacatgcagaaagccagaaagtgatatgttcttgacacaagaaatgtgtcctggaaagactagatacttggaacagttgtgaatgataattatagcacaatgtgcacctttaatgttaataggaaaattggccatgtgaatgatc

SEQ ID NO: 1956 - DNA, 445 bp, Zea mays
  Clone ID: PAT_MRT4577_34063C.1
ggttgacccacgcgtccgcgggttcgtgaggttctccggggttcgggttcatgggtgagcggattgagatggcggcgtcggacgtcgactaccggtgctgggtccgcggcctcacctgggccacggacgaccactctctccacaacggccttcagcacctacggcgaggccctcgagttcaagatcattctccatcgggagacgcataggttcctccggtttctaggtattgtcaccttctctacggtggaggcgatgcggaacgccatcgagggcatgacctgcaaggagctggacggccgctacatcccgtaacgaggcccagtcccgcggcggctcgtggaggcgtcggcggcgggtacggtggtggccgtggaggcggcggccaccggcggtggcgggctcccgagatggccgcggccgctaccgctgtggcggctggcta

SEQ ID NO: 1957 - DNA, 916 bp, Zea mays
  Clone ID: PAT_MRT4577_3412C.1
tcggtaaagcctgaactgaaataagaacgaagtggaataggacgaaggaaggttctgcatctcagattgaatgtcggaaggaaagaagtacttgattgtgttggctcaccatgagcccaagtcgctgaatcactctttcgctcaacgtgctcaacaggtgctcacggctgctggaaacgaggtcaagctgatcgatcttcatgccgtcaacttcaacccggtctcggatcgacgcaacttcaagacgacggccaacccggagtttctcaaacaacagatcgaggagcgacatgctaccgaacacgatgggttcgctgatgacatcaaggagtccctggaggcagtcgactggtgcgatgtattgattctccagtttcccttttggtggttcagcatgcccgccatcctcaaaggatggatcgacaaggtctgggccagtggaagagtctacggtccgaacaagaagttcaccgctggagtgtggaagggcaagaaggccttcctctccatcacaacgggctcttccgagccgacctacgcgggacctgactctcgcatgggagatatcaacagtctcctcttccccatcaaccatggcatcttagccttcgttgggttcacggtcttgcctcccttcatcgcctactcagcttcgcatgccaccgaagaccagaggaagcagttcctggatgagtacgaacagagacttctgaacctggagaacctcaccccgatctcctatcctcccaacgaagccttcgactccaccggaatcctgaaagcagactggaaggctgctcaagctcaccagaactcgaaccctgctccacgcgaaggctgaaagcctccctcattccctccttccatctgaatgaaaccagctgttggcataccgaggtagcaacttcgaaacatc

SEQ ID NO: 1958 - DNA, 630 bp, Zea mays
  Clone ID: PAT_MRT4577_34279C.1
cctcgaggccggccgggccgggatcatctccgcgagccactattagcagcacacttctcatcagccatgaagctcgtcctgtgcttctgcatctgtgtcgttctcgtcatcgcctcgtcgccggtcacgctctctgatagccgccctgcgatggggcgacgctggctgcgagacgaagttgtcattgccaggggccctgaagggaacacgacctctgcctcagcctctgcctggtcggaggaggcgccggggataccgtacgacgggtcgaagaggctcagccccggtggtcccaacccgcagcatcactaatcgtcgtccgatcttgttggcaagtgccactgcggacatcttgctacgggaatctgtggttgattactacactttggttctgatcagcttttcttttctgtcctttctgatcagcttttcttttctgtcaaggccgtgtgatcaaggagtaaacgtaacaaattattgccacgatttttctgaatgtatccaagtcatgtgagtgataataatgatatgctgtcattaactaaactaaagagtcgttgcagccctcgcaagttatctgtaacttttatttttggtatcagtgtttagtgctaatatgcagtcgcctcc

SEQ ID NO: 1959 - DNA, 351 bp, Zea mays
  Clone ID: PAT_MRT4577_35057C.1
ctcgatggaaccaaaaccaatacgtcagattctgcatataggagttccaacattccatcataacacgattagcaaaaccgggcaacgcttaacataaaacgttataccaagccctaaagctattatttcaaatttcttggttgataatgcacctaatcggatcctgccctcctaaagcattataattttggatggcaccaccatagcctccacctacgttgccatcgtcacctccggagccaccacctacatagcctgcgccgccatagccaccaccaccacggttccgagaaggtctttaattagccatgttgacacgtacctgtcgcccatcaattgccttgccatcca

SEQ ID NO: 1960 - DNA, 1988 bp, Zea mays
  Clone ID: PAT_MRT4577_35061C.1
caggtttatgatagtacttgcagtagccaggactctgttccaggtttctatgtctctaatctctatgaagcggtacatgtttttgtctgtgccttgttggctttcactgctctgctgctcatctcctaactacgcctgcctgtttcctcccccgcaggattgatgagctcggcgagcttgagcaccagcatgcagggggcaatgaccagggtgagggcccccttcacgccgccgcagtggatcgagctggagcaccaggccctgatctacaagtacctgtccgcgaacagccccgtacctcacagcctcctcgtccccatcaggaggagcgggagcctcgcatcgtctccctacccgcctccctacttcggcacgagcacatgtaagcgaagaaagagaggaggacgcaaaaagcaaaggcgaccgagagtgctgagtgctattgcctgggcgctagcttcagtagttcagttccatcatgcacatcgacatgataaaaaagccgcgtcggttctttccttttcggaatcttgattggcgctgctgcttgttgcctgttggcgcagtggggtggggctccttccagctgggctactccggcaatgcggatctggagcctgggcggtgccgccggacggacggcaagaagtggcggtgctccagggacgcggtcgccgaccagaagtactgcgagcgacacatgaaccggggacgccatcgttcaagaaagcatgtggaaggccagcctggccatgccgcgaaagccatgtccgcggtggccgtggcggctgcggcggctgctgctgctgctctggccggcgccggagctaccgctgctgctggccttgctgccaaccagcaccggcagccggggaagagctatgccacgggtgcgactgatccatgctctctgcaatatagcaggggactggcgaacaaactgtcgaacgagagcgaaaacatgcaggactctgacagtgtctcgatgctgacttccatgaacacaggaaacactgcaggcagcgtgtttccgttctcaaaacaaaacactgatcttttcgaagtgagcagctcaaggccagagtttggccttgttccatcggattcactgacgagttcacctcatagttccttgaagagtgtaaaaaatctgctcagctcacggagtctgagtgagcaccagagctccgcctccctgcaacactttgtggactggcccaggacgccacctgcccagggaggtctttcatggcccgaggcagaggacatgcccagagctcagacgtcacagctctcagtatccgctccaatggcatcctccgagctatcatcggcctccacatctcccatccacgaccacgagaagctgattctgtcacctctcaagctgggccgcgaccgcgagtatagcccatctggcctcgtcagcgctgcagcgaacagatacgaggttagccagctagaagcgacctgggcgacgacgttccgcgactcttcgacgggcggcccgttgggggaggttctggccaagaacaacagcaacgcggaagcaagaagttgcccgtcggcggcgccacctctaaccgactactactgctgggattcaggccacggcatgcagtcgtcccccgtgggagttctgcagaggacgaccgccttcggatcggtctccagcagcacgggcagcagccctagggtcgagagccacggcgcctgctgcgatggtaccagcaacctgatggatgatgatctcggctcagttgtagtgagccaccccagcatccgcctcttgtgagcccgctgagttctggccatggaaaaagcgtgaggggttttgtcatttgagactgatctgtcacttgagttcttcttttgtttccttttaacctggctttgtaactctcaccttctttggatcgtgaaaagcgctgcgatgtgtggtgtggctgggtttttggtgcgccgttgatgcgtagtaccattcatat

SEQ ID NO: 1961 - DNA, 1585 bp, Zea mays
  Clone ID: PAT_MRT4577_35063C.1
caaaagcaaagcgaccgagagtgtgctttttgggctagcttcagttccatcatgcacatcgatatgctaaaagccgtgtcgattgtttcttttccggatcttgatttggcgctgttgcgtgttgggcgcagtggggtggggctctttccagctgggctactctggcaatgcggatctggagcctgggcggtgccgccggacggacggcaagaaatggcggtgctccagggacgcggtcgccgaccagaagtactgcgagcgacacatgaaccggggacgccatcgttcaagaaagcatgtggaaggccagcctggccgtgccgcgaaagccatgtccgcggtggccgtggcggctgcggcggctgctgctgctctggccggcgccggagctaccgctgctgctggcctcgctgtcaaccagcaccggcagccggggaagagctatgccacgggtgcgactgatccatgctctctgcaatatagcaggggactggcgaacaaactgtcgaacgagagcgaaaacatgcaggactctgacaatgtctcgatgctgacttgcatgaacacaggaaacactgcaggcagcgtgtttccgttctcaaaacaaaacactgatcttttcgaagtgagcagctcaaggccagagtttggccttgttccatcggattcactgacgaggtcacctcatagttccttgaagagtgtcaaaaatctgctcagctcacggagtctgagtgagcaccagagctccacctccctgcaacactttgtggactggcccaggacgccacctgcccagggaggtctttcatggcccgaggcagaggacatgcccagagctcagaggtcccagctctcagtatccgctccgatggcatcctccgagctatcatcggcctccacatctcccatccacgaccacgagaagctgattctgtcacctctcaagctgggccgcgagtatagcccatctggcctcgtcagcgttgcaggagcgagcagagacgaggttagccagctagaagcgacctgggcgacgacgttccgcgactcttcgacgggcggcccgttgggggaggttctggccaagaacaacagtaacgcggaagcaagaagttgcccgtcggcggcgccacctctaactgaatactactgctgggattcaggccacgggatggagtcgtcccccgtgggagttctgcagaggacgaccgccttcggatcggtctccagcagcacgggcagcagccctagggtcgagaaccacggcgccagctgcgatggtaccagcaacctgatggatgatctcggctcagttgtagtgagccaccccagcatccgcctcttgtgagcccgctgggttctggccatggaaaaagcgtgaggggggagcatttaccacgtagtttgtcatttgagactgatctgtcacttgagttcttcttttgtttccttttaacctggctttgtaactctcaccttctttggatcgtgaaaagcgctgcgatgtgtggtgtggctggtttttttgtgcgccgttgatgcgtagtaccatcttataaaagtgagactgcacatttggatt

SEQ ID NO: 1962 - DNA, 2091 bp, Zea mays
  Clone ID: PAT_MRT4577_35068C.1
gagcaatgccgctagttccgtcccactccctcgcttcccatcccgcaccccatggaagggagcagcactagctagcgtgggacagggcggggtggtgtcgtggtgatggaagcgggcggcggcgcctcggaactcggcctgctcggcgccggatctggcaggctgctcaagcacgggcggggcgacgcggcggggggagaggaccacgggtgggtcgtcgtcgtcggcggcggcggcagggccaagcaggccaggaccgcgtccgtcggcaccggggacgcggcggccacggcggccgtgccgttcctgctgggctcctgcggcggccccggccacggcggggaacggatgctcagcttctcgtccgccgccgccgccgccccggatgatggcggtgccatgccgccgctgtactacgggaccccggcctcttgctcaggattgatgagctcggcgagggtgagaggccccttcacgccgccgcagtggatcgagctggagcaccaggccctgatctacaagtacctgtccgcgaacagccccgtacctcacagcctcctcgtccccatcaggaggagcgggagcctcgcatcgtctccctacccgcctccctacttcggcacgagcacattcgggtggggctccttccagctgggctactccggcaatgcggatctggagcctgggcggtgccgccggacggacggcaagaagtggcggtgctccagggacgcggtcgccgaccagaagtactgcgagcgacacatgaaccggggacgccatcgttcaagaaagcatgtggaagaccagcctggccatgccgcgaaagccatgtccgcggtggccgtggcggctgctgctgctgctgctacccagcatgctgctgctctggccggcgccggagctactgctgctgctggcctcgctgtcaatcggcaccggcagccggggaagagctatgccacgggtgcgactgatccatgctctctgcaatatagcagggaactggcgaacaaactgtcgaatgagagcgaaaacatgcaggactccgacaacctctcgatgctgacttccatgaacacaggaaacacaggcagcgtgttcccgttctcgaaacagaacactgctccttttgaagtgagcagctcaaggccagagttcggcctcgttccatcggattcactgacgagttcacctcacagttccttggagaacgtcaaaaacctgctcggctcacggagtatgaacgaacaccagaacccagcctccctgcaacacttcgtggactggcccaggacgcctgcccagggaggcctttcatggcccgaggcagaggacatgcaggctcagaggtcccagctctcgatatctgctccgatggcatcctcggagctatcatcggcctccacatctcccatccacgaccacgagaagctgattctgtcacctctgaagctgggccgcgagtataccccatctggcgtcgtcagcgctgcagcgaacagatacgaggttagccagctagaagcgacctgggcgacgatgttccgcgactcttcgacgggcggcccgttgggggaggttctggccaagaacaacagcaacgcggaagcaagaggttgcccgtcggcggcgccacctctaaccgactactactgctgggattcaggccacggcatgcagtcgtcccccgtgggagttctgcagaggacgaccgccttcggatcggtctccagcagcacgggcagcagccctagggtcgagagccacggcgcctgctgcgatggtaccagcaacctgatggatgatgatctcggctcagttgtagtgagccaccccagcatccgcctcttgtgagcccgctgagttctggccatggaaaaagcgtgaggggttttgtcatttgagactgatctgtcacttgagttcttcttttgtttccttttaacctggctttgtaactctcaccttctttggatcgtgaaaagcgctgcgatgtgtggtgtggctgggtttttggtgcgccgttgatgcgtagtaccattcatataaaagccagtatccgaccgatcggtctccgtctgtctgctg

SEQ ID NO: 1963 - DNA, 1811 bp, Zea mays
  Clone ID: PAT_MRT4577_35069C.1
ctcctcctaactacgcctgcctgtttcctcccccgcaggattgatgagctcggcgagggtgagaggccccttcacgccgccgcagtggatcgagctggagcaccaggccctgatctacaagtacctgtccgcgaacagccccgtacctcacagcctcctcgtccccatcaggaggagcgggagcctcgcatcgtctccctacccgcctccctacttcggcacgagcacattcgggtggggctccttccagctgggctactccggcaatgcggatctggagcctgggcggtgccgccggacggacggcaagaagtggcggtgctccagggacgcggtcgccgaccagaagtactgcgagcgacacatgaaccggggacgccatcgttcaagaaagcatgtggaagaccagcctggccatgccgcgaaagccatgtccgcggtggccgtggcggctgctgctgctgctgctacccagcatgctgctgctctggccggcgccggagctactgctgctgctggcctcgctgtcaatcggcaccggcagccggggaagagctatgccacgggtgcgactgatccatgctctctgcaatatagcagggaactggcgaacaaactgtcgaacgagagcgaaaacatgcaggactctgacaatgtctcgatgctgacttccatgaacacaggaaacactgcaggcagcgtgtttccgttctcaaaacaaaacactgatcttttcgaagtgagcagctcaaggccagagtttggccttgttccatcggattcactgacaagttcacctcatagttccttgaagagtgtaaaaaatctgctcagctcacggagtctgagtgagcaccagagctccgcctccctgcaacactttgtggactggcccaggacgccacctgcccagggaggtctttcatggccccaggcagaggacatgcccagagctcagaggtcacaactctcagtatccgctccaatggcatcctccgagctatcatcggcctccacatctcccatccacgaccacgagaagctgattctgtcacctctcaagctgggccgcgaccgcgagtatagcccatctggcctcgtcagcgttgcaggagcaagcagagacaaggttagccagctggaagcgacctgggcgacgatgttccgcgactcttcgacgggcggcccattgggggaggttctggccaagaacagcagcaacgcggaagcaagaagttgcccgtcggcggcgccacctctaaccgactactactgctgggattcaggccacggcatgcagtcgtcccccgtgggagttctgcagaggacgaccgccttcggatcggtctccagcagcacgggcagcagccctagggtcgagagccacggcgcctgctgcgatggtaccagcaacctgatggatgatgatctcggctcagttgtagtgagccaccccagcatccgcctcttgtgagcccgctgggttctggccatggaaaaagcgtgagggggagcatttacgacgtagtttgtcatttgagactgatctcctgtttctgtcacctgagttcttctttcgttgcccttatacctggctttgtaactctcaccttcgttggatcgtgataggcgccgtgatgtgtggtgtggctgggtttttggtgcgccgttgatgcgtagtaccatcatataaactagtggactggcgcgctccatcgcgcgcgtttgaatttagcaatacaaagttttgaaataacgattagtattaaatacaaagttttgaaataacgattaatattagcgcacgcgtt

SEQ ID NO: 1964 - DNA, 2450 bp, Zea mays
  Clone ID: PAT_MRT4577_35127C.1
cgtagctatagctggctagcttcctcctcctggctagctgctacccttcccggttctcaccgcgctgccattaaaacccccttccttgttaccacttcgaccttgagcaagcgcactcttcatgttgccgcctcgccgcagtagcagcttacatggatacgctgtttaggttggttagccttcaagcctccgaacagcagcagcagcagcaatcggcgtcctacaactcgaggagcaccacgtcgagcggctccaggtcgtcgtcgcaccagaccaacgcatcctacaactactactaccacagcaacagcagcggcggcggcggcggcgggcagtactactacggtcagcagcacccacagcagcaccagcaccagcagtactacctggagccgtaccagcaagaagaatgcggcaacacccaccacctttacatggatgaagacttctcctcctcgtcctcgtcgaggcagcatttccactcgcacggcgcggtggtgcagccgccgacgtcgtccacggccacgcccacggcgccgacgccctcgctgtccacgtcgtccacggccgctggggcggcgcacgcgctgttcgaggcggccgacctgtcgttcccgcctgacctcaacctcgacttctcatccccggcctcgtcgtccggcgggggcgcggcctcgtcggcggcggtcgggggaggtggcgggggaaggtgggcgagccagctgctgctggagtgcgcgcgcgcggtggcgggccgcgacagccagcgcgtgcagcagctgatgtggatgctcaacgagctggcctcgccgtacggggacgtcgagcagaagctggcgtcctacttcctccaggggctcttcgcgcgcctcacggcgtccggaccgcggacgctgcgcacgctcgcggcggcgtccgaccggaacacgtccttcgactccacgcggcgcacggcgctgcggttccaggagctcagcccgtggtcgtcgtttgggcacgtggccgccaacggcgccatcctggagtcgttcctggaggccgccgcggcgtcgccggagccccagaggctccacatcctcgacctcagcaacacgttctgcacgcagtggcccacgctgctggaggcgctcgccacgcggtccgccgacgacacgccgcacctgtcgatcaccacggtggtctcctccgcgccgtccgcgccgacggccgccgtgcagcgcgtgatgcgggagatcgggcagcggatggaaaagttcgcgcggctgatgggcgtgcccttcagcttccgcgcagtgcaccacgccggggaccttgcggggctcgacctcgacgcgctcgacctgcgcgacggcggcgccaccaccgcgctcgccatcaactgcgtcaactcgctgcgcggcgtggtgccgggcggtgcgcggagacgggacgcgttcgccgcgtccctccggcgtctcgatccgcgggttgttactgtcgtcgaggaggaggctgatctcgtggcttttgaccccggcgcgcccgatgaaagcggcgacacggaggcagcgttcctgaaggtgttcggcgagggcttgcggttcttctcggcttacatggactcgctggaagagagcttccccaagactagcaacgagaggctggcgctggagaggggagccggacgtgccattgtagacttggtctcgtgcccggcgtcggagtccatggagcggcgggagacggcggcttcatgggcccgccgcatgcggtcttccggcttctctccggtggcgttcagcgaggacgttgccgacgacgtgcggtcgttgctccgtcggtatcgggaaggctggtcgatgcgggacgccggtttagacgactcggaagccggagcaggcgtcttcctggcgtggaaggaacagcctctcgtgtgggcgagcgcgtggaggccatgatagagatccccgtcgacgcaagatgcaagctcggtgagtacgcctacgtggaacagcatgaaccacaggagaagcaagggcgccatccgccatacctagccggcgcgtggatgcaatgatccatgcagtggatcgggcgcacgtgcatgtgtgtatggcgagctgaatggctcacgcatctagggttttggagcagtagtagggattgctagttcacgcacacatggttgtatgcagcaaggtgatccaggaggaggtatggtcgatggttttaggttttagagttgcatctatttcaaatttggatcatcgatcgccacaagctcttggcgtgatgattccgattttcttgcttctttgtttttttgtcacatttctctgtgtttcttcatgtaattcaaggttaacaactttctgctccctctggagggatttacgtgcatggttttgtcatactttctctcattcctctgtttgcatttgcattgcatggttgttgagatgtcgcttcct

SEQ ID NO: 1965 - DNA, 1208 bp, Zea mays
  Clone ID: PAT_MRT4577_35131C.1
gccggccggccggccgggctcgtccgtttccgcatcggtgtatcttcgcccccggcgaaggcgctatcctcccgaccacccggcggtgccggtacgccggtaaggcaggtgaggaatccgtaggttgccagaccccgcgaccccgatcccgatcggtcgctggcgaggcggcgtgacctaccccggctcatcctctcaagccagacggtctggctgctgtgcatccccgttttggcggctaccttacctctggcaaggcaatcccccctcacccctggcaagcacgggagaacatggagagtgcttcagatgtacaaatgcaacatcgtgctgaagattccgagactacaattgagatcaaaatcaagacattggattcccagacatacaatttgcgtgtgaataaatgtgtgccagttcctctgttgaaagagaaaattgctactgtaactggaatattgtctgaacagcaacgcttgatttgtcgtgggagagtcttgaaggatgatgaactcttgtctgcttatcatgtcgaagatggtcatacattacatcttgttgttagacatccaggccagtcagctacatttggaaatgcagcaaccgaagctaacacatcaaattctggccgtcgtcatgggcccacagtggcaagaagtgtagtacttgaggctgttaatgtggatcctgggagcagtgaactcccagcttttgttgcgcagattctccaaagtgtgcttggaacaatcaatgcacaatctacgggtacaccaacatcttctgacaccggatctttagatccttcacaatcttccatcccaaatactataagagttgaactcgaccagcaacaagctcctctgctttttcagtctgaacccgcacatgagtcatctcaaccaaatgtcatccctgatgctttgacaactatgtctcagtacattaactttatgagggactcatttaggagggagggctttagtcttaatggacaaacagagggtaatgtggaaaacagaactgcagagcctgaatcagcttctgtgcttgggcttcataatgcatcattgctagctgaaaatatgcactctactaggcaaattattgttgaacaggctggtgcattgctgtctcaactctcaactcagctgggagatctagagaatgtaactgattctgcaatacgaagggacattcaaagtagtgca

SEQ ID NO: 1966 - DNA, 193 bp, Zea mays
  Clone ID: PAT_MRT4577_35394C.1
agctgcgaacaaaaaccttgctcattcttgtgtggtctcgtttcatagcgggagcaaacaaagggaacaacaggggtaccaacacctaattcaaaggttgaacggtcactaacacggtgacagaagctgacgggaacacgatactattgatagataagataactcggccgtagccaggatgggtccacaacat

SEQ ID NO: 1967 - DNA, 1276 bp, Zea mays
  UNSURE (1)..(1276): unsure at all n locations
  Clone ID: PAT_MRT4577_35583C.1
  unsure (1)..(1276): unsure at all n locations
ctcgggcggcgggcgggggtcgctcgcctgctatagactacccacgcgtatgctaggcattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgatcaccgacgctgcagtgacgggatgcagcaacaaagttccttacgaccctaacctgattaccggcatccaaggcctggatcagtactggagcaacatcaggtgccccagcaacaacgggcagagcagctggaaaacgncttgggaagaaggccggcgcctgctccggcctcagcgagaaagactacttcgagactgccctctccttccgtagccggataaacccactcgtacgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgaccccttcaagaagtggatgctcaagcagcagctcaacgaggacgacgaccctttccagctgcctggcgtcgccatggacaactgatacaccgtaccgtcgtctcagtttgcgtttctgtcaagtgtgcatggaataatactgtaactgtgtttcctgccgggcaatgcactgtgatatgatgcccaacgaataaatgtcgcttttatttttattcgacttcccccctgtaccgtgtggaaataaacctattataagcatcgtgttgaaactcatgatatgcatgagcagctagtgaaaagtttgaattctagatgaattgaaacacactattatatgattgcgaaaaaaaaaaaaaaaaaagcggccaaaaaaaaaaaaaaaaaaaaaaaaaaaaaaaaaaaaaaaaaaaaaaaactcgagggggggccc

SEQ ID NO: 1968 - DNA, 2636 bp, Zea mays
  Clone ID: PAT_MRT4577_35585C.1
aattcggcacgaggcgttccatatggcttcctgcaggatggcactcctccttaattggcttgctgctgctagtagtagcttcgcccgcgatcgctgatgacgactccggtatctactaccagctggctcttatggtatgtataataataattattatatctaatctaattaagaagaaggcccggccgccggcctgactgcatgcatgggacgcccgcgtgcagtggccaggagcatactgcgagcagaccagcgctgggtgctgcaagccgaccaccggcgtctcgccgcggcgactggcacgcggcgcggccggccgggattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgaccccttcaagaagtggatgctcaagcagcagctcaacgaggacgtacgacgaccctttccagctgcctggcgtcgccatggacaactgatacaccgtaccgtcgtctctgtttgcgtttctgtcaagtgtgcatggaataatactgtatccctttcaaagccaaagtatcgagcccaaggcgatcacaacaagagcggcatcaacgcgacgcgtgatccagtgcagcaagggcctcgacaagtacatgttccagctagcgcggcggggaacggcacgttcatcgactgccccgcgccgaagtagtacacctgctccaaggagatcctcttccacccccccacgaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttatcggaaaaaaaaaaaaaaaaaaaaaaaaaaaaaaaaaacttggcttctgcaggatggcactcctccttggcttgctgctgctagtagtagcttcgcccgcgatcgctgatgccggtatctactaccagctggctcttatgtggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttaaaaaaaaaaaaaaaaaaggcccctaaaaaataaaataaaaaaaaaaaaagtaaaaacatattgatattac

SEQ ID NO: 1969 - DNA, 389 bp, Zea mays
  Clone ID: PAT_MRT4577_35600C.1
ctggcttcttctccccctattaccaagtgcggttcggtttatggtaacttagggttttgtggatgggccatggcggcagctgatgtgaagtaccgatgcttcgtcggcgggcttgcctgggcacactcagcaacgagtcgctggagaatgccttcgcctgctaccgcgagatcctcgactacaaggacatcaccgaccgtgagacagggaggtctcgcggcttacgcttagataccttgtactacgagaactccatgctcgacgctatcgacaacatgaacggaaaggaactcgacggacgaaacatcaccgctaaccaagctcagacccgtgacggtggcggtggcggatgtagctacagtggctgtcgcggccgaggctgatatggt

SEQ ID NO: 1970 - DNA, 451 bp, Zea mays
  Clone ID: PAT_MRT4577_35623C.1
aaccgaaaattgatgatgttttgaaaaacaaagttttgaaccctggaccagtttggaagttttacctgcctggggaaaaaaaggacctgggattgtatctttgataagccctgctactaaaaatgttcacaaaacatggctttggaaaaatactggtgatccccacatcccccacccccaggcaatccggttgccaatgaggaggccgcctcaaacaaacccctgagctgggctttgcctatcaatcggaaccctgaaaggggagcaaaaaacgtaacccaccccaccctttccgaagaaggccacagaggaaggctctccaccgttttttccacaaatgcccaccttaaagttaggcctacctttgcggcccctctttttagaaggcttccccaggtggcccactccccttgggggccaagaccccgaaggggctctttttgaaaatccc

SEQ ID NO: 1971 - DNA, 343 bp, Zea mays
  Clone ID: PAT_MRT4577_35656C.1
gtttagaacctgtaaaatgttcactactggacagtcgcagtagaatctgtagcagccatggacgccagcggagccgtaagcaaggggaagaagggggcggccgggcgcaaggcaggcggacccaggaagaagtcggtgacgcgggccgtcaaggccgcgctggagttccccgtcgaacggatcgggcgctacctcaagaagggccggtacgcgcagcgcgtgtgcactggcgcccccgtctacctcgccgccgtactgtagtacctctgctgccaggttctagatttgccagggcacgcagcgaaagacaacatgaagacgcgcatcatctcgtgccacgtgc

SEQ ID NO: 1972 - DNA, 289 bp, Zea mays
  Clone ID: PAT_MRT4577_3574C.1
ggcgaaaaaaaacaaattttattcataaacaaaaggggttcacagatttttctccatacctacatgctcattgggggagacgcagttgaccacctaaagctggatacttacttattaaaactgatccagcatgggggaacatcggaagttcacatgcttacagacgacaaattttaataacaatagcctggcttggctgttttacagaataaccaaacgacacccccgaaattgcgccgttttaaaataaacaactcaaaagcaatattgccccagaagcccgttttac

SEQ ID NO: 1973 - DNA, 446 bp, Zea mays
  Clone ID: PAT_MRT4577_35832C.1
ataaatgtctttttttttttttgggaagccacatacattatacaaaaaattttttttttgaactataactcataagaaaactaaaagagggcaccaccaaagatgggggggggggggaacactgctaggtttgacaaagcaagttggttgaatggcagcaattgttgcagttgtaagagggtgccagcgttaggcccagcgccctggtagaacgccaacaactgtggttgcgtaaagaaggtagccgggctcacaccagctagctggctcaatggaagtagctgtagctgccgtaaataagcaagagagttcaatgctgccagttggatgaatggaaaaaattgctgggggtaggaaacaggtagctggctgaatggtagttcctgctcgtacaaaaaggaagcaaacttcaacgcagcttgatggtcgaacggaaaaaactgctt

SEQ ID NO: 1974 - DNA, 479 bp, Zea mays
  Clone ID: PAT_MRT4577_35964C.1
cggacgcttggtttccgctcgcggtcgcgggcggttcgagtcggaccccagagcccaatgcgccccgccgcgccgctctatgtcgcggaacggaagctaagtgcgtcacacgccagggccggtcgcgggcaccggaccggaagcacaggggcgccgtacgtgcagacatcggtcatgaaggtgctcgtcctcgccgtgctggcgctcgtctgcggcgtctccggcgctggtcagggcgaggaggatggcagaccgacgctgacggtcgcggtgggcgcggcgacggcgggctgagacgtctcgcagcgcgagaggatgcgacaagacaacgcacacccatggtaccagggatgggactgccactacatccatccgcacctgacgagccacatgcacggccgagccgacaaggttgaccagagatggggctggtaggcgcggggctgcacagtgaccaacttcgacgggacgctgatgct

SEQ ID NO: 1975 - DNA, 2626 bp, Zea mays
  Clone ID: PAT_MRT4577_360C.1
aaccaaagaaacttcatgcattggatgcaattcaaccattccaaaccaacttattgataattaatactagaaagtagagagacatgaaagcatagaaaatacagggtccagaatgtaaccacagataatgataagtcaggtaggtacgacacccagcaaccccttgcacgctatagcaaaagccagctcaagccaggtgaatgtctcggtagcaatcctttggtgatacacttcttttccgatttaagttgagatacagtagggttccgtctccaaagccaaggaagttacttggggccaacatccttcaacgcgcagatctgctcctcccccatcgcagactggacagtcacaacaagatccttcccgctttcgaacccttccttaatctgggccacaagagtctcatcagttgggagtctaagatcatccttagtgttgccatctgaagtaagaaggctcacaaatccatcctcagaaatatcaatcagctgatactcagtacggttcacatgcggaatgtcacagttgtgtgatgaaggaacaatatcttcaagctttttcccattgaatatgtctatggcgacaaagtggcatttggcgtggccatgcttaccagtcttggaggtagaaacctccacaaccttgcagggacggttcttgatgacgatgaagccgttcttacggacggtgccagcctgctgcgggtaggtcttggacgccccagcgtcggccttcgattcgaagtggtgctcctccgagtccgacatggcgatccctgtcttggatggatcaggcggaggcggaggagcagagagagaagaaatttttttttttttttcagagatcaagaaaacaataacgccaaacttaataacccagtagcaaagcgggggaataaagtcttacaacgtaagttgtaaaccacacaacgacagatagataagaaccgacagaaacataacacgataggagccactcagggcagatcacaggatagcagtggcacacaagcccgacgacgccgcgccagtagagcgtctagtactcgtcaccctcgtcgccgtcctcaccctcgtcaaactcagcaccgacctcctcgtagtccttctcaagcgccgccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagatcatacacacggcacgctgcaccttggccagatcaccgcctgggacgacgctgggaggctggtagttgattccgcacttgaagccagtcgggcaccagtccacgaactggatggggcgcttggtcttgattgtggccacagcagcgttcacgtccttgggaaccacatcaccacggtacatgaggcagcatgccatgtacttgccatggcgggggtcgcacttggccatcatggaggatggctcgaaggcgctgttggtgatttcggccacggacagctgctcgtggtaggccttctcagcagaaatgactggagcgtaggacgaaagcatgaagtggatcctcgggtagggcaccaggttggtctggaactcgttcacatcaacgttcagagcaccatcgaacctcagggaagccgtcagggatgagatgacctgggagacaagcctgttgaggttggtgtaggttgggcgctcaatgtcaagggagcggcggcagatgtcatagatggcctcattgtcgagcaggacagcaacatcagtgtgctcgaggagagagtgggtggacaggacactgttgtatggctcaaccacggatgtggacacctggggggatgggtacacggtgaaaccgagcttggacttcttgccatagtcaacagacaggcgctccaggaggagagaaccaagcccagagcccgttcctccaccaacagcgttgaagacgaggaagccctggagaccagtgcaattatctgcaagcttcctgatgcggtcaaggcacaggtcaacaatctccttgccaatggtgtagtgaccacgagcgaagttgttggctgcatcctccttgccactgatgagctgctcaggatggaagagctggcggtaggtgccagtcctcacctcatcgatgacagtgggctcaaggtcaacaaaaacagcacgggggacgtgcttcccagcgccagtctcactgaagaaggtgttgaaagcatcatcacctcccccaatggtcttgtcaccgggcatctggccatcagcctgaatgccatgctcgaggcagtacagctcccagcacgcgtttccgacctggataccagcctggccgatgtggatcgagatgcactccctcatggtgttgttgaacggggggagcggcggccggtggtgagaaatgggagaagggggggaattggggaaagctttgagtcgcggagataggcgagtacgaagacgcctgtctctgcggttctcagtgtagggttccaccggtttcctctcgacgccctttatagaacggaacgacagcctgggccacgatggacggatggagtgccggcgaagcgaaagcgcggacgcgtgg

SEQ ID NO: 1976 - DNA, 429 bp, Zea mays
  Clone ID: PAT_MRT4577_36122C.1
tacccgttccattaccccatatcccagatccaattcgtgtagtaattgctcctctgccgtcatgtgcctctctgaggagaagacctacactggacgcgagcacaagggcaaggatctctcgcacgcggacttcgtgcgactcgagattgagctcaccgcggtcgaaatgcccagcctcatggcctgccgcgccgcgttcgtccctgacagacccttcgccggcgctaggatctgggagcgtgtccacatgaccatccagaccgtcggactgattgagaccctcaccgcgctcggcgccgaggtccgctggcgctactgcaacatgttattgacgcaggaccacgccggcgtcgacatagcgcgcgactcggactgcgtgttcgtctggaagggggagaccctcgaggagtactggtggtgcaccgagcg

SEQ ID NO: 1977 - DNA, 268 bp, Zea mays
  Clone ID: PAT_MRT4577_36165C.1
ctctccgcctctgctcccacacccgtgcgtgtccgctccctccggtctgcgctcccacagcctcacccctgcgcccccgccgattcgcgtcgacctttgttggaaggaacgatggagcagaccttcatcatgatcaagcccgactgtgtccatcggggcctgatcgggggcatcatcagtcgcttcgagaagaaagggttctacctcaatgggatgaagttcatgaacgtggaggggtccttcgcgcacagcactacgctgacctttc

SEQ ID NO: 1978 - DNA, 3156 bp, Zea mays
  Clone ID: PAT_MRT4577_362C.1
aagtctgtccaccttccgcgtagactcggatcccacctagtcaatggagtgagcaacgagggttgggttcggcagcagcgagggaaaagccaaagccccccagggcagcaggaagcaatagaagcgagcgaggcagcggcgtggggcgaggagtggaggacaccgatccccgccggagagcgcgtccatcccaaatggcgactgcagcttcgcccgccgctgcctttccccacatcctctccctctcctcctaatcccctcccaatcccccccccctctctctctcttcctcgccagctggttcgttccgcacccgccgccgcattgggtgccgaggagggacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcaggttacatgatgttgtccacagcgagaagcggatatacctcgtcttcgagtacctggatctggacctcaagaagttcatggactcttgcccggagtttgctaagaatcccactttgattaagtcatacctctaccagatactccgtggcgttgcgtactgccattctcatagagttcttcaccgagatttgaaacctcagaacttgttgatagatcggcgtaataatgcactgaagcttgcagactttggtttagccagggcatttggaattcctgtccgtacatttactcatgaggtagtgacattatggtacagagctccagaaattctgcttggagcgaggcagtattccacaccagttgacgtgtggtctgtgggctgtatctttgcggaaatggtgaaccaaaagccactattccctggtgattctgagatcgacgaactgtttaagatattcagggtgctaggtacaccgaatgaacaaagttggcctggagtcagttgtttgcctgacttcaagactgctttccccaggtggcaagctcaggacctggcaacaatagtcccaaatcttgaacctgctggcttggaccttctctctaaaatgcttcggtatgagccaagcaaaagaatcacagctaggcaagcacttgagcacgagtacttcaaggaccttgagatggtacagtgacctgctaaatgtgcttggcgttgctttggcatttgtaattgtatgagctgagtcgctcattcctttttatgggcgtctgtactctctcattctctctgcatttttgtcgttcagctggatattttgaatctggtgtgttttgagatgtattaaggaatatcaaatagattaccgccttggtctctatttactgaaagtaaatatcctccatgtttatttcccccgtagcaaaaaagaaaaaaaaaaaaaaaaaaaaaaaaaaataaaaaaaaaaaaaaaaaaaaaagggggcggccgccctgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaaatccaagcttgggttcactgtgtacccttccccccaagtttctacttcggtagttgagccatacaacagtgtactgtccacccactccctcctcgagcacactgatgtggctatactgctggacaatgaggccatctacgacatctgccgccgatcccttgacattgagcgcccaacctacaccaacctcaacaggcttgtgtcccaggtcatctcatcccttactgcctccctgaggttcgatggtgctctgaacgtggatgttaacgagttccagaccaacctggtaccctacccgaggatccacttcatgctttcttcgtacgctccagtcatctctgctgagaaggcctaccacgagcagctctctgtggctgagatcaccaacagtgccttcgagccatcttccatgatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcctcctagcgttgtgcctggtggcgacctggccaaggtgcagcgtgccgtgtgcatgatctccaactccaccagtgttgtggaggtgttctcccgcatcgaccacaagttcgacctcatgtacgccaagcgtgccttcgtgcactggtacgtcggtgagggtatggaggaaggtgagttctctgaggcccgtgaggacctggcggcgctcgagaaggactacgaggaggtcggtgctgagttcgatgagggcgaggatggcgacgagggtgacgagtactagagaagtttgctgatgacgcagcatcaggccagtgtgctgcccttatcccgtgatctgccgagagttgctcctgctatcgtgttatgtgtgtctgttctgaagtattgtgtggtttacaacacctgatgttgtaagagttgttaattcccctgcattgctaccgggttattgagaataattatggctgtttacgttgttgcttcatctcggagatgctttacatttaccaccttgttcatcttttgtcatcagtaaaatcgagtcggcggatgattttcttgaaaaaaaaaaaaaaaaaaaaaaaaaaaaaaaaaaaaaaagcggcc

SEQ ID NO: 1979 - DNA, 284 bp, Zea mays
  Clone ID: PAT_MRT4577_36316C.1
ttttgggggatttttttatatgttcgtttttttttttttttgagacacatcaactccaatgacaagctcgctgcttaattggtcaattttagcagaatcctagcccaaacagtcggagaataaaaaaggtcactgtgccttggaattacggggggattagctgaaacaaccctccacttctaatctatgcacgtgttcatatagcgaaggcagtgacttagccccaccagcttgctttgtgcgagtagtattcggctagaacacatataccgacagacattttt

SEQ ID NO: 1980 - DNA, 421 bp, Zea mays
  Clone ID: PAT_MRT4577_36430C.1
aacggccggcatgtgctggcattcggccttgagctatctggaggattcggccttagcttatttctgggaagcgacaatctcacacaaaaactttattattgagactataacttattacaaactaaaagagggcaccaccaatgatgggttgttggtagaaacgctgctgggttggtcaaagaaagttggttgggggggtgaaattgttgaagttgtgagagggtgtcagcgttaggcgcagggtgctggtagaacggaaacaactgtggtatgtatacaagtaagggagtagggttaacaccagctagttgtttgaatggtagtagttgttggtgttgaaaataagtatgagagttaaatgctggcagttggatgaatggaagaaattggtggggtaaggtagtaggtagttggatgaatg

SEQ ID NO: 1981 - DNA, 1602 bp, Zea mays
  Clone ID: PAT_MRT4577_3650C.1
cattgggtacctcgaggccggccgggatatcggttaggttgtggtatttcattgctacaacatgggttattgtaaaataagacatgtcatttggataagactgttgtgcttgtatatatgtgtggaaccttcgcttgggtccgggctctacaccatagctgaagcctcagcttgcaggttgcagccgatgagaatcgagcgtgatctccacatggccacaggggacggagaaactagctacacgaaaaattctaggattcaagagaaaactatgtttcagatcaagcctgtccttgaggaggccacaagagcagtatacacagctctccaccctcaaaccatggttgttgctgacttaggctgctcatctgggcctaacacactacgcttcgtatccgaggtgattggcatcatagctcgccattgcaaagaatatggccgacaacatgaccacacacagcttcagttcttcctgaatgacctgcccggaaacgacttcaacaatctcttccagctgatccagcagttcaataagtcgacggcaataaaccacaagagtgaggcagctgaggcactacctcctccgtgctatatctctgggttgcctggctcctactacactaggatcttccctagcgaaagtgttcaccttttccattctttgttctgccttcagtggcgctctgaggcaccagagggcaacaaaaaaacatgcctagatatctacatcacaaagactatgtcaccgtcgatggtgaagttgtttcaacaacagtttcagaaggatttctccctcttcctcaggctacgctatgaggaactcgtgtccggtggccaaatggttctaacatttattggaaggaagcatgagaatgtgttcactggagagtctaaccatctttacggattgcttgcgcagtcactgaaatccctagttgatgagggtcttgtggagaaggaaaaacttgaatcattctatttaccaatgtattcaccatcggttggtgaagtggaggccatactaaagcaagttgggttgttcaacatgaatcatgtaaaagtattccagacaaattgggatccctacgatgacttggaaagtgatgttgtgcataacagtattaggagcggtgaaaatgttgctaagtgcctacgagcagttatgcagccgctagtcgcaagccaatttggagaacccattctcgataagttattcaaagagtacgctcgccgtgttgccaaacaccttgagaatgagaaaaccaagcatgctattattgtcctatccatcgagaaagcaattcacctgtgaagtgtattgtttctcactatctcgcttggcatgctactatttgtgtagaaaactttgtatgtatgtttttttgtgtgtttgtgtcactagtgtattgaattacatatggtgtttttgttgttttatttatcacttctcctgtattcctatattttatatgtctaagtttttaatgtgatttcatgcaacccttgtacaagcaattaatacaaataaattgcaccttttatgatcaaaaaaaaaaaaaaaaaaaaaaaaaaaaaaaaaaaaagggcgccctcgcgatctag

SEQ ID NO: 1982 - DNA, 409 bp, Zea mays
  Clone ID: PAT_MRT4577_36533C.1
gtgagcgatcaaggtatctgagctccagtcctcgatagctagctagtagaccgccctaccacaagtgttcttcacaaggtaaagagagaccacggcaagagatctcaatggcgtctgccaccgggctcaagtcctccttccgtcccaagaagtccgaatggggagccaccaagcagggcgccgagcccaggccgcccaccgtctccatgcgccgccgcgcctccgcctacgtcgatgagctcgggaagaccggtaaaacgatcgcgcaccggggaggggcatcctgccgatgcaccaatcgagcgcaactcgtggaaagcgtgtggcgtccatcggtctggagaacactgaggacaaccggcatgcagtagcgcacgatggtggttcacggagagcgcaccatgggcca

SEQ ID NO: 1983 - DNA, 1477 bp, Zea mays
  Clone ID: PAT_MRT4577_3653C.1
gccggcgggccggggaaggggattgtaaatgtgctagcttagcttgtatgtgctgagctttggctccccggcgcaccgctgaagcctcaactcgcagccagccatgccgatgagaatcgagcgtgatctccacatggccatagggaacggagaaactagctacacaaaaaattctaggattcaagagaaagctatgtttcagatgaagtcggtccttgaggaggccactagagcagtatgcacagctctcctcccacaaaccatggttgtggccgacttaggctgctcatccgggcctaacacactgcgcttcgtcactgaggtgactagaatcatagctcaccattgcaagctggagcacaaccgacgacatgaccacctgccgcagcttcagttctttctgaatgacctgcccggtaacgacttcaacaatctcttccagctcatcgagcagttcaataagtcgtcgacgacacacaagggagatgcagcaactgaggcactacagcctccttgctatatctccggattgccaggctcctactacactaggatcttccctagcgaaagcgttcatcttttccactctctgttctgccttcagtggcgctctcaggcaccagagcaactgaagggcacccaaaaatcatgcctagatatctacatcacaaagactatgtcaccatcgatggtgaagttgtttcaacagcagtttcagaaggacttctccctcttcctcaggctacgctatgaggaactcgtgtctggtggccaaatggttctaacatttattggaaggaagcatgaggatgtgttcactggagagtccaaccatctttacggattgcttgcgcagtcactgaaatccctagttgatgagggtcttgtggagaaagaaaaacttgagtcattctatcttccgatctactcaccgtcggttggtgaagtggaggcgatagtgaagcaacttgggttgttcaacatgaatcatgttaaagtatttgagataaattgggatccctacgatgactcagaaggtgatgatgtgcataacagtattgagagcggtgaaaatgttgctaagtgcctacgcgcagttatggagccgctggttgcaagccaatttggagaacgcatactcgacaagttattcaaagagtacgctcgccgtgttgccaaacaccttgagaatgagaaaaccaagcatgctgttcttgtcctatccatcgagaaagcaataattcatgtgtgaagtgtcttgtttctcactatatatctttccattattatcacatggtaatgtatgtttgttttgaatgtgcatgtttgtgtcactagctggtgtattgaatgtcatggtgtttttgttgttttctttatcgcttctcctatattttagatgcctgaattttaaggtgatttcaggcaacactcttgtacaaggaattaatacaaataaattgctccttttatgatc

SEQ ID NO: 1984 - DNA, 364 bp, Zea mays
  Clone ID: PAT_MRT4577_36578C.1
cccacgcgtacggccacgcgttcgggctgctcaagaatgctactagttcaaatatgtctggttaccaagcaatgagcatgcatgttatcatccacgctttttgtaggaggggcttcttatggaaccgcatgatcacagtctcagagacgagtctgccaaatatggacaaccatatcgaacgctgagattatcctcgatccgtagcctgggaggtccagaggatgagactctatcacttacacgtgtactgacgaggctactgctgccataacgggcatggctggatagactctggatggaccgaacatacggcttaatcactgctgcgagaggacaggtggcttccgccgcactggcggttata

SEQ ID NO: 1985 - DNA, 412 bp, Zea mays
  Clone ID: PAT_MRT4577_36609C.1
gcaacatataaagcacaatagtgttccaacaatggcagccaaaatatgatgcttgcttatgctcctaggtcttactgcaagtgctgctaccgcaaccattttattacaatgcttacaagctcctatagctgcctatcttactgcatacctctgaccagcggtgtctacagtatgtgaaaacctaattcttcaaccctacaggatccaacaggcaatcgcagcacgcattttacctgtatcacccttgttactccaacaactgtcagccctattacagcaggtacctatggtgcatttgatgacacatgacatcaaggtacaacaactacaacaacttgtgctaggaaaccttgctgcctactgtcagcaacagcacgattgttgcattcaaccgactggctgcatagaactc

SEQ ID NO: 1986 - DNA, 1280 bp, Zea mays
  Clone ID: PAT_MRT4577_36673C.1
ttcttatgcgtggccattgggctttgggctggtctcgccatcggcttcaccaccgagtacttcaccagcaacgcctacagcccggtccgggacgtcgctgactcatgcaggacgggcgctgcgaccaacgtcatcttcggcctcgccctcgggtacaagtccgtcatcgtgcccgtcttcgccatcgccgtgtccatctacgtcggcttcacgctggcatccatctacggcatcgcggtcgccgcgctcgggatgctgagcacggtcgccacggggctggccatcgacgcctacggccccatcagcgacaacgccggcgggatcgctgagatggcaggcatgagccgcaggatccggcaaagaaccgacgcgctcgacgccgccggcaacaccacggccgccattggcaagggattcgccatcggatcggctgcgctggtgtcgctggcgctgttcggcgcgttcgtgagccgcgcgggggtcgaggacgtgaacgtgctcaacccgaaggtgttcgtcggccttctcgtgggggcgatgctcccgtactggttctcggcgatgacgatgaagagcgtgggcagcgcagcactgaagatggtggaggaggtgcgccggcagttcatcaccatccctgggctcatggagggccgcgccgcgccggactacgcgcgctgcgtcaggatctccacggacgcgtcgctcaaggagatgatgccgccaggagcgctggtgctgctcgcgccgctggtcgccggcaccttcttcggagtcagcacgctcgcgggactactcgccggcgcactggtttccggtgtccagattgccatatctgcttcgaacagtggtggagcatgggacaatgccaagaaatatatagaggcaggtgcgtctgatcacgccaagtctctgggccccaaggggtcggacgctcacaaggctgccgtgatcggcgacaccatcggcgaccctctcaaggacacctccggaccgtccctcaacatcctgatcaagctcatggccgtcgagtctctagtatttgcgccattcttcgccgcccatggaggcctgatattcaagtagacagggcggaggattattgtacaacgtgattctgtagtaaaggcgcactggttgaacaaatgattctgcatcgtagattgagtagccatgacctgtgtattgttttcacatctcatgaatctgttttgcagacatgtgtaatttagtgaaagatattacaatcctaacaagagcaagaatgttttttgattgtggcc

SEQ ID NO: 1987 - DNA, 328 bp, Zea mays
  UNSURE (1)..(328): unsure at all n locations
  Clone ID: PAT_MRT4577_36721C.1
  unsure (1)..(328): unsure at all n locations
tcttcttcacaagtttttttttttttttttcnngaganncgaggcctttggggggggggtcaagtcctccttccttcccaagaagtccgaatggggcgccaccaggcacgccgccgcgcccaggccgcccaccgtctccatggtcgtccgcgcctccgcctacgccgatgagctcgtgaagaccgcgaaaacgatcgcttcgccgtggcggggcttcctggcgatggacgagtcgaacgcgacgtgcggtaagctggctggcgtccattcggctggggaacaccggtgccaaccgggtggctttcctgactgttggtggtcccggctc

SEQ ID NO: 1988 - DNA, 335 bp, Zea mays
  Clone ID: PAT_MRT4577_36948C.1
aaaaaaaaaaaaaaaaggaaacttgttttattgttaataaagaaacacgcgcgagggcttgtcaacttattattcggtacaacacaaatttttttttttaaaatgcaccccccacaaagggttgctgtaaaaacatggggggaatcgccatggccattgggttaaacatgaatggaaactggtgttgcaaaataatctgaaaaacggggtcccagggacattggggcattattttttgcaacattatgctcggaaagaccattggggacattatgctcggcattataaatggggacatcatgttaggcgtcatcatttggggcataatcactggc

SEQ ID NO: 1989 - DNA, 781 bp, Zea mays
  Clone ID: PAT_MRT4577_36961C.1
aggttaaagcgacgccgccgccgcaagccgtccgcctcgctcttctcccgagcctggtcctcatcctctcgcctctcctcctcaacacagatttaacaatctagagttagcgcctccgtccgtctcgtagctgctcagatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtctccgcggtgactccatcgtgctcatgggcaagaacaccctcatccgccgctgcatcaaggtgcactcggagaagaccagcaacaaggacttccttgagctcagcaacctcctcgtcggtaacgttggcctcatcttcaccaagggtgacctcaaggaggttcgcgaggaggtcgccaagtacaaggttggtgctcctgctcgtgttgggctagttgcacctgttgatgtggtggttccccctggcaacactggtctggatccctcccagacgtccttcttccaggtgcttaacattcccaccaagattaacaagggtactgtggaaattactatcccagtggagctaatcaagaaaggtgacaaggtgggctcctctgagtctgccctgcttgccaagcttggtatccgccccttctcatatggactggtcatctgcaatgtctatgacagtgggtcagtcttcagcccctgaggtcttgaccttactgaggaagacctga

SEQ ID NO: 1990 - DNA, 3641 bp, Zea mays
  UNSURE (1)..(3641): unsure at all n locations
  Clone ID: PAT_MRT4577_37056C.1
  unsure (1)..(3641): unsure at all n locations
ggcgcccgcgctagaaaagagtccatctcctccctccctggctcggctgtcggctcccttcgccaccgccttcacctccttccctaattcggcatcggcccactgttccccggcggcggcggagatgagcgtgtggaactacgtcgtcacggcgcacaagcccacaagcgtcagccattcctgcgtcggcaactttaccagccccaaccagctcaaccttattatcgcgaaatgcacccggatcgaaatccatttgcttacccctcagggccttcagccgatgcttgatgtgcctatatatggaagaattgcaacgattgagctcttccggcctcataatgagactcaggactttcttttcattgctacggagaggtacaaattctgtgttctgcaatgggacacagaaaaatcagagctaatcaccagagccatgggtgacgtttctgatcgcattggccgccctactgacaatggacagattggaatcattgaccctgactgtagactcattggtcttcatctctatgatggcttatttaaggttataccatttgacaacaaagggcagctgaaggaagctttcaatatcagacttgaagaacttcaagtactggacatcaaatttctacatggttgtgctaaacctactattgttgtcctctaccaggataataaagatgtgaggcatgttaagacttatgaagttgcactgaaggacaaagattttgttgagggtccttggtcccagaataatgtagataatggtgctggtttattaataccagtaccagctccacttggcggtgtgataataattggcgaggaacaaatagtttactgcaatgccaattccacatttaaagcgataccaataaaacaatccatcatcagagcttatggacgggttgacccagatggttctcgatatttactcggtgataatactggaattttgcatttacttgtccttacccatgaacgagaaagggttactggtttgaaaattgaatacctgggagagacttcgattgcatcatcgatttcgtatcttgataatggtgttgtttatgttggttcacggtttggcgattcacagctggtgaagctgaacctccaagctgatgcaagtggttcatttgttgaaattcttgaacggtatgttaatcttggaccgattgtggacttctgcgtggttgaccttgataggcagggtcaaggtcaggtggtcacttgttctggggcgtttaaagatggttcccttcgggtggttcgtaatggtatagggattaatgagcaggcttcagtagaactccaaggcataaagggattatggtcattgaaatcttcgatcaatgatccatttgacatgtaccttgtcgtgagctttataggtgagacacgattcttggcaatgaacatggaagatgaactagaagagacggagatagaggggtttgatgcacaacctcagcctctctcttgtcaaaatgcgatcaatgatcttcttatacaggttactgctaattctgttcggttagtcagttgcacctcccgggagttagtgaatcaatggaatgcaccagcaggattctcagtcaatgttgcttcagctaatgccagccaggttctgttggcaaccggtggtggccatcttgtttacctggaaattagggatgctaaacttgttgaagtgaagcatgctcagctagaacatgagatttcttgtcttgatttgaacccaattggggagaatccacaatatagttccctagctgctgtggggatgtggacagatataagtgttagaatattttcgcttccagatcttgaattgataaggaaggaaaatttgggtggagaaattgttcctcggtctgttctgctgtgcaccttggagggggtttcgtatttgctttgtgctcttggggatggtaatttgttcagttttctactgaatgcaagtacaggtgaactgactgatagaaagaaggttaccctcgggacccaacccatcagccttcgtaccttctcatcaaagggtaccacccacgtgttcgcttcgtcagataggccaactgtcatctatagcagcaataagaagcttctctacagcaatgtcaatttgaaagaggttaatcatatgtgccctttcaatacagccgcttttccagacagtcttgcaattgctaaagagggtgaactttcaattggaactatcgatgatatacagaagcttcatatccgcacaatcccccttaatgaacaagcacgtcgcatttgtcaccaggagcaatcaaagacactagcattttgcagtttcaagtacaaccagagtgtggaggaaagtgagactcacttaatacgtctgctagatcatcagacttttgagtccctgtgtgtgtatcctctagaccaatatgaatgtggctgctccatcattagctgttcgtttgcggatgacagtaatgtttattactgtgtgggaactgcatatgttatacctgaagaaaatgaaccgaccaagggccgaatccttgtatttgcagttgaagatggaagtttgcaattgattgtggagaaagaaaccaaaggagcagtttattcgctgaatgcattcaatgggaaattgttggctgctatcaaccagaagattcaattgtataagtggatgtcacgcgaggatggttcacatgagctgcagtctgagtgtggccaccatgggcacatacttgccttgtatactcaaacacgtggtgacttcattgtggttggcgatctgatgaagtcaatttccttgctggtgtataagcatgaggaaagcgcgatcgaagagcgtgctagggattacaatgcaaactggatgactgcagttgagatgcttgatgatgaagtctatgttggggcggagaatggctataacttattcaccgtgcgcaagaacagtgatgctgccacagatgacgaaagggccaggcttgaggtggtgggagagtaccaccttggggagtttgtgaacagattccgccatggttcactggtgatgcgccttccagactcggatatagggcagatccctacggtcatctttggcacaataaacggggtgattggcattattgcctccctcccgcacgaccaatacatcttcctggagaagctccagtcgacccttgtgaagtacataaagggcgtcggaaacctgagccacgagcaatggcggtccttccataacgacaagaagacggcggaggctcggaacttcctcgacggtgacctgatcgagtctttccttgaccttagccggagcaagatggaggaggtgtccaaggcgatgggcgtccccgtggaggagctgtccaagagggtggaagagctgacgaggcttcactagtgtagatggaacatggaagcgttgcttgtaagcaagtagtaacttgttccctgagctgtagcctccgcggctcgcacgatcaaagtgttcggccgtggctgcagtctatcctatgctatatcctatcgtgatttgtttgtttgagctgtgccagtttcttttctttattattaatgcttaatgttaaaattaaaaaaaaaaaaaaaaaaaaaaaaaaaaaaaaaaaaaaaaaaaaaaaaaaaanaag

SEQ ID NO: 1991 - DNA, 109 bp, Zea mays
  Clone ID: PAT_MRT4577_3717C.1
agacatgttctgccatatgatggcgttgctgtatgggggctattctgtttggcaaccatcttggtgtcgtcaatagcgcacttgaatatctcgcgaaggatctagggat

SEQ ID NO: 1992 - DNA, 279 bp, Zea mays
  Clone ID: PAT_MRT4577_37192C.1
gttgcttagtcatgtctggccgtggtaaaggtggaaaaggtttgggtaagggaggggctaagcgtcatcgcaaggttttgcgcgataacatccagggcatcactaagccagctatccggcgccttgctcgtcgcggcggtgtcaagcgaatttctggccttatctatgaggagactcgcggtgttctgaaggtgttcctggagaacgtgattcgtgacgctgtcacttacacagagcacgccaaacgcaagaccgtgacagcaatggatgtggtctacg

SEQ ID NO: 1993 - DNA, 1127 bp, Zea mays
  Clone ID: PAT_MRT4577_37203C.1
aattcggcacgacggaggaaccagtctaagccaccacccaggccccagctcacctctttcctctcttctcatgcccacgcgctcgcctatctcatagtccttccccattccgcctctctagctggcctgtcgaggaccctcgccatcctccccaggcgcaccaccaaacggtccaaacccccagcggcggcgctaggatttgagtctcagcgcgccggcaccgccaccgccaccggcggtgatggcagggcaggagcgtaggacaatcgatctggaggagggatgggcgtttatgcagaagggtatcaccaagctgaagaacatcctcgagggcaagcccgagcctcagttcagctccgaggactacatgatgctctacacgacgatatacaacatgtgcacgcagaagccgccgcacgactactcgcagcagctctacgacaagtatcgggagtcgttcgaggagtatatcacctccatggtactaccttcgctaagggagaaacatgatgagtttatgctgagggagctagtgcaaaggtggtcaaaccataaagtcatggttcgttggctctcgcgtttctttcattaccttgaccggtacttcatatcaaggaggtcacttaccccacttaaagaagttggtcttacttgcttccgagagttgatatatcaagagattaaagggcaagttaaagatgcggtgatagctctgatagacaaagaacgcgagggtgaacagattgaccggggtctgttgaagaatgtattggatatttttgttgaaattgggctgggtcaaatggagtgttatgagaatgactttgaagatttcttgctcaaggatactacagagtactactctgtcaaggctcaaagctggattcttgaggactcatgtggtgatttgcgtgcttatgggtcctgccacagcaagggctgctcgcatttgtaaattggccgttaaaatagacaatcttgacctgcattagatgatatgatgatgatatgaggaataggagaggcactcaagtacttgtttgccatctatgccaatgttttacctatatgtctgtatcaatgtttcagttaactgagatgagattatgcttgggggttgctttgct

SEQ ID NO: 1994 - DNA, 1132 bp, Zea mays
  Clone ID: PAT_MRT4577_37333C.1
gccttctcttctccagcgtccgatctctcccactcgccttcctcaccgcagctctcccggctcggtcccttcccacctccgccctccccccgcgctcggtcgctcgccacttgctctcccccccctccacgttgctcgcgcccgcgcttatataagcaggaggagctcatggcggacgctccggcgagccctgggggcggaggcgggagccacgagagcgggagccccaggggaggcggaggtggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctcggagttcatctccttcatcactagcgaggcgagtgacaagtgccagcacgagaagcggaagaccatcaatggcgacgacctgctgtgggccatggccacgctggggtttgaggactatattgaacccctcaaggtgtacctgcagaagtacagagagatggagggtgatagtaagttaacttcaaaatccagcgatggctccattaaaaaggatgcccttggtcatgtgggagcaagtagctcagctgtacaagggatgggtcagcaaggaacatacaaccaaggaatgggttatatgcaacctcagtaccataacggagatatctcgaactaatgaagacatggaccttttctgcaacagctgctcttccccgaggcgggtttttggtcgcagttatttactaagtaagacaccttgcggtgaccattaaagagtaaccaatcaccctgggtaggtcaatttttatctgcaagaactgatgaggccgcttggtaggagtaaatcgcttttcctgggaacgattgttggttagcgccgctactgtatgtatattgagataccttaacgattggtcttttggctgccatttggttacatgtatttgtatttggaggcataagtatcgtgtaatttgtgttatgactagtgtattgactattgaattatgagaagagctgctttagttgtaagatcaaaaaaaaaaaaaaaaaaaaaaaactcgagactagttctctctctctctctctcctcgtgc

SEQ ID NO: 1995 - DNA, 185 bp, Zea mays
  UNSURE (1)..(185): unsure at all n locations
  Clone ID: PAT_MRT4577_37451C.1
  unsure (1)..(185): unsure at all n locations
cggggacaacgcgcaacaccgtcaagcgccggctgcagctacgcgttacaaacatgacncaccggcgggntcctcgctcaccttcgngatcgngtcctngagnncgacctctaccttcttangcccggnctcgccgctactgctcacccggnacagacatcaaccggagntgctaccaccccgtg

SEQ ID NO: 1996 - DNA, 1072 bp, Zea mays
  Clone ID: PAT_MRT4577_37519C.1
tttttttttttgttttttttttttttttttttttttttttttttttttttttttttgggctttttaagcaactcctgttgcaccacccttgcgttttgccgcgcctacacgagggacagagcgtaagccacggtcctggcattttttttaaagggggagacacggggcccatcgccctgtatggaaacccattcgcgtggagcgtctcgtcgtctcgtctcgcctctcctctccttttcccccctccctgcacagcgccgctcaccgtcaccggaccacagcagcgatcgatggctgaggtacacaacgagcggcccgtggggatggtgggcggcgtccgggacgcgccggtgggccgcgagaacgacctcgaggccatcgagctcgcgcgcttcgcggtcgccgagcacaacagcaagaccaacgcgatgctggaattcgagaggctggtgaaggtgaggcaccaggtcgtggccgggaccctgcaccacttcaccgtcgaggtgaaggaggccggcggcggcgaaaagaagctgtacgaggccaaggtgtgggagaaggcgtgggagaacttcaagcagctgcagagcttcgagctcgtcggagacgccgcggtcgcctgaggcgcacaggcttttcgctggaggctggagcacaacaatgaaagaatttaactgtcatcccactggaaaagtatgatataatgaataaaccagcgtcttacccacatctcattctattacagtggtcaaatatctcattagggtacaatacatctgatttcccttatccttatccgagcggttcctggagaattccccaacccccttggcttatcttctcccacgcgcgcgcacgcagtctcattccgctgatgccttccttagcttcttctctgcgtcggccatcatggagccctggtcttctcctctaactccggtggtcgactctccgttcttctcggttgtccctgtatctctaactcccacaatgtaagttctctttgataaatatcctaggttcacctctccagtagcaagccccatcgtctagattttttttctatttgccc

SEQ ID NO: 1997 - DNA, 684 bp, Zea mays
  UNSURE (1)..(684): unsure at all n locations
  Clone ID: PAT_MRT4577_37567C.1
  unsure (1)..(684): unsure at all n locations
gccggccgggcttcgatctatctgaccgtcatcgagcgttcaacccacctccccctgcgactgtgccggccgtcgactgccgcgctacttcgtgcccttttctgtcgacgatcccaccaatgacttgctgatggagattgacagtcctcagacaaagatctgatcgaggtgctgataaacgatcattatcttctgctatagctctgaaagatggatcacatactgtgtgaaattgaggaggttattgcgaatgtgcagatgatgaatacaagaatctactgcgaaatgtatgaccacccatctcactccttgcagaactgaaagctaagctcaatgaattgacaccactaaacccgctagaatgcaaccaaaaggagctcagtggtgctctgaccaaatatactcaaactgccttggcaagtctttcaataccacatatattcttagngcatacagaactgagatattttgaggtccatacagcaaacaatatgatagcgaatcatttctaccgccaagggctctttgatcttgctgacatgtatagtccctgagtgtgcggaactaggctcagcttccttgcagctaccggttcaggacatgtatgctatcgcttgaagccatgatagagacaacctcgagcctgctctcacgtggcgtgccaaaaaccatgatcatatgatg

SEQ ID NO: 1998 - DNA, 1703 bp, Zea mays
  Clone ID: PAT_MRT4577_37639C.1
gctgcatctctctcctcggtcctcgctcgctcggcttccctcctctctctctctccgccgagaccgagaggaggaggaggcaaggcaggcatccctgacgtacggacggcggccatggggacgcaggcgccggagaactaccccgccgagaaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagcttggctggggccctggcatcgcggtgctggtggtgtcgtgggtgatcacgctgtacacgctgtggcagatggtggagatgcacgagatggtgccggggaagcggttcgaccgttaccacgagctggggcagcacgcgttcggggaccggctgggcctgtggatcgtggtgccgcagcagctggtcgtcgaggtgggcgtgaacatcgtgtacatggtgaccggcggcaagtccctgaagaagttccacgacgtgctggtgtgcggcgacacgggggtgtgcgaggggaaggacaacatcaagaccacctacttcatcatgatcttcgcgtccgtccacttcgtcctctcgcagctccccaacttcaactccatctccggcgtctccctcgccgccgccgtcatgtcgctcagctactccaccatcgcgtggggcgcgtcggtgcacaaggggaggatgtcgggcgtcgactaccacctgcgcgcgaccaccacgccggggaaggtgttcggcttcttcggcgcgctgggggacgtggcgttcgcctacgccgggcacaacgtggtgctggagatccaggccaccatcccgtccacccccgacaagccgtccaagaagcccatgtggaagggcgtggtggtcgcctacgtcgtggtggcgctctgctacttccccgtcgcgctcatcggctactgggcgttcggaaacacggtcgaggacaacatcctcatcacgctcagcaagcccaagtggctcatcgcgctcgccaacatgatggtcgtcgtccacgtcatcggcagctaccagatctatgccatgccggtgtttgacatgatagagaccgtgctggtgaagaagctgcgcttccctcccggcctcacgctgcgtctgatagctcggaccctctatgttgcgttcacgatgttcatagccatcaccttccccttcttcggtgggctgctcggtttcttcggcgggttcgccttcgcgccgaccacctatttccttccctgcgtcatgtggctcgcaatctacaagcccaaaaggttcagcctctcctggttgaccaactggatgtgcatcattcttggggtgctcctgatgattctgtcgcccatcggagggctccggcaaataataatggaagcgaaaacctaccagttctactcgtgagctctaccaccagccatgacttgtgacttgtaagcacgattggagaaatctgtcaaagcctcaaccacgagtttttttttgtcatgccaaacacatacatatacgtactgtttcttaatattcaaaggtgttcttcgtggcttgcgtgtgtacagtattatgtgtatgagggagacttttaagtttaatgatgctggctgtcaaagataatggcggttcaattacacttt

SEQ ID NO: 1999 - DNA, 2577 bp, Zea mays
  UNSURE (1)..(2577): unsure at all n locations
  Clone ID: PAT_MRT4577_37645C.1
  unsure (1)..(2577): unsure at all n locations
cattggtacctcgagccggccgggaatcctcctcctccttctcctcctaccgcagcccgcagggaggtggagttgtcaacgtgccgaggactggagcggcccgcgtcctctataaacgagacgcccggccatttcctctgctcctctctgttcccccctgcctgcctgcttccagctgcatctctctcctcggtcctcgctcgctcggcttccctctctccgccgagaccgagaggaggcatccctgacgtacggacggcggccatggggacgcaggcgccggagaactaccccgccgagaaggtacaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagctcggctggggccctggcatcgcggtgctggtggtgtcgtgggtgatcacgctgtacacgctgtggcagatggtggagatgcacgagatggtccccgggaagcggttcgaccgttaccacgagctggggcagcacgcgttcggggaccggctgggcctgtggatcgtggtgccgcagcagctggtcgtcgaggtgggcgtgaacatcgtgtacatggtgaccggcggcaagtccctgaagaagttccacgacgtgctggtgtgcggcgacaacggggtgtgcgaggggaaggacaacatcaagaccacctacttcatcatgatcttcgcgtccgtccacttcgtcctctcgcagctccccaacttcaactccatctccggggtctccctcgccgccgccgtcatgtcgctcagctactccaccatcgcgtggggcgcgtcggtgcacaaggggaggatgtcgggcgtcgactaccacctgcgcgcgaccaccacgccggggaaggtgttcggcttcttcggcgcgctnnnnnacgtggcgttcgcctacgccggccacaacgtggtgctggagatccaggccaccatcccgtccannnnngacaagccgtccaagaagcccatgtggaagggcgtggtggtcgcctacgtcgtggtggcgctctgctacttccccgtcgcgctcatcggctactgggcgttcggaaacacggtcgaggacaacatcctcatcacgctcagcaagcccaagtggcnnnnnnnnnnnnnnnnnnnnnnnnnnnnnnnnnnnnnnnnnngcagctaccagatctatgccatgccggtgtttgacatgatagagaccgtgctggtgaagaagctgcgcttccctcccggcctcacgctgcgtctgatcgctcggaccctctatgttgcgttcacgatgttcatagccatcaccttccccttcttcggtgggctgctcggtttcttcggcgggttcgccttcgcgccgaccacctatttccttccctgcgtcatgtggctcgcaatctacaagcccaagaggttcagcctctcctggttgaccaactggatgtgcatcattcttggggtgctcctgatgattctgtcgcccatcggagggctccggcaaataataatggacgcgaaaacctaccagttctactcgtgagctaccaccagccatgacttgtaagcacgattggagaaatctgtcaaagcctcacccccgagtttttgtttttgttttttgtcacccccaacccatacatatacgtactgtttttttaatattccccccccccccccctggcttgggtgtgtccagtattatgtgtatgagggagccataagtttaatgatgctggctgtcaaagataatggcggttctcgtcgtcgctctccttgtcgctagtagtactgtttactgtctgcttcggcgccaccgccaccgacaccgccaccgacggcgccattcgtctcctccccggcagctctggtgctgttggtcgaccgtgggagtgctgtgactatgtcaccaaggacccgattatcagcaggccgccccggtggcgctgcaacgacgtggtggacaagtgctccgccgactgccaagagtgcgaggagtcgctggccggcgacggcttcgtctgcgatgactggatcttcagcctgctcgagcccccggtctgcacacccaggccgtgggactgttgcgacttcgccgtctgcacaagggaatacatccccaactgccggtgcggcgacgtgggggagtcgtgccccagcaactgcaaagtgtgcgagtttgtggagtcggaccctcctggctaccgatgcctagacgtcttccacggctatcctggccccaggtgcacgccatttggatcggtaaaagcaattagctcagctcagctacttgctagtacgtagtacgtccacaaaaataaataaaagtggctagcgaacaaattaaagctgttacacctggttgttcgtcccgacatggacgatcagtcgattagactagctccatcgctagctgctgctactctctttcgcgcaatcgtgcgtcattaaatatcaatctggcgaagccactaggcctcgatcccactcc

SEQ ID NO: 2000 - DNA, 2320 bp, Zea mays
  Clone ID: PAT_MRT4577_37648C.1
gtgatgcatattccatggcgcggcggcgttggagcttctgtttgccctatactagtgatcacgtcatcagggcgtcaggcccccatcggtggatcagccgatcgatgggccgggaggccatgacgaactgatcaccctcgttgctagctggggtagggtgggagctggttacgaagaaatcacacagcccatctaaaagcgacgacgcgacggcatcctcccagcttccagcttccagcctccagcctccagcaccagggtgtcagagcgtgctccgaatcccccgccaagaaacgcgagagcctccatcacagctctgctgaggcctctcaattctgcccgtcgaagcgcccgcggcttttattactgtgtatatatatataatactacggcatctatcggtccctcaaatcctcctcctcctcctgccgcagcccgcagggaggtggagttgtcaacgtgccgaggactggagcgcccgcgtccggcgtctctataaacgagaccgcccggccatttggtctgctcctctctgttctcccctgcctgcctgcttccagctgcatctctctccgccgagaccgagaggaggaggaggcaagggaggcatccctgacgtacggacggcggccatggggacgcaggcgccggagaactaccccgccgagaaggtacaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagcttggctggggccctggcatcgcggtgctggtggtgtcgtgggtgatcacgctgtacacgctgtggcagatggtggagatgcacgagatggtccccgggaagcggttcgaccgttaccacgagctggggcagcacgcgttcggggaccggctgggcctgtggatcgtggtgccgcagcagctggtcgtcgaggtgggcgtgaacatcgtgtacatggtgaccggcggcaagtccctgaagaagttccacgacgtgctggtgtgcggcgacacgggggtgtgcgaggggaaggacaacatcaagaccacctacttcatcatgatcttcgcgtccgtccacttcgtcctctcgcagctccccaacttcaactccatctccggcgtctccctcgccgccgccgtcatgtcgctcagctactccaccatcgcgtggggcgcgtcggtgcacaaggggaggatgtcgggcgtggactaccacctgcgcgcgaccacgacgccggggaaggtgttcggcttcttcggcgcgctgggggacgtggcgttcgcctacgccggccacaacgtggtgctggagatccaggccaccatcccgtccacccccgacaagccgtccaagaagcccatgtggaagggcgtggtggtcgcctacgtcgtggtggcgctctgctacttccccgtcgcgctcatcggctactgggcgttcggaaacacggtcgaggacaacatcctcatcacgctcagcaagcccaagtggctcatcgcgctcgccaacatgatggtcgtcgtccatgtcatcggcagctaccaagatctatgccatgccggtgtttgacatgatagagaccgtgctggtgaagaagctgcgcttccctccccggcctcacgctgcgtctgatcgctcggaccctcctatgttgcgttcacgatgttcataaccatcaccttccccttcctcggtgggctgctcggtttcttcggcgggttcgccttcggcgccgaccacctatttccttccctgcgtcatgtggctcgcaatctacaagcccaagaggttcagcctctcctgggttgacaaactgggatgtgcaacaatcctgggggtgctcctgaataatctgtcgcccatcggagggctccggcaaataataatggacgcgaaaacctaccagttctactcgtgagctaccaccagccatgacttgtaagcacgattggagaaatctgtcaaagcctcaaccacgagtttttgtttttgttttttgtcatgccaaacacatacatatacgtactgtttttttaatattcaaaggtgttcttcgtggcttgcgtgtgtacagtattatgtgtatgagggagacataagtttaatgatgctggctgtcaaagataatggcggttcaattacactttcatctcacttgcttcgtagctaggactttggaaggggctacagtatgtatttgggattatttgagcagtgtgttttttgtcgtttct

SEQ ID NO: 2001 - DNA, 1885 bp, Zea mays
  Clone ID: PAT_MRT4577_37650C.1
gccggccggttcggaggtccctcaaatcctcctcctccttctcctcctaccgcagcccgcagggaggtggagttgtcaacgtgccgaggactggagcggcccgcgtcctctataaacgagacgcccggccatttcctctgctcctctctgttcccccctgcctgcctgcttccagctgcatctctctcctcggtcctcgctcgctcggcttccctctctccgccgagaccgagaggaggcatccctgacgtacggacggcggccatggggacgcaggcgccggagaactaccccgccgagaaggtacaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagcttggctggggccctggcatcgcggtgctggtggtgtcgtgggtgatcacgctgtacacgctgtggcagatggtggagatgcacgagatggtgccggggaagcggttcgaccgttaccacgagctggggcagcacgcgttcggggaccggctgggcctgtggatcgtggtgccgcagcagctggtcgtcgaggtgggcgtgaacatcgtgtacatggtgaccggcggcaagtccctgaagaagttccacgacgtgctggtgtgcggcgacacgggggtgtgcgaggggaaggacaacatcaagaccacctacttcatcatgatcttcgcgtccgtccacttcgtcctctcgcagctccccaacttcaactcccatctccggcgtctccctcgccggccgccgtcatgtcgctcagctactccaccatcgcgtggggcgcgtcggtgcacaaggggaggatgtcgggcgtggactaccacctgcgcgcgacgactacgccggggaaggtgttcggcttcttcggcgcgctgggggacgtggcgttcgcctacgccgggcacaacgtggtgctggagatccaggccaccatcccgtccacccccgacaagccgtccaagaagcccatgtggaagggcgtggtggtcgcctacgtcgtggtggcgctctgctacttccccgtcgcgctcatcggctactgggcgttcggaagcacggtcgaggacaacatcctcatcacgctcagcaagcccaagtggctcatcgcgctcgccaacatgatggtcgtcgtccatgtcatcggcagctaccagatctatgccatgccggtgtttgacatgatagagaccgtgctggtgaagaagctgcgcttccctcccggcctcacgctgcgtctgatcgctcggactctctatgttgcgttcaccatgttcatagccatcaccttccccttcttcggtgggctgctcggtttcttcggcgggttcgccttcgcgccgaccacctatttccttccctgcgtcatgtggctcgcaatctacaagcccaaaaggttcagcctctcctggttgaccaactggatgtgcatcattcttggggtgctcctgatgattctgtcgcccatcggagggctccggcaaataataatggaagcgaaaacctaccagttctactcgtgagctctaccaccagccatgacttgtgactgcacgattggagaaatctgtcaaagcctcaaccacgagtttttttttttgtcatgccaaacacatacatatacgtactgtttcttaatattcaaaggtgttcttcgtggcttgcgtgtgtacagtattatgtgtatgagggagacttttaagtttaatgatgctggctgtcaaagataatggcggttcaattacacttccaaaaaaaaaaaaaaaaaaggccccta

SEQ ID NO: 2002 - DNA, 223 bp, Zea mays
  Clone ID: PAT_MRT4577_37706C.1
aaacccgaacaaaagcattttttccgaacaaaagcatccatgggcccaattaatttttaaaatgaaaaggggggatcgaaacatagcacccgggccccatgggtcggttgggccaaacgaaggggggggcgtttcactcgtggttggggacccggacaagctgttttccgaccttgcgaccggggaagagtcctatgagcgccttgggcgcgctctttagccc

SEQ ID NO: 2003 - DNA, 288 bp, Zea mays
  Clone ID: PAT_MRT4577_37757C.1
ggccaccggtccggtcgttccggaagaacattatgttcgtgcagttcgacaagggggccgccgccgccaacggggacaagttcttgccggcgggaggcgggggttccccttttgtgaaggtgagcttggacggggcgccctaccttggcaaagtggaccttaagatgttcaggagcttccagcagttgttcaaggggcttgagaacatttttagcttctttaccattggaagctgtgggttttaagggatgaacggcgttaaccagagcaagctggtggattttttta

SEQ ID NO: 2004 - DNA, 2563 bp, Zea mays
  Clone ID: PAT_MRT4577_37761C.1
ggatcaattggtggtggtaggattttactccgatcagggttcaacacaggcgtatgaggatccggacaggcaacaagccagccgccgccaacaggtatgttccagtctgccgttcacttattacagacaagtatttatgtgctacagtaatagacctagttcacccatgggcctccaacgtacttggcattgggcttcttggtgcgtttgcttctctgcgctttggctgcagcctggtcgtcgatctccagtggcactgtcttctgggccttgtgacagatcaggagacctgcaccccggcgttgaggttgaggttgaggatgcgtgcggtggacctgatctccagggcggggctgatggagagcaggcccaccaagctctccggcgggacccgcatcccgcccacgttgatgcactccagccgccggcacttgttcaccagcgccaccagcccgccctccgtcacgtggcggcagctccacaggatgatgctcttaagatttgcgcagctgtttgtggctgccgggcggggccgggattttcagccgccccaccgcagcagcagagaagaggccgccgccgccgcgaccaagagccgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagcttaagaacggtgccgtcttcttccagaaggaaaaggcgtcacagccccgtaagaggaatcccatccttgcccctggtgaatgtttatttctgtggccgcttggcatggcatgtactgtcctttacatttgagatcagctctgatcgcagctcatgtcagctctgatcaatctctgaagggcttgatctctgcggcattgtttcaccacattaactgcattgcttgaaagatgcctgtcattcattgctgctgttaacttttgatgggcttaaaaaaaaaaaaaaaaaaaaaaaaaaaaaaaaaaaaaaaaaaaaaaaaaaaaaaaaaaaaaaaaaaaaaaaaaaaaaaaaaaaaatgtcctgctaaggactgaaaactgtagcaaattgggaccctcgaggccggccgggactagttgttcccaccgcaagcaaagcattttcgcccgccccaccgcagcagcagagaagaggccgccgccgcgaccaagagtcgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaacgccgtcgaggagctcaaacttgcaagggacatttatgagcatgctgttgttttgagtgtgaaacttgaggaccaagatgcatttgaacgtgatttctgccagctcaagccttattacatggatacatgtggcataattcccccctcaccagaggagtacccaattttgggactcaatcttctgaggctgttggttcagaatagaattgctgagttccatactgagctggagcttttacctgtcaaggcacttgagcatccttgcatcaagcatgctgtagagcttgagcaatccttcatggagggtgcctacaaccgagtgttaagcgctcggcaggctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatggggagtttaaagaatgggcgccgtctttcttccagaaggcaaaggaatcacagccccctacagggagatcccatccttgcagctcatcaacagacgctcagctatgcgagg

SEQ ID NO: 2005 - DNA, 3587 bp, Zea mays
  Clone ID: PAT_MRT4577_37763C.1
atttctttcgtttttttgtcggatcgccccgccgtgcaggggtcttcctcccgatcaggctccaacacccgcgtccggcggcagcaccctcacccctcaccaacccaagccgcaagcataacccgcagcacagaagaggagaggagtcgccgcgaccgagagctccagagcacgcccccggcacagcctccgacgatggatccgaagatgacagaggtgacccagatgttcgcccgcttcaaggcggcctacgcccgcaacgacctcaacacctgcgtcaccctcctctcgcagctcaaggtccatctcacccaattccccagccttccgcccttgtttcagcagacaccgaacattgtggaggagctcaacctcgcaagggatgtgtaggcgcatgctgtggttttgcgtgtgaaactggtgtgccacgcccgtcggggcactacatcctccggccctcgccccagcacccgacgagcccgccgtcgcccacgcggccaaaggccgataggaaccgtagtatgacagaggggacccagatgttcgcccgcttcaaggcggcctacacccgcaacgacctcgacgcctgcgtcaccctcctctcacagctcaaggtccatctcaccaaattccccagccttccgtcacctcatttgccgcagacccctaaaacaagtgatgggcttgctctgccacatgacatctatgtatatgtcatcgaactttacggcgaaactctaagacacaagagactttgatgagcgtaatatggttatgattttcaatctttcgggcatagataggacatgatcatgttctgttctggccgagatctgctcgcgtacacccctgaggagcacgccgcgtgggagaataagaatggtgctgtcttcttccagatggtgagggactcacggccctgcactgaaatcccgttgtagaggctgagcaatcattcctggagggtccctagagcggggtgtcaagcgctctgcatgatgtgccacccgagacctatcttttcttcccggcccttctcgcctggacagtgagagatgagatcgctgggtgcagcgaaaaggggtatgattccctatctgtaagtgatgcaaaacaaatgcttatgttcagttgtgaccaagatctgcacgagtacatcacagaggagcgcccggaatgggagcttaagaacggtgccgtcttcttccagaaggcaaaggagtcacagccctacaaggagatcccatccttgcagctcatcaaccagacgctcagctatgcgagggagctggagcgtattgtatgatttaatttcacagtaatccctggttgatgtttatttctgtggtcacttggcatggcatgtactgtcctttacatttgagatcagctctgatcgcagctcatgtcagctctgatcaatctctgaagggcttgatctctgcggcattgtttcaccacattaactgcattgcttgaaagatgcctgtcatccattgctgctgttaacttttgatgttcttaatacaaaaaaagcattttcgcccgccccaccgcagcagcagagaagaggccgccgccgcgaccaagagtcgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaacgctgtcgaggagctcaaacttgcaagggacatttatgagcatgctgttgttttgagtgtgaaacttgaggaccaagatgcatttgaacgtgatttctgccagctcaagccttattacatggatacatgtggcataattcccccctcaccagaggagtacccaattttgggactcaatcttctgaggctgttggttcagaatagaattgctgagttccatactgagctggagcttttacctgtcaaggcacttgagcatccttgcatcaagcatgctgtagagcttgagcaatccttcatggagggtgcctacaaccgagtgttaagcgctcggcaggctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagtttaagaatggcgccgtcttcttccagaaggcaaaggaatcacagccctacaaggagatcccatccttgcagctcatcaaccagacgctcagctatgcgagggagctggagcgtattgtatgatttaatttcgtatccctccgggggccgcaccctccactataacccaacccgcaagaaaaaacccgcagcagagaagaggagtcgccgcgaccgagagctccagagcacgcccccgccacagcctccgacgatggatccaaagatgacagaggtgacccagatgttcgcccgcttcaaggcggcctacgcccgcaacgacctcaacacctgcgtcaccctcctctcgcagctcaaggtccatctcacccaattccccagccttccgcccttgtttcagcagacaccgaacattgtggaggagctcaaacttgcaagggacatttatgagcatgctgttgttttgagtgtgaaacttgaggaccaagatgcgtttgaacgcgatttctgccagctgaagccttattacatggatacatgtggcataattcccgcctcgccagaggagtacccaattttgggactcaatcttctgaggctgttggttcagaatagaattgccgaattccacactgagctggagcttttacctgtcaaggcactcgagcatccttgcatcaagcatgctgtagagcttgagcaatccttcatggagggtgcctacaaccgagtgttaagcgctcggcaggctgtgccacatgagacctacgtttacttcatcgaccttctcgccaaaacagttagagatgagatcgctgggtgcagcgaaaaggggtatgattctctatctgtgagtgatgcaaagcaaatgcttatgttcagttctgaccaagatctgcacgagtacatcactgaggagcacccggaatgggagattaagaacggtgctgtcttcttccagaaggcgaaggagtcacagccctgcaaggagatcccatccttgcagcttatcaaccagacgctcagctacgccagggagctggagcgtattgtatgatttaaaccaatccctggtggttctttttccccctgtgaccgcttggcatggcttgtactgtcctttgcatttgggatcttctttgatcgcagctctcatctgactgaaacatcatgtgaatctctgaagggctcagtttctccggcattattctgttaacttcatttgtatttcaccacattaactgcattgcttgaaaaatgcccggcattcactgctgctgtgaacttttgattgaattaaccccccccccc

SEQ ID NO: 2006 - DNA, 2324 bp, Zea mays
  UNSURE (1)..(2324): unsure at all n locations
  Clone ID: PAT_MRT4577_37764C.1
  unsure (1)..(2324): unsure at all n locations
gnccgcttttggccgcttttttttttttttttttttaagtaaaacattttcatgttaactgctggttatgtaatgtgtggtatttcaagatgaacagcaaaacttgtatacagtcggagccctagtagtacatgcaccaagacagcacattgcaacgattaacaaagggaaaaagactgcaaaacggcatgaatcctgttcgccgcaccaaacggatctattcgtcgtttagctgtagacattgttgaggtagaagtacaggccagccaaggcgatgatcccgacgacgatggcaataggcaaggctttccccatgctctcctccttcttcagctcctccttcctcgcctttctggcatcggtggcgttcgcgttcttggagactgccggctcgtagggtctgaaccttctcttcggagctccacaaacagggcagaagtagttgtcagccagcttgtcgaacggcgtcctgtcgttgtagatgtacccgcagtcacggcagatgtaggcctgcttggacgcgacccgcatggtgatccgcgcggcagtggccacccggcgccgcgcaggcgccggcagccgcagcgaccacggggcggagaaggagggccgtggcggcgcggaccgctgtgccgccggcgcgcgcatgagtgacggggcctgcagggccatcgctgcagcgagagctgagcagtggccgagaaccgaacgtacgcgcgcgcggcgaggcgacggatagcaagcggtggcgaggagataagaatggggtggggaggcgattcccgcccgcccgcgagggagccacccaaggagacgaggatgccaacgccctaccttgctcttccagcccagcgggcggcgccccagactttaagaaatcgaaagctctcttcctccaacagacataccttatcagtccatcaccacaggtctggtctaaccggcggcggccggggcgtggtcgccccccacctccggttttgcgtcccagcccggtcctctcggttgaggagtctgctcaatcgctccacggcttccgcggggtcgctgtgtttctcttctcctctggcattgaaggaattttagttctcatccttgtctcttgcctccccatgcttggagcaggcagttcaaaaggttgacctatttgggaatctccggctttatgcttagtttcagctcgccgaagcatttggtcgctggctgcgtacgattccctatctgtaagtgatgcaaaacaaatcctcaatgttcagttctgaccaagatctgcagtagtacatcacagaggagcacccggaatgggagtttaagaatggcgcagtcttcttccagaaggcaaaggaatcacagccngacaaggagatcccatccttgcagctcatcaaccagacgctcagctatgcgagggagctggagcgtattgtatgatttaatttcacagtaatccctggtggatgtttatttctgtggccacttggcatggcatgtactgtcctttacatttgagatcagctctgatcgcagctcatgtcagctctgatcaatctctgaagggcttgatctctgcggcattgtaaaaccacattacccgcattgcttgaaagatgcctgtcattcattgctgctgttaccttttgataggcttccgatggaagacagagatcgcccagatgttacgcccgcattcaaggctggcctacacccgcaacgacctcgacgcctgcgtcaccctcctctcacagctcaaggtacatctaaccaaattccccatgctttcgccctcatttgagcagacacctaacgctgtcgaggagctcaaacttgcaagggacatttatgagcatgctgttgatttgagtgtgaaacttgaggaccaagatgcatttgaacgtgatttctgccagctcaagccttattacatggatacatgtggcataattcccccctcaccagaggagtacccaattttgggactcaatcttctgaggctgttggttcagaatagaattgctgagttccatactgagctggagcttttacctgtcaaggcacttgagcatccttgcatcaagcatgctgtatagcttgagcaatccttcatggagggtgcctacaaccgagtgttaagcgctcggcaggctgtgccacatgagacctatgtttacttcatggaccttctcgccaagacagttagagatgagatcgctgggtgcagcgaaaaggggtatgattccctatctgcaagtgatgcaaaacaaatgcttatgttcagttctgaccaagatctgcacgagtacatcacagatgagcacccggaatgg

SEQ ID NO: 2007 - DNA, 1262 bp, Zea mays
  Clone ID: PAT_MRT4577_37835C.1
caggttaaagcgacgccgccgccgcaagccgtccgcctcgctcttctcccgagcctggtcctcatcctctcgcctctctccccccacacagatttagcaatctaggtttagcgcctccgtccatctcgtagctgctgcgatggcgatcaagaggaccaaggccgagaagaagatcgcgtacgaccagaagctctgccagctgctcgaggagtacaccaaggtgctcatcgccgtcgccgacaatgtcggctccaagcagctccaggagatccgcaagggtctccgcggtgactccatcgtgctcatgggcaagaacaccctcatccgccgctgcatcaaggtgcactcggagaagaccggcaacaaggacttccttgagctcagcaacctcctcgtcggtaacgttggcctcatcttcaccaagggtgacctcaaggaggttcgcgaggaggtcgccaagtacaaggttggtgctcctgctcgtgttgggctagttgcacctgttgatgtggtggttccccctggcaacactggtctggatccctcccagacgtccttcttccaggtgctcaacattcccaccaagattaacaagggcactgtggaaattatcacccctgtggagctgatcaagaagggtgaaaaggtgggctcgtccgagtctgccctgctcgccaagctgggtatccgtcccttctcgtacggcctccaggtcaccagtgtctacgaggatgggtccgtgttcagccctgaggtgcttgacctttccgaggaggacctgattgagaagtttgccactggtgtctccatggttgcctccctgtcactggcgatctcgtacccgacccttgctgctgtgccccacatgttcatcaatgggtacaagaatgtgcttgctgttgctgtcgagacagactactcgtacccacatgctgacaagatcaaagagtacctcaaggacccaagcaagtttgctgttgccgccccggttgctgctggtgacgctggcgctgcagctgctcccaaggaagaagagaaagctgcggagcctgaagaggagtcggacgaggaaatgggcttcagcctcttcgacgactagagctgctgttttcgtcaaactgctgcaagttttagttttttttttatcatctacaagtactgtttcctatattttttagcagacaaattatcgtgtgtaatcgacaatgatatccccttaaattttaagaacctgtgttgtgtcactaaagttgatactgttt

SEQ ID NO: 2008 - DNA, 827 bp, Zea mays
  Clone ID: PAT_MRT4577_37871C.1
catcctctccatcggcggtcttcccccaagtcgtcgtctaaactaaaccctaatccccaaatccccgacgcagacaacacgacgcgcacctgcgttcacgaggagcaagcatgagtcgccacccaatcactaagtgggcacagaggtctgacagggtgttcttgacgatagagctgcccgacgccaaggatgtgaagctgaacttgaagcccgaaggtcatttcaacttctcggctaagggctcagatgacttgccctatgagtttgaccttgagctgtttgatgctgtgaatgtggaggagagcaaagcagctgttgccccaaggaccatatgctacctgatcaagaaagctgagagcaagtggtggccaaggctgctgaaaaaggagggcaaggcacctgtgttcttgaaggttgactgggacaaatggcaggatgaggatgatgaggatgttggatttaatgacttcagtgatatggacttctcgaaactggacatgggaggtgctgatgatgacgattttgaggatgacgaagacgatgtggttgaaagtgctaacaaagatgaagaaggtggtaagacagagaagagcaacggggaggaggaagcagctgccgcagcagcagccgctgaggaagtgaagccatgaagaagcatttgagtttgctccacgccataggtgtccatggtatctagctaggctaaatgttcccttagatttttggtgtaaaatctggaggatgaatacaaaacagttgtgctgttttagttttatctgaaccctgtgaactgctgatataatatttgatcagagctcatttgcgtc

SEQ ID NO: 2009 - DNA, 942 bp, Zea mays
  Clone ID: PAT_MRT4577_37872C.1
gttctgacttccgacgagcggcaccacacctatttttataacccacacacctttttttttttttttgcgtcgcatgatggatgcatataaactctgaccaaatattgtagcagcagttcacagggttcagccaaaaactaagacagcacaactgtttttgtatcctttacttcaataggcagtgagtggttcgacctccagattttacaccaaaaatccaagggaacgtctagcctagctagataccgtggacacccatggcgcggagcaaagtcaaatgattcttcatggcttcacttcctctgcagccgcaggagctgcttcctcctccttgctctcttctgtcttacctccttcttcatctttgttagcactttcaaccacatcatcttcatcatccccaatatcgtcgtcatcagcacctcctatgtccagtttcgagaagtccataccaccaaagtcattaaatccagcgtcttcatcatcctcgtcctgccatttgtcccagtcaaccttcaagaacacaggtggcttgccctcctgcttcagcagccttggccaccacccgctcttagctttctttatcaggtagcatatggtccttggggcaatagctgctttgctctcctccacattcacagcatcaaacagctcaatgtcaaactcatagggcaagtcatctgagcccttagctgagaagttgaaatggccttcaggcttcaagttcagcttcacatcctgggcgtcgggcagctctatcgtcaagaacaccctgtcggacctctgtgcccacttagtgatcgggtggcgactcatgcttccgcctcgtgaacggaggtgcgcgtcgtgtggtctgcgtcggggatttagggattggggtttagacgtcttgggggaagactgccgatggggagaggatgcggccgcgcccacgcgtccggc

SEQ ID NO: 2010 - DNA, 571 bp, Zea mays
  Clone ID: PAT_MRT4577_37945C.1
gtaggagacctgcacgctcctattacctgctcattaacgtgaaccaggccagcaccaagagcaagtttgacaactctgtatgggggccgtcactcactccctcatggtctgatgagggccaccgacattatgatcgccggaaacggtgcctaggaccgcggatactgcgatgttcgcaagggattgagcccctacactcaagcaggctggtgcccggaacatagggacctacatcgaccccatctgctccctccaggctctgatgaagggtctacaagacctaacgttcgaggacgtaatatattgaagctgacatcttaactaccaccactggcaacaacgatatcaccatgggagaccacatgaggaagatgaataacaatgctcatcgtctgcaacattgaccactacgacacagaaatcgatatgctcaggcttcagacctaccctggcgataagcgcatcaccatcaagccccatactgaccagatggtgttccccgagaccaacactggcatcattgtccatgctgagggtctcctgatgaaccttaggtgtgctactggccata

SEQ ID NO: 2011 - DNA, 449 bp, Zea mays
  UNSURE (1)..(449): unsure at all n locations
  Clone ID: PAT_MRT4577_37965C.1
  unsure (1)..(449): unsure at all n locations
ttttttttttttttttctaaaaatgtgctttcttatttctgggaagccacaaacatcagacaaaaactttattattgagctataactcataagaaactaaaagagggaccaccaatgagggggtgttgggaaaacgctgctgggggggggaaagcaagtggggtgaatgggancaattgtggcggttgtaagagggggccagcgttaggcgcagcgtgctgggaaaacggcaacaactgtgggtgtatcaagaagggggcagggctcacaccagctagctgggtgaatgggantaggtgtggcgtgggtaaataagcaggagagttcaatgcggccagtgtggtgagtgggaaaaattggtggggggaggcancaggtanctggctgaatggganttgtgtgggttgcaaataaaaagcagaggtcaatgcggctaggtgggtgaatgg

SEQ ID NO: 2012 - DNA, 577 bp, Zea mays
  UNSURE (1)..(577): unsure at all n locations
  Clone ID: PAT_MRT4577_37967C.1
  unsure (1)..(577): unsure at all n locations
aaaaagtactttcttatttctgggaagccacaaacatcagacaaaaaactttattattgagactataactcataagaaatctaaaagagggaccaccaatgagggggtgtggggaaaacgctgctgggtttgtgggagggggggggtgaatgggancaattgtggcagttgtaagagggggccagcgttaggcgcagcgtgctgggaaaacggcgacaactgtgggtgtgtcaagaagggggcaggggtcacaccagctagctgggtgaatgggantaggtgtggctgctgtgaataagcaggagagttcaatgcggccaggtgggtgaatgggaaaaattgctggggggaggcancaggtanctgggtgaatgggantgtggtggtgggcaaataagaagcagagttcaatgcggctagtgtggtgaatggaaaaaactgctgtggctgagagtangcancaaggggtgctancacaaggtgtggtanttgttgtgccctgatgtgttgtgcgaataaatgcgccanaggtgactgatgtaatanggctgatgattgttggaggagacaaggggat

SEQ ID NO: 2013 - DNA, 242 bp, Zea mays
  Clone ID: PAT_MRT4577_38034C.1
attcccgctcgagccactcgtcctccgagcgtccgcaactagcaacatattattcacaatagtgtaccaacaatgtcagccagaatatttttcctccttatgctccttggtctttctgcaagtgctgctactgctaccattttcccgcaatgctcacaatctcctatagcttcccttcttcccccttacctttcaccagtgttgtcttcattatgtcaaaacccaattctttaaccttacat

SEQ ID NO: 2014 - DNA, 393 bp, Zea mays
  UNSURE (1)..(393): unsure at all n locations
  Clone ID: PAT_MRT4577_38142C.1
  unsure (1)..(393): unsure at all n locations
agaaatgtactttcttatttctgggaagcctcaaacttcagacaaaaaacttttttgttgaactataactcataagaaatctaaaagagggcaccaccaatgatgggttgttggtggaacgctgctgggttggtgaaagcatgttggttgaatggcagctattgttgcagttgttagagggtgccagcgttaggcgcctcgtgctggttgaacggcaacaactgtggttgtctcaagaaggtagctgggctcacacctgcttgctggctgtgtggtcgtngttgttgctgctgttgttcagccggtgagttcagtgctgcctgttggttgcttggtagaaattgctgggggtcggccccctgttgctggctgcatgggcgttgttgttgttgc

SEQ ID NO: 2015 - DNA, 421 bp, Zea mays
  Clone ID: PAT_MRT4577_38299C.1
gttggcttctcctccccctccggttcggcttcgggttcgtgaggttctccggggttcggtttagggggtgagcggatctatatggcggcgaaagatgttgagtaccgatgcttcgtcagcggcctcacctgggccacggacgaccactccctacacaacgccttcagcacctacggcgaggtcctgaagtccaagatcatccatcgatcggctagacgcatgaggtcccgcggattcggcttcgacaccttctccactgatgaggcgatgcgtaacgccttcgacggcatgaacaggaaggagctggacggccgcaacatcaccttatacgaggcccactcccgcagagtccgtgtgagctgccgaggatgtggatacggtggtggccgttgaggcatctgatactgcggcggcgggcacc

SEQ ID NO: 2016 - DNA, 835 bp, Zea mays
  Clone ID: PAT_MRT4577_38506C.1
tcatttcaaataggtcttccagctaagttcaccatcttcaacttcggtgctcagaaggacgtgtccaactggggcctgttcttctgcgtggcagttggtctgtgggctggtctgattattgggtttgtgaccgagtactacactagcaatgcctacagccctgtgcaagatgttgccgattcctgcagaactggtgctgccaccaacgtcatcttcggtcttgccctgggttacaagtccgtcatcatcccaattttcgctattgctgtcagcatctacgtcagcttctctattgctgcgatgtacggcattgcaatggctgctcttggcatgcttagcacaatggcaactggtcttgcgatcgatgcttatggtcccattagtgacaatgctggtggaattgctgagatggctggcatgagccacagaatccgtgagaggactgatgctcttgatgctgctggcaacacaaccgctgctattggaaagggtttcgccgttggatcagctgctcttgtgtccctggcacttttcggtgcttttgtcagcagagccggcgtgaaggtcgtcgatgtcctatctcccaaggtgttcattggcctgattgttggagccatgcttccgtactggttctctgccatgaccatgaagagtgttggaagtgctgctctcaagatggttgaggaggtccgcaggcagttcaacaccatccccggactgatggagggaactgccaagcccgactatgccacctgtgtcaagatctccactgatgcttccatcagggagatgatcctcccgggtgctttggtcatgctcacccccctcattgtcg

SEQ ID NO: 2017 - DNA, 506 bp, Zea mays
  Clone ID: PAT_MRT4577_38545C.1
cgccagaggtaatttcgtcctcgattcgaccccgattcgtctcgcccgcgaccgggattccctccgccaggagcggatctgaacgctgcgctccgtggcgtcgcacgaatccgccatgaagggggacaaatccaagggcgccgccaaggacgatgccaagctgacgcgtgaagagcaaggggacggagaaccccgccaaggccaggaaggggaaggtcgccaaagaccccaacaagcctaagagggctaccagcgctttctgcacgttcatggaggaatttcgcaaggttttctaggagacaaaccctaagaacaagcctgccgcaggggaggaagaagttgctggcgacaggaggaaatcccggagagagacggcaaaggctccctatgtatccaaggcctaacacgctcaagctacagtaaaacaaggccatcaaaacctacaacaagggagagaggactgctaataagaaggctcccgccaaggagcaacaggaggcagacca

SEQ ID NO: 2018 - DNA, 367 bp, Zea mays
  Clone ID: PAT_MRT4577_38578C.1
gttccttagggtaatgtggaggggcgatggcggcgtctgatgtggagtaccgatgcttcgggggaggacttgcctgggccaccaacaaccagtccctagagaatgccttcccctcctacggcgagatcctcgactacaaggtcatcaccgaccggcagaccgcgaggtcccgccgcttcggctttgttaccttatcctgcgagaactccatgctcgacgctatcaataacatgaacggcaaggatctcgacggccgtaacatcaccgttaaccagacccactcccatgccggcggccgtggcaccggtggctacagcagaaagacggagcggcggcgccggttatgagtggccaacgccacgaccgc

SEQ ID NO: 2019 - DNA, 671 bp, Zea mays
  Clone ID: PAT_MRT4577_38644C.1
agaaaagccgccgccgccgcatcctgcagcagccgcatccgcagcaggcgagcgagatggtgtttgtgaagaaccagaagaccagggcctactccaagcggttccaagtgaagttcaagagaaggagacaggggaagaccgattacagggccaggctcaggctcaccaaccaagacaagaacaagtacaacacgcccaagtaccggtttgttgtacgatttaccaacaaagatgtcactgcccaaattgtgtacgctaccattgctggtgatatcgtgatggctgctgcctattcccatgagcttcctcggtatggtcttgaagttggcctcaccaactatgctgcagcgtactgcactggtctgcttttggcccgccgtgtgctcaagtgccgtgatttggatcaggaatatgagggcaatgttgaggccactggggaggacttctctgttgagccggctgatgagaggaggcctttccgcgcgctcttggatgttggccttattaggaccactactggaaaccgtgtgtttggtgcccttaagggagctttggatggtggtcttgatattccgcacagtgacaagagatttgctggcttcaagaaggatgagaagcagctggacgctgagattcaccgcaaatacatctatggagggcatgttgctgac

SEQ ID NO: 2020 - DNA, 1952 bp, Zea mays
  Clone ID: PAT_MRT4577_38702C.1
atcaacgcacaaggctgactgttttgccatgtgaggagaccgcggtgggttgctttgatgcttgtcaattaacgcacgctatgggcacttccgctgccgtcgtgcggcgcgcctgcaactgcaacgctaccacctcgactcgcccctgctagcagcatccgggaagctgccctgccactgccaggctgccacaccgaggtgctcccttgactccctctcctctcctcttctcgcgcacgtggtctgtgcccgtacgcggcggcgctgccgctcaccagaccggccgccgccacgtctgcttccgcgcctccccgcctcctcaccgtccgcccccttttacctgcctgatcattttattataaatgtggggcgagagaactcatcataagcactggcatcaaggtcatggtacctcggggaattccaacaacaaaaagcatgataagcggcagccaaaatttataccagacaattatagctccgtcgatgaggttactactgctctgcgagaagctggcctcgaatcgtcaaatctaatcctcggtattgatttcaccaaaagcaatgagtggtcaggcaggcattcctttagaagaaaatctctgcatgccattaatggcaccccaaatccatatgaacaagctatctctataatcgggcgaacgctgtcaccttttgacgatgataacttgataccatgttttggatttggcgatgcttctacacatgatcattctgtgttcagtttctacccagagaaccgaccctgtcgtggctttgaggaggttcttgtaaggtatcgacagattgtaccacatttgaacctttcaggaccaacttcttttgcacctcttatttatgcagcgatttctgttgttgaaaacagtaattggcagtaccatgtcctcgtgatcatagctgatggacaggtgactgccgcgaatataaatgatggaagattaagtccacaggaacaagcaactatacaagcaattgtcgatgctagctactatcctctttcaatagtaatggttggggtgggtgatggaccatgggatgcgatgcagcattttgatgactgtatccctgaaagagcttttgacaattttcagtttgtgaacttcactggtattatgtcaacaagtaaggatatgtcaaagaaggaggctgcatttgcccttgcagctcttatggaaataccttctcagtataaagcaacgcaaggcctccgacctccagaaaagcaagcacaaaggattggctctcctaggattcttcctcctccaaataaagttcttgaaaatgataatgccgccgccgctgcttcgcaccctcctcaaactgcaagctcgaaatcaactggtattggcaaaagtgctgctgacgagcaggtatgccccatatgtctaaccaatccaaaggacatggcttttcagtgtggtcatctgacatgtaaggaatgtggcccaacactatcaacgtgcccattgtgccgcgctctaatcaccatgcgtgtgaggctctactcctaagtcggttggtgtctggagggatgggaccaaacagaaaggagcaagaactttggggcgcaaggactgcgctacgatcttgagatatggtccatatggatgtcatgataacgatgcatgtacagaaaccttgtccgtgcctattcagtaatgtcgttgatgagtatcttccatcaatcacatgtaaaatttctaatgttatcttgtattagtagcaggggattgcttgttgagtggaataccaccagttgttcagcaacagatagtaaactccatgtgcatttggaagtcacttttgtgatttgtgtcaaaaaaaaaaaaaaaaaaagccaaaataaaaaaaaaagggttttttaataattttataaaatataaataataatatatacaatataaataataataatacctcggagggggggt

SEQ ID NO: 2021 - DNA, 279 bp, Zea mays
  Clone ID: PAT_MRT4577_38703C.1
aggaactgagcggtggggcccgcgcggctcttatatcctgttcgctaccgtgatgtttacgctagtccagagggtttatcttccgtcctcttctttggtggtgcccattttggtttttgattgcaagggccctttttgtcaagtggtaatgctggggtcattctcggcttcagcaaacccatgcattaaccaacatggactgtggatcgatggatgcttttactcctgtcaagatttgttcttaattaattctaaggaaaaaatggtgcttcttggtgc

SEQ ID NO: 2022 - DNA, 325 bp, Zea mays
  Clone ID: PAT_MRT4577_3890C.1
cggcaaggagctcgacggccgtaacatcaccgctaaccaggcccaatcccgtggcggtggcggtggcggcggaggctacggcggcggtcgcatgcggcagcagcagctatggcggcaggcgccgtgaccgcggttatggcggctgcggcagctactgcgtgtcggcgcgaaggtggcggctgcggctactgacgcagaggcggatacgagggtcggcgcgagggtggcggcggcggctacgtgctgcagtgcatgctgcggctgcaggtactgatgtgtaggcccatgctggcttctgccgaggtatattatctatctatagtat

SEQ ID NO: 2023 - DNA, 316 bp, Zea mays
  UNSURE (1)..(316): unsure at all n locations
  Clone ID: PAT_MRT4577_39022C.1
  unsure (1)..(316): unsure at all n locations
cacttgctttccctccaacaagctaaggaaggcgggtcgtcatccctcttctagctcgttttattatccatggcggaggagaagcaccaccaccaccacctgttccaccataagaaggacgaggagcaggaggagcagctcgccggcggcgggtacggcgagtctttcgagtacaggggggggggggtgacngaggtggtgtccacggacaaaaacgagtacgaggagacaaggaggagaagcagtataagcacaagcagnacctnggngaggccggngccatngncgncggngccttngnactntacnagaagca

SEQ ID NO: 2024 - DNA, 375 bp, Zea mays
  Clone ID: PAT_MRT4577_39039C.1
gcaacgtagaaagcacaatagtgtaccaacaatggcagccaaaatattttgcttccttatgctcgttggtctttctgcaagtgttggtaccgcaaccattttcccacaatgctcacaagctcctatagcttcccttctttccccataccttttaacaacggtgtctttaatgggtgaaaccccaattggttaacccttcaggatccaaccaggcattgcaaccagcattttaccattattacccttggtccttcaacaaccgtgagccctattacaggaattacctttgggccatttggggggacaaaacattagggcacaacaactacaacaacttgtgctagcaaaccttgctgcatactcttagcaacatca

SEQ ID NO: 2025 - DNA, 1678 bp, Zea mays
  Clone ID: PAT_MRT4577_39086C.1
gggtacctcgaggaattcggccggaggcgtgtacgcccaccagccaccacacatcctctctcccttccagtcccaggagcgtggcctcactctcctcgtcgcatcccccctcctcatcttcgcagcgcgggcggcggcaatggcgatggcctccacctacgcgccgggcggaggcgcgcgggcgctcgcgcagggtagatgcagggtccgcggtcccgcggggctgggcttcctcggcccctccaaggccgccggcctcccccgccccctcgccctcgccaggcggatgagcagccccgtcgcggtgggcgccaggctgcgatgcgcggcgtcgtcgtcccccgcggcggcgcggcccgccacggcgccgcgcttcatccagcacaagaaggaggccttctggttctaccgcttcctctccatcgtgtacgaccacgtcatcaatccgggccactggaccgaggacatgcgcgacgacgcgctggaacctgccgacctcttcagccgccacctcacggtcgtcgacgtcggcggcggcacggggttcaccacgctcggcatcgtcaagcacgtcaacccggagaacgtcacgctgctcgaccagtccccgcaccagctcgacaaggcccggcagaaggaggccctcaagggggtcaccatcatggagggcgacgccgaggacctcccgttccccaccgactccttcgaccgatacatctccgccggcagcatcgagtactggccagacccacagcgggggatcaaggaagcctacagggtcctgagatttggtgggctagcttgtgtgatcggcccggtctacccgaccttctggctgtcccgcttcttcgccgacatgtggatgctcttccccaaggaggaagagtacatcgagtggttcaagaaggctgggtttagggatgtcaagctgaagaggattggaccgaagtggtaccgcggtgtccgaaggcatggcctcatcatgggctgctccgtcacaggcgtcaagagagagcgcggtgactctcccttggagcttggtcccaaggcggaggatgtcagcaagccagtgaatccgatcaccttcctcttccgcttcctcgtaggaacgatatgtgctgcctactatgttctggtgcctatttacatgtggataaaggaccagatcgtgccaaaaggcatgccaatctgagtgaagggaatgagctgcatggaagagaggatagccaacgtctgaattttactcttctctatattagacgcttcctgcctgttttgtattaatacctcttgttttccttctgctatttacttcttgcactgctgttcctgtttgtggtaattaataatactaagacatcgatgttctcctgtttcttgagcatgactggttgcagtggaacctcgaaattaaattatatgatgtgtaatttagttggttaaattatataaatttgtatagtttatttggttcctggttcaacaaaattccttctttcttgtcaccagtacgatttctaagacctgttttgttactctatgctcaatctttgttacccttgttggatttcatctctagcttaatccaacttgcttataattagaatgcttataattagaaggcttcggactttggtgttgttagtattgttacgctaagtggtagagtggtaatatt

SEQ ID NO: 2026 - DNA, 711 bp, Zea mays
  Clone ID: PAT_MRT4577_3916C.1
cccacgcgtccggtgaggttccatctcacaatcgaatcatgtgggagtacctgcatgttatcacagggaggtcggcagttattgtaggaatcgtggcgcttttcacaggaatgaagcatttaggccataggtatgacagtgagaatgtagaggagctcacttgggccttaatgctgtgggtgctttcagttatcgttgttgtgctgtgcttggaatataaggaagtcaaaagaaggatcggtgacagaagtgccagagggcactgggtattaggcaacaccgaggaggaggattcagttgatcttttgcatcctgatggtgcagccaggaattcagaatctagcgctactggtgtaatggaggtgcagcttgaacctctcactagatgatgtagatcaatctgtcagatacaaatacacctgaatacctgatccatatcttatatggatgataggtcagccggcatggattttctggttcagaggaaattgatctggaatccccatgtttgttttaagcagaatggttccagactagacaagatgttcagattctgttcttaatttcatgcatcacacctttacattgtacagtgtacattttttttacaatagacaggtataatttgtgacactgccccagccattctttttgctattgatatttataaagggaaagaattaatttaggtggtcattggaatccccagcc

SEQ ID NO: 2027 - DNA, 404 bp, Zea mays
  Clone ID: PAT_MRT4577_39173C.1
tctacggcgccgggcaggtactttcttattttgggaagccacaaacatacacaaaaaaactttattattgaactataactcataagaaactaaaagaggcaccaccaatgatgggttgtaggtagaacgctaatgggtttgtcaaagcaagttggttgaatggcagcaattgttgcagttgtaagaggtgccaacgctaggcgcaacgtgctggtagaacggaaacaattgtggttgtgttaagaacgcatgagggctcacactagctagctggctgaatggtagcagcagctgctgctgtaaataaacatgagatttgaatagctgccactggcttgaatggacgaacacgctgggtgtcggcataacataactgggtgactagcagttgctccctcttacaa

SEQ ID NO: 2028 - DNA, 563 bp, Zea mays
  Clone ID: PAT_MRT4577_39195C.1
ccctctttctttcttcttttatttatttttcttttttattttctttttctttttttttctttggtttttttttttttttttttttaaaaaggactttcttatttctgggaagccacaaacatcatccaaaaaacttcattattgaagtataacccataagcaatctaaaagagggcccccccaatgatgggttgttggtaaaaccctgttgggtttgtcaaaacaagttggttgaatggcaacaattgttgcagttgtaaaagggggccagcgttaggcccaacgtgcaggtaaaacggcaacaactggtgttgggtcaaaaaggcaacagggctcacatcaactaactggctgaatggggggagctgttgctgttgtaaaaaaacagcaaagttcaatgctgccaattgggtgaatggaaaaaaatgctggggggaggcaacaactaactgaccgaatgggagttggtgttgcaaataaaccgcaaagttcaatgcaccccgttgggtgaaaggaaaaaactcccgttgcttgaaagtaggcaccaagggttcccaacacaa

SEQ ID NO: 2029 - DNA, 2682 bp, Zea mays
  Clone ID: PAT_MRT4577_39279C.1
tagcgatctagtctcctcctcttcatcccaccccacgcgtccgccctgcttcgctgttccctttccccgcccctacctggggcatctgcctctgaatcgcggcggctcccgaggcgccgcctggcgagcgtctaggcgccggtctacggcgacgatggaggtgtgatttggacgggagagagcgtggtggtgaggtctcggttttctcgatataggagatggcggcggcagaggcgcggggaggggagttccccgtgggcatgaaggtgctggttgtggacgacgacccgacgtgcctcgttgtgctcaagaggatgctccttgagtgccgatatgacgtgacaacatgtcctcaggctacaagagcactaactatgttgcgagagaataggcgtggttttgatgttataataagtgatgtccacatgccggatatggacggattcaggctacttgaacttgtaggccttgagatggaccttccagttatcatgatgtctgctgattcaagaacggatattgtaatgaacggaattaagcatggagcatgtgactatttaataaaacctgtcagaatggaggagctgaaaaacatctggcaacatgttattaggaaaaaatttaatgaaaacaaggaccatgagcattctggtagcctagatgacaccgatcgtaacagaccaaccaataatgataatgaatacgcttcctccgcgaatgatggaggtgatggcagctggaaatctcagagaaagaaaagagagaaagaagatgatgaaactgacctcgaaaatggtgatccttcttctacatcaaagaaaccaagagttgtttggtcagttgagcttcatcaacaatttgtgaatgcagtcaatcacctcgggatagacaaagctgtcccaaagaaaattttggaattgatgaatgtcccaggcttaaccagggaaaatgttgccagccatttgcagaaattcagactctacctgaagagaattgctcagcatcatgcaggaatacctcatccatttgttgcgcctgtatctagtgctaacgttgctccgttaggaggactggaattccaagctttggctgcttctggtcagatccctcctcaagctctggctgctttgcaggatgaactccttggtcgacctacaagcagtttggcgttgcctggaagggaccagtcatctttgcgagtggctgcaatcaaaggaaacaagcaccatgaagaaagagaaatagcatttggtcaacccatatacaagtgtcagaataatgcatatggtgcattccctcaaaacagcccagcagttggaggattgcaaccttttgcagcttggcccaataacaaagttggtatgactgattcaacaagcacattgggaaatgtgggcaattctcaaaatagcaatatgctattgcatgaattgcagcaacagccagacaccttgctgttaggaacccttcacaatattgatgccaaaccttctggtgtagttatgccatctcagtcgttaaatacattcccggctagtgagggtatctcacctaatcaaaatcccttgattataccatctcaacccccaagttttgtgtcatcaattcctccatccatgaaacatgaatctcttcttggattaccttcaacgtcaaccagtctgttgggcgggcttgatatggttaatcaagcttcaacaagtcaggctttgattagtagccatggaacaaatcttcctggtctcatgaaccgtagctcaaatgcaatcccttcaccaggaattagtaattttcaaagtggaaatattcattatgttgttaatcagaacgctatgggagttagctctaagccaccaggtgttctaaagaccgagagcactgactcactgagttgtagttatggctatattggtggtagcaccagtgtggactctggcttgttctcttctcagtccaaaaatccacagtatggtctactgcagaatcaaaatgatgttaacggcagctggtcgccttcacaagattttgatagttttggaaattctcttgggcaaggccaccctggtaccacttcatctaacttccagagttccgcccttgggaagttgcctgaccaaggacgagggagaaatcatgggtttgtcgggaaaggcacttgcattccaagccgctttgcagtggatgaggttgaatctccaactaacaacttgagccacagcattggaaacagtggagacatagtgaaccacgacatatttggatttagtggacatatgtgaaactttcttgaatttgtaagtagcgttgatcagtgagcactggaaacaaatctagtggtttgatgaatggttgctagtaatttcgtttcttttttttttcttctgtaattggtttataaagggaataatctatgtggcagcatgtggaatcttactttatagaagtttgttcagttcaaaggacttaaaattggtcagtcccttgtcatatagcttcttttctttgttctctttttctgtaattaccaattgtagcattatttttatgaccgtcgtaattcagcctagtcgatttattcccggccccaaatcggctatgtaacagcataggaatcttctttatagaagtttttcagtttaaaggacttaaattatcagtcccttgcgataaaaaaaaaaaaaa

SEQ ID NO: 2030 - DNA, 2747 bp, Zea mays
  Clone ID: PAT_MRT4577_39280C.1
gccagcggtgttattagcagtaactcgtaatcgctgcctgagctctccggccaatcgcgtcatttacttgctttactaatcacgcttagcgattttagtctcctcctcctcttcaccccacctcttcctccctcccttccctccctgttccctttcccacccctgcctgaggccttccgccttcgtctctgaatcgcggcggctcctgagtcccgaggcgccgcctgatgagcggctaggcgccggatctacggcagcgttggaggtctgatttggacgggagagagcgaggtgaggtctcggttttctcgatataggagatggcggcggcagaggcgcggggagcggacttccccgtggggatgaaggttctggttgtggacgacgacccgacgtgcctcgtcgtgctcaagaggatgctccttgagtgccggtacgacgtgacaacatgtccgcaggctacaagagcactaactatgttgcgagaaaataggcgtggttttgatgttataataagtgatgtccacatgccggatatggatggattcaggctacttgaacttgtaggccttgagatggatcttccggttatcagtcagtatatatttcttcttgtttttctgtttagtatgttaacatgtggtgttggaacacatcagaaataattgctgatgaaattgcagtgatgtctgctgattcaagaacggatattgtaatgaagggaattaagcatggagcatgtgactatttaataaaacctgtcagaatggaggagttgaaaaacatctggcaacatgttgttaggaaaaaatttaatggaaacaaggatcatgagcattctggtagcctagatgataccgatcgtaacagaccaaccaataatgataatgaatatgcttcctctgcgaatgatggaggtgatggcagctggaaatctcagaaaaagaaaagagagaaagaagatgatgaaactgacctagaaagtggcgatccttctacatcaaagaaaccaagagttgtttggtcagttgagcttcatcaacaatttgtgaatgcagtcaatcacctcgggatagacaaagctgttccaaagaaaattttggaattgatgaatgtccctggcttaaccagggaaaatgttgccagccatttgcagaaattcagactctacctgaagagaattgcacagcatcatgctggaatacctcatccatttgttgcgtctgcttctagtgctaaagttgctccgttaggaggactggaattccaagctttggctgcttctggtcagatccctcctcaagctctggctgctttgcaggatgaactccttggtcgacctacaagcagtttggcattgcctggaagagaccagtcatctttgcgactggctgcaatcaaaggaaacaagccccatggagagagagaaatagcatttggtcaacccatatacaagtgtcagaataacacgtatggtgcattttctcaaagcagcccagcagttggaggattgccatcttttgcagcttggcccaataacaaacttggtatgactgattcttcaaacacattgggaaatgtgggcaattctcaaaatagcaatatgttattgcatgaattgcagcaacagccagacaccttgctgtcaggaacccttcacaatattgatgtcaaaccttctggtgtagttatgccatctcagtcgttaaatgtgttcccggctagtgaaggcatctcacataatcaaaatccattggttataccatctcaatccccaagctttctggcatcagttcctccatccatgaaacatgaatcccttcttggatcaccttcaccatcaaccagtctgttgggtgggcttgatatggttaatcaagcttcaacaagtcagcctttgattagtagccatggagcaaatcttcctggtctcatgaaccgcagctcaaatgcaatgccttcaccaggaattagtaattttcaaagtgggaatattccttatgtggttactcagaatgctatgggagttagctcaagaccaccaggtgttctaaagactgagtgcactgaatcgctgactcatagttatggctatattggtggtagcaccagtgtggactctagcttgctctcttctcaggccaaaaatccacagtatggtttattgcagagtcaaaatgatgttagcagcagctggttgtcttcacaagattttgatagttttggaaattctcttgggcaaggccaccctggttccacttcgtctagcttccagagttccgctcttggcaaattgcctgaccaaggacgagggaggaatcatgggtttgtcgggaaaggcacttgcattccaagtcgctttgcggtggatgaggttggatctccaactaacttgagccacaacattgtaaacagtggagacatagtgaacccggacatattcggatttagtggacagatgtgaaactttcttgaatttgtaattagggttgatcagtgaggactggaaacaaatttagtggtttgaatggttgctcgtattttcgtttcttccttttccttctgtaattggtttataaggggaatcggctatgtgacagcatatggaatcttgctttatagaagtttgttcagtttaaaggacttgaaattaatcagtcccttgccatatagctcctttcctttgttctcttgtagcacaatttttatgacagtcgtaactcaacctagccgatttattcctaacc

SEQ ID NO: 2031 - DNA, 1150 bp, Zea mays
  Clone ID: PAT_MRT4577_39495C.1
catggcgtccgcccaaccctccaaaccaaggcggccaagccccttccatttgccaggcggccacaccatctgatccccaattcgtttccacctatcgagccaaggtgcgacgacggcggtcgcagcgtcccctccctccctccgtaccgctgccgccggtctaccaaaaggtgaaatatttacgcaagcgaaatcagtgtcttgaagatagcttccagatatgtggggttttgcatcaaatgcttgggcatccgggctggggaagaggagtcccccaaattgcacctcttcgagtgctgcttgttccgatgacgaagcatcctcgtgcacgagcagggaagaaggcctggaatgcccaatatgttgggagtctttcaatatagtggagaatgtgccttacgtgctatggtgcggccacaccctttgcaagaactgcgtcctaggacttcaatgggccgtcatcaaagttccaactgtgccgatgcagctacccttcttcgtttgctgtccctggtgcaacctcctgtcgcttcgcatactttacaaagggaacctcacgttcccacggaagaactatttcctcctctggatggttgaggggatgaatggtgagcgggccagatcacgcccagctactcacagcgagcaacatactccatggctctcaagcagcagcagagcaaatggaaatgcaggctgctcaaatcccacaagacgccaccttccactgccaccgccggttgacactacttcgcccaccaatgcaaatcatgccaaccatggggtccctgtccctctgctgaacgcagagagggtacaggcttcgctgcgcaagtccttgtcgttcctggttcacctgacctccaagtttcccctggtgttcatcttcctcctcatagtgctctatgcgatccctgccagcgcagcagtcttgctactgtacatccttatcacggtgctgttcgcgctcccctcgttcctgatactgtatttcgcgtatccgagcctggactggcttgttagggaaatctttgcctgagatttccttgttcggtaaaatctcaatgctgttgttgagtccttgtataactgaaccttccctagatcttgttgcaagcgtggatgctattgcaaagttttggtttttaca

SEQ ID NO: 2032 - DNA, 1513 bp, Zea mays
  Clone ID: PAT_MRT4577_39766C.1
attcggctcgaggtgggattgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcaggtcgattgcatggcttcccttatatggcgtcatcagcggttttgatacgtaccggccattcagatatttaggatatagtttgagaagtttcctggccaattcagtgtcgtagtgttttttatttgacatctgtgtacctaaatcttacaccatttctcaaaacacagccagggccaagggagagaccaatgcagtgctttatcaagaggaataagaacaactctacattctacctctaccttggcttcacaagttcacctgtggataaagggaagtttctcatggctgctagaagatttaggcgtggtccccataccgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtg

SEQ ID NO: 2033 - DNA, 1526 bp, Zea mays
  UNSURE (1)..(1526): unsure at all n locations
  Clone ID: PAT_MRT4577_39767C.1
  unsure (1)..(1526): unsure at all n locations
ctcgctatacgccttccgcgcgggcttttgaacaagaagagagagaaaaagaaaaaggagaggcccgcgactgtagtgggattgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcagccagggccaagggagagaccaatgcagtgctttatcaagaggaataagaacaactctacattctacctctaccttggcttcacaagttcacctgtggataaagggaagtttctcatggctgctagaagatttaggcgtggtccccataccgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtgaagtgatacttctcccttttctatcggccggggggggaaaaaacggggaaaaaaaaaaaaaaaaacaaaaangaagggcggccgccgactagagtagacgtcgacccaggaataaaa

SEQ ID NO: 2034 - DNA, 1989 bp, Zea mays
  UNSURE (1)..(1989): unsure at all n locations
  Clone ID: PAT_MRT4577_39768C.1
  unsure (1)..(1989): unsure at all n locations
ttgaacgcggttttgcacaagcgagcaaagagagggagagagagaaagaaaagaaaagaaaagaaggggagggccgcgactgtagtggggagatgcctcggcatactgcgcccgcggcgccgccatcggagcgcggcgagatggacgaggtggtagaggcggatccggacacggaggcggaggatcaggaggagaggtgggcgacgctgctaccagagttgctctccgacgtgttgctgcgcgtcgaggcctccggcgccgagcagtggccggcgcggaaggacatcgtctctttcgcctgcgtgtgccgctggtggcggaaggccgcagtctccgttgtgcgtcctccggcggagtccgccaagatcaccttcccctcctcgctcaagcagccagggcctagggagaacccaatgcaatgctttatcatgcggaataagaactctacattctacctctaccttggcttcacaagttcacctgtgtataaagggaagtttctcatggctgctagaagacttaggcgtggtccccatactgagtacattatatctcttgatgcagaggacttatcacaagggagcaattcatacatgggaaaactgagatctgatttctgggggacaaacttcaaaatatatgatagcaagccaccatatgacggcgctaaagcatcaagtagtcgatctagtcgtcgtttcggaagcagaaggattagtccccaagtatcgtctggtaactatgaagttggacaggtttcatacaaatacaacttgctcaaatccagaggccccaggagaatgaattgcactcttgaatgcccttcagcgcaagagacctgggaaaactcactcaagacaaagttcaggaggcccttgggtcccacaactttacgaaacaaagcgccccgctggcatgagcagctgcagtgctggtgcttaaacttccatgggcgggtaacagttgcatcggtcaagaatttccagcttgtgactgctgccggccccagtgaccctactagcaacgtggacgaggaaacggttctgctgcagtttggtaaggtcgacgatgatattttcacaatggattaccggcaaccgctctctgcgttccaagcttttgccatcagccttagcagctttgggaacaagctagcctgtgaatagcgatacggttcgatgctcgtcgcgtggctatatggtttgcggtggtgggtgcttgctcgccgttgttacaatgtgatctgttcttttttttttagttgagtatcgacgtactatttgtaccatgctgttgtacaagagatgcactatactgcattactgctgtgttgtcaaaaggacttgttcaagaaggaaatactgtgtcataaactttttgctctgattccatgcaaaaggcatttcggtggccggtgttaaaaaatattggattgtcaacggatttgttcaaggaaattatgtgtaatcaacttttgctctagttccatgcaaaagacatttcaatgtaaaaaaaaaaaaggtgaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttttttttttttttttttttcccccccccccccccccccgggggggaaaaccccccccggcgggggggaccccccccgtccccctttaaaaaccccccccccccgagggggggggggggtttccaaaaaaaaagggggggggggggccccaaaattggggggggacccccccccccggggggaaaccccgggggggggggggggggcccccccccccacccccccccccccnaggggggggggccctcaatatttgcctaaaaaaaaaaaggggggggga

SEQ ID NO: 2035 - DNA, 480 bp, Zea mays
  Clone ID: PAT_MRT4577_398C.1
aaaaactaaaaagtccttttttatttctgggaacccacaaccttcagcacaaaaacctttattatggacctttacctcataaaaaactaaaaagggccccaccaatgatgggttgtgggtaaacccctgctgggttggtcaaaccaggttggttgattggcaccatttgttgcagttgtaaaagggtcccaccgttaggcccaccgtcctggtaaaccggcaccacctggggttgtttcaaaaaggtaccaggcctaaccccacctacctggctgaatggtagtagttgttgctgctgaaaataaccaggaaagtccaatgctgccagttggttaaatggaaaaaattgctgggggtaggcaccaggtacctgcctaaatggaacttgttgttgttgcaaataaaaaccaaagttcaatgcacttagttggttaaatggaaaaaactgctgttgcttaaaagtagccaccaaggtttgcc

SEQ ID NO: 2036 - DNA, 380 bp, Zea mays
  Clone ID: PAT_MRT4577_40046C.1
agaaatgtacttccttattagtgggaagccacatacatcataccaaaaactttattattgcactataactcataagaaatctaaaagagggccccaccaatgacgggctgctggtagaatgctgttgggtttgtcaaaaccaagctggttaaatggcaccaattgatgcagctgtaagagggtgccatggttacgctccatgtgctggtagaactgcaaccatctgtgctgtgtcaataaggtaccagggctcacaccagctagctggctgaatgtgagtaggagctgctgctcgaaataaacaggagagctccaagctgcccgttggttgaatggaacaaactgctgggggtaggcaccacatagctggctgaatggta

SEQ ID NO: 2037 - DNA, 1899 bp, Zea mays
  Clone ID: PAT_MRT4577_40235C.1
tcccctgcaactgcaagtcgtcttcttccccaagcctaaaaccaacaacagtttggcagatcgcccggctcgatcgatcgcagccatggtgctctccaaggccgtctccgagagtgacatgtccgtgcactccacgttcgcgtcgcgctacgtccgctcgtctctcccaaggtaccgcatgccggagaactccatccccaaggaggcggcgtaccagatcatcaacgacgagctcatgctcgacgggaacccgcgcctcaacctggcgtccttcgtcaccacctggatggagcccgagtgcgacaagctcatcatggccgccatcaacaagaactacgtcgacatggacgagtaccccgtcaccaccgagctccagaaccggtgcgtgaacatgatcgcgcatctcttcaacgcgccgttgggcgagtccgagacggcggtgggcgtcggcacggtgggctcgtcggaggccatcatgcttgccgggctggccttcaagcgcaggtggcagaacaagcgcagggccgagggcaagccgttcgacaagcccaacattgtcaccggcgccaacgtccaggtttgctgggagaagttcgcgaggtacttcgaggtggagctcagggaggtgaagctgcgcgacggctactacgtgatggaccccgagaaggcggtggagatggtggacgagaacaccatctgcgtcgccgcgatcctgggctccacgctcaacggcgagttcgaggacgtgaagctgctcaacgacctgctccaagccaagaacagggagacccggtgggagacgcccatccacgtggacgcggcgagcggcggcttcatcgcgcccttcctgtacccggacctggagtgggacttccgcctgccgctggtcaagagcatcaacgtcagcggccacaagtacggcctcgtctacgccggcatcggctggtgcatctggcgcagcaaggaggacctgccggaggaactcatcttccacatcaactacctcggcgccgaccagcccacgttcacgctcaacttctccaagggctccagccaagtcatcgcgcagtactaccagctcatccgccacggcttcgaggggtacaggaacatcatggagaactgccacgagaacgccatggtgctcaaggagggcctggagaagacgggccgcttcgacatcgtgtccaaggacgaaggcgtcccgctggtggccttctccctcaaggaccgcagccggcacgacgagttcgagatctcggacatgctgcgccgcttcggctggatcgtgccggcatacaccatgccccccgacgcgcagcacgtcacggtgctccgcgtcgtcatccgggaggagttcagccgcaccctcgccgagcgcctcgttctcgacatcgagaaggtgatgtaccagctggacgcgctcccgtccaggctcccgccccctcccccggcggcgccgctgctcaggaaaaagacggagctggagacgcagaggtcggtcacggaggcgtggaagaagtttgtgctcgccaagaagaccaacggcgtctgctagtgacgcttccaccgctacacacaacactaccatggtcaacgggccttcttccgtgctgatttgagtgagcaccgcgatatctaggtagtctaatatgcttcgtgtctttccgtaatttgtgcatgcagttgctatgcaccgagtgagttgctatatatgttcgatagcaacagtttttttctccccaatgcaaggaagagagtaatagttgaggctggtgtcgattattgttatccatgcccatgcgcgtgcagttattacctccattctaaactgtaatctattttaatttcttcagagagtcaaagcccctcaagttttattaaacctataagatttat

SEQ ID NO: 2038 - DNA, 5088 bp, Zea mays
  Clone ID: PAT_MRT4577_40273C.1
ggcacgagctctgttcctcatctcccgttcaccccgccggcgccgggcgcgctctctccacgtggcgatctccgaccgtaacggccgctgcccgggttttcgccggtcccttctccacatcttctctgcacccctcgtctgcgacgagcacccaccagcagaatcaattggaccgtctgatacatctatcgattgagggaagcaggttctaccgcaaagcatataatggctggttttcacgtctaagtactgagcactatccggctgcatcgattaatatgcctcagtatatgcgctctgggtggcatctcttcttaatgctccattcgagatcaccagaattggtcaaggacccggtgtcctgcatccatggattagttggtgtgttggcgattcttttgattaacgtgccagctaaattgaggagcttcacgattgaaggctcttctcacttaatcaaacaaactgagaaaggcgtggatcttattgcttcattatgtcataactatcatacctctgaagaacgtttgaaagaaatgttgcacaagtctcacaatgcaatagaagacattttccatatgaaagcactaagtgcttcagagtgcaaaccagaaaatttggataagatagacacagatgacctgatgtatttcaaaggtctgattgatatggaatgtttccagtcaaatttggaaaaaatggagaaactatgtaattctaatagctgtaaaggggagcttgattttaaatcaattttgatcaataatgattatattccctatgatgagaactcgacgggggattccaccaatttaggacattcaaagtgtgcctttgaaacattggcatctcccacaaagacaataaagaacatgctgactgttcctagttctcctttgtcaccagccaccggtggttcagtcaagattgtgcaaatgacaccagtaacttctgccatgacgacagctaagtggcttcgtgaggtgatatcttcattgccagataagccttcatctaagcttcagcagtttctgtcatcatgcgatagggatttgacaaatgctgtcacagaaagggtcagcatagttttggaagcaatttttccaaccaaatcttctgccaatcggggtgtatcgttaggcctcaattgtgcaaatgcctttgacattccgtgggcagaagccagaaaagtggaggcttccaagttgtactatagggtattagaggcaatctgcagagcggagttacaaaacagcaatgtaaataatctaactccattgctgtcaaatgagcgtttccaccgatgtttgattgcatgttcagcggacctagtattggcgacacataagacagtcatcatgatgtttcctgctgttcttgagagtaccggtctaactgcatttgatttgagcaaaataattgagaactttgtgagacatgaagagaccctcccaagagaattgaaaaggcacctaaattccttagaagaacagcttttggaaagcatggcatgggagaaaggttcatcattgtataactcactgattgttgccaggccatctgttgcttcagaaataaaccgccttggtcttttggctgaaccaatgccatctcttgatgacttagtgtcaaggcagaatgttcgtatcgagggcttgcctgctacaccatctaaaaaacgtgctgctggtccagatgacaacgctgatcctcgatcaccaaagagatcgtgcaatgaatctaggaacacagtagtagagcgcaatttgcagacacctccacccaagcaaagccacatggtgtcaactagtttgaaagcaaaatgccatccactccagtccacatttgcaagtccaactgtctgtaatcctgttggtgggaatgaaaaatgtgctgacgtgacaattcatatattcttttccaagattctgaagttggctgctattagaataagaaacttgtgcgaaagggttcaatgtgtggaacagacagagcgtgtctataatgtcttcaagcagattcttgagcaacagacaacattattttttaatagacacatcgatcaacttatcctttgctgtctttatggtgttgcaaaggtttgtcaattagaactcacattcagggagatactcaacaattacaaaagagaagcacaatgcaagccagaagttttttcaagtatctatattgggagtacgaaccgtaatggggtattagtatcgcgccatgttggtatcattactttttacaatgaggtatttgttccagcagcgaagcctttcctggtgtcactaatatcatctggtactcatccagaagacaagaagaatgctagtggccaaattcctggatcacccaagccatctcctttcccaaatttaccagatatgtccccgaagaaagtttcagcatctcataatgtatatgtgtctcctttgcggcaaaccaagttggatctactgctgtcaccaagttccaggagtttttatgcatgcattggtgaaggcacccatgcttatcagagcccatctaaggatttggctgctataaatagccgcctaaattataatggcaggaaagtaaacagtcgattaaatttcgacatggtgagtgactcagtggtagccggcagtctgggccagataaatggtggttctacctcggatcctgcagctgcatttagccccctttcaaagaagagagagacagatacttgatcaattataaatggtggcctctctcgtatatagctcacagatccgtgctccgtagcagtctattcttctgaataagtgggttaactggagcgatttaactgtacatgtatgtgttagtgagaagcagcagtttttaggcagcaaactgtttcaagttagcttttgagctatcaccatttctctgctgattgaacatatccgctgtgtagagtgctaatgaatctttagttttcattgggctgacataacaaatctttatcctagttggctggttgttgggaggcattcatcagggttatatttggttgtcaaaaagtactgtacttaattcacatctttcacatttttcactagcaatagcagccccaaattgctttcctgactaggaacatattctttacaggtataagcatgccaactctaaactatatgaatccttttatattctcatttttaagtacttctctgtttctgctacttttgtactgtatatttccagcttctccatcagactgatgatcccatattcagtgtgctgcaagtgatttgacatatgtggcttatccttcaggtatgtctcatgttgtgacttcattgctgattgcttttgtaatggtactgttgagttcatttctggttacaatcagcctttactgctttatattgttctactaattttggcttgcacagccaggatgattggttttctgcatcaatcaatcttttttaggacaagatatttttgtatgctacacttcccaaattgcaattaatccagaagtctaccttgttttattctattagttctcagcaacagtgaatgaatatgaatcagtcatgctgatagatgttcatctggttattccaaacaatctgacatcgcatctctttctgcaagtgagatgaagaaaacctgaaatgctatcaccatttaaaacattggcttctggaagttcaggtgattagcaggagacgttctgacattgccattgacatgtacggtagtgatggcaggagacgttcttaaacagcagctgctccttcagcttgtaatgtctgattgtattgaccaagagcatccaccttgccttatggtactaactgaatgagctggtgacgctgactcatctgcataatggcagatgcttaaccatctttaggagctcatgtcatgattccagctgcaccgtgtgcaaatgtgaaggccctgcaagggctttccaggccgcaccaatcctgcttgcttcttgaagatacatatggtgccacctaaataaaagctgtttctggttatgtctgtccttgacatgtcaacagattagtgttgggttgcaatcatgtggtgtttaagtcttggagaaggcgagaagtcattgctgccagcattgtgatcgtcaggcacagaagtactcaaaagtgagagctacttgttgcgagcaaacggagggcgatataggttgataatcaatttcagttctctatatacaagcagcggattttgtttagagttagcttttgagatgcatcatttctttcacatctgattctgtgtgttgtaactcggagtcgcgtagaagttagaatgctaactgaccttaattttcaccgaataatttgctagcgtttttcagtatgaaatccttgtcttaaataaaaaaaaaaaaaaatcatgggtatattttgtctttagatacttgtcatgtttttaatcatttattacatatttatagttttgactaagtactctgcgttgttaccactgcttaagggcgatagccccctttcaaagaaaagagagacagaaacttgatcaattataaatggtggcctctctcgtatatagctcacagatccgtgctccgtagcagtttatttttttgaataagtgggttaactgtagcgatttaactgtacatgtatgtgttagtgagaaccaccagtttttaggcagcaaactgtttcaagttagcttttgagctatcaccatttttttgctgattgaacatatcccctgtgtagagggctaatgaatctttagttttcattgggctgacataacaaagctttatcctaattggctggttgttgggaggcctttaaaaaaaaaaaaaaaaaaaaaaaaaacgtcgtctggcgagtggtgccggtgtgtgtacgcccgtgctggacgaagatatatatatttggtcgtctggggctctgggctgggatgttattcttgtgatattttcgaggtatatactgttgttcttgttcggtcgctgggtcctgcagctagcaaaggtttgtacacaaattctgctggctgcgctggtaatgtgttcatctgtgaaatggtaatctgatcctactgatattatcatgagcc

SEQ ID NO: 2039 - DNA, 2332 bp, Zea mays
  UNSURE (1)..(2332): unsure at all n locations
  Clone ID: PAT_MRT4577_40303C.1
  unsure (1)..(2332): unsure at all n locations
aacgtgaacccgcagtcccacacacaagtgcatagaattcacaagagctgaggcctgaggggggagatagaggagtggcaccgccgtccgccgcaccggcactggaggcgaaatttcattatttggcgcactggagcggggagagagagagagagagctggaaggtggaagcaaaaatctagagtctatagagggaggatggagatctggagctcctggggagcaacgagaagcagctggaaaatctcatggtaacggttggcagagggatccttgatctcttcctgagctggaggactccatctttcgagccgcggacccggagaaacttggatctctaggccatccaagaaaaggtttactcattccttgctggtagcctactgcattgctgcctgcccccagatccgagctgccgcaagaagaaaggtggaatctttgctcgcctgctgcacaaatccgtccaaatttggggtttcttgagctgttcttgggagcgccgtgcttcatgtttttttttgggggaaaggtcgttttctttgctggggtagatgcgggagtgatgtcgaccactttatgagctttccccctgctattttggggtttagattcgctctagttatggcggatcttgacatggagcattaggagtttctttcgtcgaaggcggaaggagcttgctgtaagctgcaatgtctctcaagagcattgtgcgggagctgaaggagatgagggacggtatcgggagcatgtcgagacgcggcggcagcggctccgacgggcgcgtcggccacggccgctcggggtcgcggcattcttggcccagcctgtgggcggagcagcaacagtcgcatcggcagggccagggccctgggtcccgggcccggaggggccgcatcatcagcatcaggggcggtgggcgaacttgcctccggaactgctgctggatgtgatacagagggtggagtccagcgaggcgacgtggccggcgcggcgccaggtcgtggcatgcgcagccatttgccgatcatggcgcgaggtcaccaaggaggtggtgaagacgctcgaggagtgtggcaggatcaccttccccatatcccttaagcagccggggcctcgtgaaatgccggtccaatgttttgtgaggagggagagggcaacatccacatatctactctacctagggctcagcccatctatgaatgtggagaaagacaagttattgcttgctgcccgtaaggtcaggcgtgccacaaggacttattttgtgatatcactggtctctgatgatttctctcactctagtagcacctacgttggcaaactgaagccaaacttcctcggcacaaagttcacaatcttcgacagccagcctcctcctgacgctgtagtgctaccaaacaataagacaagcaaaaggcagtccaagcaagtatcaccgagactgccgctaggcaattacaatgttgctacagtcacgtacgagctcaccgtcctacgcaacaggggtccaaggagaatgcaatgcaccatgcactcaataccagctgagtgcatccaggagggcgggaaggcccctacccctacaggcgccatccagtcgcttgacgagccagtgtcgtccaccttacctagtgccaaagggaaggaagtggctgtagaattctcttcgacaagcctcagcgccgatctgtctggaccggcctgcgtgaacggaacacctctagtgctgaagaacaaagctcctcgttggcatgagcagctgcagtgttggtgcctcaacttccgggggcgtgtcaccgtcgcgtcagtgaagaacttccagctcgtcgcctctgttgatccttccctaaacatccccgcagcggagcaggagaaggtgatcctccagtttgggaagataggcaaggatatattcaccatggactaccggtacccactctcggcgttccaggcctttgcgatctgcctgaccagcttcgacaccaaaccggcctgcgaatgattgacggtagtttaaaatcccgggtggtggagtcttgtgtacgtccgtgttcttccagggcgatgtaaattctttatcttgccatgctgggcctctgctgcccaggcgaaatggtagcttgtgaggtggagatgagcgatagcatctgtaccataggaagagatttgagcgaccttgtttacccaactgttatatgtattattgctgggatgtttggctgtgaaatatcactgccgtatcgataatggacgttgtgaccattttgctantattaaananagggggcgccctctcagaggactccacgctgcgagcgcgtgcatccac

SEQ ID NO: 2040 - DNA, 206 bp, Zea mays
  Clone ID: PAT_MRT4577_40351C.1
gcgacgcgtggcgcactatggaccttgcgttatctgaaactccttcgactggtgcggcatgagaatgtcattgctgtgaaggatgtaatgatgccaatacacacgagaagctctaaggatgtgtactagaggtacgaactcatggatactgacttgcaccatataatcaaatcacctcaaggccttagcaatgaccactgacagta

SEQ ID NO: 2041 - DNA, 2091 bp, Zea mays
  Clone ID: PAT_MRT4577_4043C.1
gccggccgggcctcgaattacgggcgacactcgcggctccttccctattttaagaccccaccacggcaccacctcctccgcaaacaacacacgaacacggaacaccgcaccgcaacgtagccggctaggggaagagctctttccttcagctgtgccgtgcacaacgcacggcacgctggtttggtttgcatcgcccccgccaagaaagacgctgccgtgagcgggcagagcgggcgggaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtccacatcctctgctcggcgttcctggtcgtcttcgtcggcaccgtgtacgtgatgtcgcggcccaggccggtgtacctggtggactacgcctgctacaagccccccgccagctgccgcgtgcccttcgccaccttcatggagcacacgcgcctcatcagcgacgacgacaagagcgtgcgcttccagaccaggatcctggagcgctcggggctcggcgaggacacgtgcctcccgcccgccaaccactacatcccgcccaaccccagcatggaggcctcgcgcgccgaggcgcagctcgtcatcttctccgccatcgacgacctcgtccgccgcacggggctcaagcccaaggacatcgacatcctcgtcgtcaactgcagcctcttctcaccgacgccctcgctctccgccatgatcatcaacaagtacaagctccggagcaacatccgcagcttcaacctgtcggggatgggatgcagcgccgggctcatctccatcgacctcgcgcgggacatgctccaggttcacccgaactcgaacgcgctggtggtttcgaccgagatcatcacccccaacttctaccaggggagccggcgcgacatgcttcttcccaactgcctgttccggatgggcgcggctgcgatcctgctgtcgaaccggcggcgcgaggcccggcgcgccaagtaccggctggtgcacgtggtgaggacgcacaagggctcggacgaccgcgcgtaccggtgcgtgtacgaggaggaggacgagcagggcttctcgggcatctcgctgtccaaggagctgatggccatcgccggcgacgcgctcaagtccaacatcacgacgatcgggccgctggtgctgcccatgtcggagcagctgctcttcttcttccgcctggtggggcgcaagctcgtgaacaaggggtggaggccctacatcccggacttcaagctggcgttcgagcacttctgcatccacgcgggcgggcgcgccgtcatcgacgagctgcagaagaacctgcagctgtcgccgcgccacgtggaggcgtcccgcatgacgctgcaccgcttcggcaacacgtccagcagctccctctggtacgagctcgcctacatcgaggccaagggccgcatgcgccgcggcgaccgcgtctggcagatcggcttcggcagcgggttcaagtgcaacagcgccgtctggaagtgcctccgcagcatcaagacccccaccaacgggccctgggacgactgcatccaccgctaccccgtcgacgtcccggaggtcgtcaagctttgacctacgggctacggctacggctacgacaacgagcgagctcggccggcaccgccgccgccgccgccgccgtcctactgtgtacctgtacgtcctctctgttctcttctcttcccatttccttcgctattaatataaaaaaggtaaaaaaagaaagaaagatccatatacactctgactgttggaagtattgtcatccctcaggcaagggattgggtgattgtaatttgcttgaatgagaatgaatcgtgcacttgtaaattgtaatccacgttgtaactgtgtgaaagggatacatgcattctcctgatacttggttgacgaaaaaaaaaaaaaaaaaatttgcggcc

SEQ ID NO: 2042 - DNA, 380 bp, Zea mays
  Clone ID: PAT_MRT4577_40513C.1
gctgactactctcacaaacatcaggggggtctattcaaccaactaggggcatacaacgcccactagtgtaccaacaatggtatccaaagtattctgcctacatatgctccttgaactttctacaggggctgatacggctaccattttcccgaaatgctcgcaagctcctatagctaccattattgccccgtacctctcaccaccgttgtcttcggcatgtgaaaacctaattcttcaaccctacaggatccaacaggcaatcacagttggcgtgttacctttatcacccttgttcctccaacaatcatcagccctattacatcagttacctttggtgcatttaatggcacaaaacattaaggcacaacaactacaacaac

SEQ ID NO: 2043 - DNA, 2278 bp, Zea mays
  Clone ID: PAT_MRT4577_40527C.1
agtagcccattttcctggaggcggcgacggcagcggcccagcccacctctgccgctgtgcttcgcgtgggccgtgcaactcgccggagacggaagcgacgtcggcgagaaccgcgctgccgttgccgtcgaggcgatatggccctaccctcgtcgacggagacacggagtccgcatccgcctccgcctccggggcgctcgtcgtggtcggcgccgcgtgatcccacgggggtctagaatccgggcctcgtcttcatcacccgccacccaccggcgtccgcaagatgcgcgagatggcaccgccgccacagagtcagtatcaaatccaagaggtcattggtaagggaagttatggagtagttgctgctgcaattgatagtcacgcctctcatccggattggattgataccagctgtggcttgttccagaaagaatactagacatggactttttctcggagtatgggggggcgagtcagtatcaaatccaagaggtcattggtaagggaagttatggagtagttgctgctgcaattgatagtcacactggggagcgggttgcgatcaagaagataaatgatatttttggtaatgtctcggatgctgctcgcattttgcgggaaatcaagcttcttcgtctgcttcgtcacccaaacatagtccagattaagcacattatgttgccccctacccgaagggatttaaagcccaggaacatactatgttgtttttgagctcatggagtctgacctgcatcaagtgatcaaagcaaatgataacctgactccagagcatcaccgctttttcctgtatcaacttatttgtgctctcaagtacatgcattcagcccatgtatttcatcgtgatttaaagcccaggaacatactggccaattcagacagcaaactaaagatctgcgactttggacttgcacgtgcatcatttaacgactctctttcagctatctattggacagattatgtcgcaacaaggtggtaccgggctcctgaattatgtggctcctttttctccagttacacccctgcaattgatatttggagtatagggtgcatttttgctgaagttctcaccggaacaccattgtttcctgggaggaatgttgtgcaccaattagacttaataacagatctccttggaacaccatcgtttagatccttatcccagattcacagtgataaggccagggaatatttgcttggcatgccgaggaagcgccctattccattttctcataagttccgtaatgccgatcctctggctctccggttgctagagcgtttacttgcatttgacccgaaagatcgacctactgctgaagaggctttagctgatccatacttcagtggcctttctaaattggaacttgagccttcagcacaaccaatttcgaaggttgactttgaattcgagggaaggaaactaacaaaggctggtgtgagagaaatgatatatcgggagattttggagtaccacccccagatgcttcaggagtacatcgaaggtggagatcagattcacttcctatacccaagtggggtcgatcgcttccagcgacagtttgctcatctcgaggagaactacaggagaggagtagcaagcaccccgccgcgaaggcagcccacatctctgccgagagagcgagtctgctcatcagaagatggccacagtcaggactctgacagcgaagagcaaagagcagcatcctacgttgcccgaacaaccataagccctccaagatcacaagaggagggcggcaagctccagcctgcctaccagagcgccgccgccgccgcagactcctgcgccaagagctatctgaagggtgccgctagtatcagtagtgcttccaggcgtaccatcaagggggataatggccgaaaggagaaggaatctccgaggctgtgaaagaggtggcgcaggctcgtgacctgttaggcaaaagaggtagcaatggcgccaatgcgactgcaacgtgggatgtcttagtcatcatgcatccaacaatgcaggagcacggagcaccacctcacccccccccccccccccccagtacaagtatgcaggtcatcctagctaggtcgcccaaattaaagcagcctgcttggaggaattagatttgtgtactgttgttaagttttttttttttttgaattcaactgctagattctggcagatctgtcaaccgcactctccttggtttcccaaaatttactggtttgaacaagtttattactgaaaaaaaagtcgacgcggccgcga

SEQ ID NO: 2044 - DNA, 142 bp, Zea mays
  Clone ID: PAT_MRT4577_40589C.1
tcatcatggcttacgaaatctctcggcctccataaatcacccatcacaaacatgctctagcattagcattaccttgcccccgaaacgccagggcggccatcgaaacgcgagagccattcgaggataggtgtaggcagcagcg

SEQ ID NO: 2045 - DNA, 346 bp, Zea mays
  Clone ID: PAT_MRT4577_40836C.1
caactctctatagtgagtcgtattattcgcgatagatagcgcgaccgatccactgcgatggccaccgtccagcctcaatccccggcaggtcccattcatctcccgcacgaggatcgacacggggacgccccggtaccgccctccgtctccggcggaaccgccgccgcaacgtgagctggcggccagatctccgcgcatcacaagcaactcggcctcgtcagccgctgtgaaggataggacgccggtctgggccaccatcgcaagtcggggatggaatcttgtggctgaggccatgcgcaagtacgctgccccgcggtcttctcgcttccacagcgttaccaggctc

SEQ ID NO: 2046 - DNA, 1802 bp, Zea mays
  Clone ID: PAT_MRT4577_40856C.1
aattaattacccacctctctcttccctcctctcttcccgtagctctctctcctcgccccgctccgtcctcccctcctagggttcgacgccctcgccagcccgcggcgaagccaccgcccacctcgccggcggcgtccgcggccaggaagatggctggcggctttcgggtgctgcatcttgtcaggcccttcttggctttcttgccggaagtgcagagtgctgacaggaaaataccatttagagaaaaagtgatctacaccgtcatttctctcttcattttcctggtgtgcagtcagctcccgctctatggcatccattcaaccactggagctgatcctttctactggatgcgtgttattcttgcatcaaaccgtggtactgtcatggaactgggtattacccccaattgtgacatctggaatggttatgcaacttctagtgggatccaagattattgaagttgacaacagtgtgagagaggatcgtgctctgctgaatggtgcacagaagttgctgggtatcctgattgccattggggaagctgtggcatatgttctgtctggaatgtatggcagtgtgagccaacttggaactggaaatgccattctcatcatacttcagcttttctttgctggcatcattgtcatctgtctagatgaacttctccagaaaggctatggtttgggttctggcatttctctcttcattgctaccaatatctgtgagaatatcatttggaaggcatttagccctaccaccatcaacagtggacgtggtgctgaatttgaaggggctgtcattgcattgttccatctgttgattactcgatcagacaaagtccgtgccctacgagaagctttctaccgtcagaatctgccaaatggtgaccatttgcttgctactgtcctggtctttctcatagttatctatttccaaggcttccgtgttgtgcttccagtgaggtcaaagaatgctcgtgggcagcaaggctcatacccaattaagctgttctacacttcgaacatgcccatcattctgcactctgccctgattaccaacctgtatttcatatcccagcttctctacaggaagtacagtggaaactttctggttaaccttctcggtatatggaaagaatctgaatattctggccattctatccctgttggtggtcttgcttactatgtaactgcaccatcaagtatggctgatattctggcgaatccattccatgcattgttctatgtggtcttcatgctgtcagcatgtgctctcttctcaaaaacatggattgaagtctctggttcatcagccaaggatgttgctaagcagctgaaggaacaacaaatggtgatgccaggtcatcgtgagtcaaacctgcaaaaggaactgaacagatacatccctactgccgctgcatttggtggagtgtgcatcggcgcattgactgttcttgctgatttcatgggcgcaattggttcaggaaccggaattctgttggctgttaccatcatataccagtactttgagaccttcgagaaggagagggcaacagagcttggtttcttcgggttttgattgatacatgatagctttgggagcatgttatggctacagcacagctcgagtctttttagacagtcgcaatactgcttggctggctggctgttgtggttgtaaccggagattaaattctgtttaggttaccccgacttatttacagttgagaaatctgtagatgctgcgtgtgttcttcaggccagtttatggtgggtggaccggtccaagcacgggcgtggccg

SEQ ID NO: 2047 - DNA, 336 bp, Zea mays
  Clone ID: PAT_MRT4577_4090C.1
caacgtacaaagctcaatcatctaccaacaatggcatccaaagtattctgactccttatgctccttgggatttttgtaagtgctgctacagcgaccaattttgcgcactgcttacaagctcttatagctttccttcttacctcgtacctatcaccagcggtgtctttggtatctgaaaactcaattcttaaaccctacaagatgcaacaggcaatcgcatctgacatttaacatttatgacccttgatccttcaacaatcatatgacctattacagctgttacccatggagcgtttattggcacaaaacatcagggcccaccaactactacgactt

SEQ ID NO: 2048 - DNA, 345 bp, Zea mays
  Clone ID: PAT_MRT4577_40967C.1
aggggttcgggttagagggtgagcggatctagatggcggcgtcggatagttgagtgccggtggttcctcggcggactcacctgggccacggacgaccactccctccacaactccttaagcacctacggagaggtcctctagtccaagatcatgctcgatcgggagacgcaaaggtcacctggcttcagcttcgtcaccttctacacagaagaggcgatgcggaacaccatcaaggtcatgaaccggaacgagctggacggccgcaacatgaccgacaacgaagcccattcccttggcggccgtggaggcggaggcggcggatacggtggcagccgtggaggcggc

SEQ ID NO: 2049 - DNA, 1430 bp, Zea mays
  Clone ID: PAT_MRT4577_40999C.1
cattgggtccctcgaggccggccgggctgcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctacttcagcaaaggtccgcgacaaaggttacctttcctttagtttggaccaatacctgctgcagccaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgacgggaaatggggggagcatgagcttgactacctgctgttcatcgtccgggacgtgaaggtgcagccgaacccagatgaagtcgctgacgtgaagtacgtgaaccgcgacgagctcaaggagctcatccggaaggctgacgctggcgaggacggggtgaagatctccccctggttcaggctggtggtggacaacttcctcatgggctggtgggaccatgtcgagaaaggcaccctcggcgaggccgtggacatggagaccatccataagctgaaggagtgaggggccgccggccggccggctccgatgacctcaccacctgttgatgttgctgctgctgctgcactgcatgtttatcaaaagttatcgctcctgctcgcggaaagtgagcttgactgttgccggggtggaagtgtcgttttggactgaagatgagtgccgcggaggggtttgttgtttgtttgtttgtttgttcggtgaccgaatcgcgagttggacgcctgtttaatccgtgcttatacatcgtctgagtaaacagcaataagagggacatccgtaagctctttccgtaactacttttgcgactcgtctgctgctactgcagttccatttctgtatatttttggcagaagatccttgtgcagcctaggctagcggcatcgtgactgggaggtagggaagggaacgacgcttgtggttgtgcatgttggcttgcttcttgagctctttgcttgtggctgtagctgatttttttaaaaaaataactttaggggctcgtttatctcagtataacatgagggtttgggtttatttgcttgtgactggacttctgtttatgaacttaagggcctggcttatctgatta

SEQ ID NO: 2050 - DNA, 538 bp, Zea mays
  UNSURE (1)..(538): unsure at all n locations
  Clone ID: PAT_MRT4577_41025C.1
  unsure (1)..(538): unsure at all n locations
ctcctctctcnctttccaccaaacacacctcagacctcacctcgctccccgccccgccgatctcttctcttctaggctcgtcggcgatggcggctccggtggtggacgccgagtacctgcgccaggtcgacagggcgcgccgtgccctccgcgccctcatcgcctccaagggatgcgcccccatcatgctccgcctcgcatggcatgatgctggcacgtatgatgtgaacacaagaactggtggtgcaaatggttcaattagatacgaggaagagtacacccatggttcaaatgctggcttaaaaattgctattgatctcctcgagcctattaaagcgaagcatccaaagattacatatgcagacctttatcagcttgctggagtagttgcagttgaagtcacggggggtccaactgttgagttcatccctggaagacgtgattcgtcagtttgtccccgtgaagggcgccttcctgatgctaagaaaggcgcaccacatctgagggacatcttttatcgaatgggcttaacagacaa

SEQ ID NO: 2051 - DNA, 2921 bp, Zea mays
  UNSURE (1)..(2921): unsure at all n locations
  Clone ID: PAT_MRT4577_41083C.1
  unsure (1)..(2921): unsure at all n locations
ccacgcgtccgtgcacggctacctctaagtcgcatagttccgatatctccaaacgagcttaacctttatcggatcgtgattgttctccggcttatcatcctatgtttcttctttcaatatcgtataactcatccagtggaagatgcttatgggttgtggcttgtatctgttatttgtgaagtttggtttgccttgtcttggcttctagatcagttcccaaagtggtatcctatcaaccgtgaaacttacctcgatagacttgcattgagatatgatagggagggtgagccatcccagttgggctccaatcgatgtctttgttagtacagtggatccacttaaggaacctcctctaattactggcaacactgtcctgtccattcttgctgtggattaccctgttgacaaagtatcatgttatgtttctgatgacggttcagctatgttgacttttgaagcgctatctgaaaccgcagagtttgcaaggaaatgggttcccttttgcaagaaacacaatattgaacctagggctccagagttttactttgctcgaaagatagattacctaaaggacaaaatacaaccttcttttgtgaaagaaaggcgggctatgaagagggagtgtgaagagttcaaagtacggatcgatgcccttgttgcaaaagcgcaaaaaatacctgaggagggctggaccatggctgatggcactccttggcctgggaataaccctagagatcatccmggaatgatccaagtattcttgggccacagtggtgggcttgacacggatgggaatgagttgccacggcttgtttatgtttctcgtgaaaagaggccaggcttccagcaccacaagaaggctggtgccatgaatgctttgattcgcgtatcagctgtcctgacgaatggtgcttatcttcttaatgtggattgtgatcactacttcaatagcagcaaagctcttagagaggctatgtgtttcatgatggatccagcactaggaaggaaaacttgctatgttcagtttccacaaagatttgatggtatagacttgcatgatcgatatgcaaaccggaacattgtcttctttgatattaatatgaagggtctagatggcattcaaggacctgtttatgtgggaacaggatgctgtttcaataggcaggccttgtatggctatgatcctgtattgacagaagctgatttggagcctaacattatcattaaaagttgctgtggcggaagaaaaaagaaggacaagagctatattgattccaaaaaccgtgatatgaagagaacagaatcttcggctcccatcttcaacatggaagatatagaagagggatttgaaggttacgaggatgaaaggtcactgcttatgtctcagaagagcttggagaaacgctttggccagtctccaatttttattgcatccacctttatgactcaaggtggcatacccccttcaacaaacccaggttccctgctaaaggaagctatacatgtcattagttgtggatatgaggataaaacagaatgggggaaagagatcggatggatatatggctctgttactgaagatattttaactggtttcaagatgcatgcaagaggttggatatccatctactgcatgccacttcggccttgcttcaagggttctgctccgattaatctttctgatcgtctcaaccaagtgttacgctgggctcttggttcagttgaaattctacttagcagacactgtcctatctggtatggttacaatggaaggctaaagcttctggagagactggcatacatcaacaccattgtttatccaattacatctatcccactagtagcatactgcgtccttcctgctatctgtttactcaccaacaaatttattattcctgcgattagcaattatgctggggcgttcttcatcctgctttttgcttccatcttcgccactggtattttggagcttcgatggagtggtgttggcattgaggattggtggagaaatgagcagttttgggtcattggtggcacctctgcacacctctttgctgtgttccaaggtctcttaaaagtgctagcagggatcgacacaaacttcacggtcacatcaaaggcaaccgatgatgatggtgattttgctgagctgtatgtgttcaagtggacaactcttctgatcccccccaccactgtgcttgtgattaacctggttggtatagtggctggagtgtcgtatgctatcaacagtggctaccaatcatggggtccactattcgggaagctgttctttgcaatctgggtgatcctccacctctaccctttcctgaagggtctcatggggaagcagaaccgcacaccgaccatcgtcattgtttggtccgtccttcttgcttccatattctcgctgctgtgggtgaagatcgaccccttcatatcccctacccagaaggctctttcccgtgggcagtgtggtgtaaactgctgaaatgatccgaactgcctgctgaataacattgctccggcacaatcatgatctaccccttcgtgtaaataccagaggttaggcaagacttttcttggtaggtggcgaagatgtgtcgtttaagttcactctactgcatttggggtgggcagcatgaaactttgtcaacttatgtcgtgctactgttacttatttgtagctaagtagcagtaagtagtgcctatttcatgttgactgtcgtgactacctgttcaccgtgggctctggactgtcatgatgtaatctgtatgttggaacttcaagtactgattgagctgtttggtcaatgacattgagggattctctctcttgaaatttatataaaaaaaaaaaaaaaaaaaaaaaaaaaaaaaaaaaaaaaaaaaaaaaaaaaanaaaaaaaaaaaggggcggggcc

SEQ ID NO: 2052 - DNA, 691 bp, Zea mays
  Clone ID: PAT_MRT4577_41105C.1
cggccgctcgagccggcgggcgggtctttttcgcatctcctgatcattatctgaaacatcagacagtttacaatgcaaatgaacttgctgatctggttgagaagaagaagaaaatgcggaattggcttgattactaccaaaacaagcttgagcgaaaatccaaaaggccaacaactaagactggctttcttggatgttttggttctgaagtggatgcgattgatcactgcaaatcagagattgagaagatagggaaggaagaagctgaagagcgtaaaaaggtcatgaaggatcccaagtcaattatgccagcagcctttgtttcttttcgttcacggtggggtgcagctgtttgtgcacagacacaacaaaccagcaacccaaccctttggctgactgaatgggctccagaacctcgtgatgtctactggagtaatctatctattccctttgtttccctcacagtcaggaggttgataattggcgtggcctttttcttcctcaacttcttctatgtcattccaatagcattcgtacagactcttgcaaatcttgaaggcatagagaaggcactaccatttctaaaacctttaattgaatcacctcccattaaatcattcatccaagggtttcttcctggacttgctccgaagatcttcctcatagtgcttccaactatactgatgtacat

SEQ ID NO: 2053 - DNA, 396 bp, Zea mays
  Clone ID: PAT_MRT4577_41116C.1
cccacgcgtgcgcaagtgaacctgaaacttgcggtgttactggctggtattctgagtgagagtgagtgatcgagctatctgagctccgatcctagctagctaggataccgccataccacaggtcttcattcacaagtttaggagcgacagcaacaagagatcgatggcctgtgccaccgagcttaagttcttcttccttcccaagaagtccgaatggggcgccaccaggcaggccggcgcgcccaggccgaccaccgggttcatggtcgagcgcgccttcgtctacgccgatgagctcgggaagaccgtgaaaacgatcgcgttttcggggcggagcatcctggcgacggactagtagaacgcgacgtgcgggaagcggatggcgatcatcgtgct

SEQ ID NO: 2054 - DNA, 617 bp, Zea mays
  Clone ID: PAT_MRT4577_41145C.1
cggacccgtcaccagccggaggcttcgggatgtgaaaacccaatgcttcaacgcctacaggatccaccaggcagcgcagctggcatcttacctttatcacccttgctactccaacaatcatcagccctattacagcagccacctgtggacgcatgtattgtgacgaaacatcagggcacaacatctaccacaacttgcgctagcataccgtgctgtctactctcagcaacagcagttccttccattcaaccgactagctgcattgaactgtgcttcttatttacaacaacaccaactaccattcagccagttacctggtgcctacccgcagcattttcgtcacattcaaccaactgtgagtattgaactctcctgcgtatttacagcagcaacaactactaccattcagccagctagctggtgtgagccctggtaccttcttgacacaaccacagtcgatgccgatctaccagcgcgcgtgcgcctaacgctggaacgcctattacaactgcaacaattgctgccattcaaccaacgtgctttgacgaacctagcagtgatctaccagcaacccatcattggatggtgccctcttttagatttcttatgagttatag

SEQ ID NO: 2055 - DNA, 151 bp, Zea mays
  Clone ID: PAT_MRT4577_41162C.1
ggctctcgcagcgctatattcctcatatctttggcttcaagctccacaagccataaacctcatatatttatcttttaaactcctcaagacgtagcactgggggcatacgagaattttacaatccttgaaaacttacatataagagcgccct

SEQ ID NO: 2056 - DNA, 550 bp, Zea mays
  Clone ID: PAT_MRT4577_4155C.1
agagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggggagggcggggccatcggcgccggcgccttcgcactctactataagcactaggcgaataaggaccccgagcacgcgcacaggcacaggatcacggaggaggacaatgccgcggagggcgacggcgccggcgaatacatattccacgggcaccacggagaagaagaaggaccacaaggaacgccaaggcaggatagcggatgagaagaaacaccaccccctcttcgggatgaccgaaggaccgcgcggaagcatcacccagctagctagttccggcgcacgcaaccacgcacctgtttaa

SEQ ID NO: 2057 - DNA, 196 bp, Zea mays
  Clone ID: PAT_MRT4577_41589C.1
ccacgcgtccggatcgatgcacggaggaggatgctgccgctgctctggcctaatcactagtataaagcaggcggagacagcctggccgcctgaccgcagtgctcccccttcctccccgtccccaaccacatgccctgcctccgccccgccccgccctgcccaagctcgattccccagcccccaacaaacaattact

SEQ ID NO: 2058 - DNA, 244 bp, Zea mays
  Clone ID: PAT_MRT4577_42217C.1
cctatagtgagtcgtattaacacgcgtgcgcacacctcgcgacagccaccaggagtacaccgtttcacgcgacagccgtcacgcgtcacgtatccaggctgaccgtaggagagacactcatcttcaggacggagggagacgactacacaggatgcacgggttcaggcagctgcagcgatcgccagctcaagagcaacatcaggcgccgtcggatcagctgtacgcctggggtgtcggaagtcgt

SEQ ID NO: 2059 - DNA, 121 bp, Zea mays
  Clone ID: PAT_MRT4577_42224C.1
tcacgaaatagttggcaatattttacactgctcgtctctgataaggagtcgcttttggatgatcttgagggcgagcactctaatcacagtcgttcagacgtgtcacactagcaataggtat

SEQ ID NO: 2060 - DNA, 715 bp, Zea mays
  Clone ID: PAT_MRT4577_42323C.1
gggaccctcgggttcggccggggccggctgctgcctgcactgtcaggtgcactgccagagtatccgcgatccaattagagagaatctcccctgctgtgacgtctggcgctctctgtggagaacacctcgtctggacgggagtacaaggtcaaggatctctcgcaggcggacttcggccgcctcgagattgagctggccgaggtcgaaatgcccggcctcatggcgtgctggggggagttcggcccgtcgaagcccttcgctggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgttaaggtcgaggaggattacgagaagaccggcaagatccccgatccggagtccaccgacaacgctgagtttaagatcgtgctcaccatcatccgggacgggcttaagggtgaccccaagagtaccgcaagatgaatgataggcttgtcggcgtctctgagga

SEQ ID NO: 2061 - DNA, 1831 bp, Zea mays
  Clone ID: PAT_MRT4577_42325C.1
aactgatgtcgcggccgtgccgcctgtggttgccctggcggcggatggccaggcgggtgccgaggagatcgtgctgcagcccatcaaggagatctccggcaccgtcaagctgccggggtccaagtcgctttccaaccggatcctcctgctcgccgccctgtccgaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggatgctaaagaggaagtgcagctcttcttggggaatgctggaactgcaatgcggccattgacagcagctgttactgctgctggtggaaatgcaacttacgtgcttgatggagtaccaagaatgagggagagacccattggcgacttggttgtcggattgaagcagcttggtgcagatgttgattgtttccttggcactgactgcccacctgttcgtgtcaatggaatcggagggctacctggtggcaaggtcaagctgtctggctccatcagcagtcagtacttgagtgccttgctgatggctgctcctttggctcttggggatgtggagattgaaatcattgataaattaatctccattccctacgtcgaaatgacattgagattgatggagcgttttggtgtgaaagcagagcattctgatagctgggacagattctacattaagggaggtcaaaaatacaagtcccctaaaaatgcctatgttgaaggtgatgcctcaagcgcaagctatttcttggctggtgctgcaattactggagggactgtgactgtggaaggttgtggcaccaccagtttgcagggtgatgtgaagtttgctgaggtactggagatgatgggagcgaaggttacatggaccgagactagcgtaactgttactggcccaccgcgggagccatttgggaggaaacacctcaaggcgattgatgtcaacatgaacaagatgcctgatgtcgccatgactcttgctgtggttgccctctttgccgatggcccgacagccatcagagacgtggcttcctggagagtaaaggagaccgagaggatggttgcgatccggacggagctaaccaagctgggagcatctgttgaggaagggccggactactgcatcatcacgccgccggagaagctgaacgtgacggcgatcgacacgtacgacgaccacaggatggccatggccttctcccttgccgcctgtgccgaggtccccgtcaccatccgggaccctgggtgcacccggaagaccttccccgactacttcgatgtgctgagcactttcgtcaagaattaataaagcgtgcgatactaccacgcagcttgattgaagtgataggcttgtgctgaggaaatacatttcttttgttctgtttttctctttcacgggattaagttttgagtctgtaacgttagttgtttgtagcaagtttctatttcggatcttaagtttgtgcactgtaagccaaatttcatttcaagagtggttcgttggaataataagaataataaattacgtttcaaaaaaaaaaaaaaaaaaaaaaaaaaccgtggctgtcaagcctgctgctacgttttaggagatggcattagacattcatcatcaacaacaataaaaccttttagcctcaaacaataatagtgaagttattttttagtcctaaacaagttgcattaggatatagttaaaacacaaaagaagctaaagttagggtttagacatgtggatattgttttccat

SEQ ID NO: 2062 - DNA, 401 bp, Zea mays
  Clone ID: PAT_MRT4577_42338C.1
ccccgcgtccgcccacgcgtccgggcgagggacaacaagaagacgcgcatcatcccgcgccacgtgctcctggccatccgcaacgacgaggagctcgggaagctgctggccggcgtcaccatcgcgcacggcggcgtcctccccaacatcaacccggtgctcctgcccaagaaggtggccgagaaggcggccagcggcggcagcaaggaggccaagtccccaaagaaggccgccaagtcccccaagaaggcttagaaagtagggagttcattagcgctgtgtaacatgttcgtgtttagatctgtggatgggatgtgttgtggtctagtttcctccctgtggcttatggtatgttcattttcattgagaagatcttcagaaatcagagctcgttgcatagt

SEQ ID NO: 2063 - DNA, 563 bp, Zea mays
  Clone ID: PAT_MRT4577_42475C.1
aagaaccgagtgtcaagtgaacctgcatcttgcggagtcactggctggcttagcctgagcgcgagtgagtgatcgagctagctgagctccgatcctcgttagctagatcggataccgccataccacaagttttatttacaagtttaggagtgacagtaacaagagatctcgatggcctatggcatcgcgctcaagttctcctttctttccaagaagaccgaatggggcgccaccaggcaggtcgccgagcccaggccgaccaccgtcttcatggtcgttcgcgcctccggctaccccgatgagctcgtgaagaccgtgaaaacgatcgcgtcggcggggcgggacatcctgtcgatggacgagtcgaacgcgacgtgcgggaagcggctggcgtccatcgtgctggagaacacggaggccaaccggcaggcgtaccgcacgctgctggtcacggcgccggacctgggccatacatctccggcgccatcctttttgaggagacgctgcaccagtccgacgtcgacggtcgaatgatcgtgtacatgctggtggagcagggcatc

SEQ ID NO: 2064 - DNA, 883 bp, Zea mays
  Clone ID: PAT_MRT4577_42487C.1
ggccgcccttttttttttttttttttcacttctatggatctggtattatatcattccaaattccaatcacccacacacggccatgcatgtgcctcatggcattattatttttttgactgtcaagtcatctattttcacacctggtgtgagattgttttaaatccctgaacagttatatagaaacccaaatattgctaatcgaccatcattgctttgatagagcactgattttgatatggataataaatcatttcatttgccgattgcctagaacagtaagtctcggaaggtggggagcttgatctcgccctcggtggtgagcgggatagtgaaggcgccgatgacggggaggtcgatggtgagccctacctccagcaggtagtcgatgtcccagtcccctcccagatccttcatcagcgtcaggatgaagtcgtacggcaccttcaccggtagctccagcttggtgctaccgctcgccgcaatccacccggggtcgggcatcatgcccgacgctatcaccttgccggcgctcttgaaggtgtaggtgatctcgcagatggggatgcggtgcgagtaggggttgctaacgtcgacgtggctgtgcagctcgacgccctcgcggcttatgctctggaaggagactcgatccagcgccgcctcgggcttgggaatctgcgccaccttctccaccacgaagcccttggccctgtccacgaggccggccatcaggccgacgctcctctcccgtctctcctcctcccctcctcccgcttctgcggcggcgccggacctctcatcctctgtcgtgctcatgttggggaacggagatcgtgccgcgcggccggaggcggtgtgtccctcgctcgacgcgggcggaggtgga

SEQ ID NO: 2065 - DNA, 713 bp, Zea mays
  UNSURE (1)..(713): unsure at all n locations
  Clone ID: PAT_MRT4577_42542C.1
  unsure (1)..(713): unsure at all n locations
ggccgcttttttttttttttttttgtttattcgttttcatttttttttgttttttatttattttttgagtacatacgaataggaactctttggacgatgatacacaagcacgtgcgtacacacgacatctacgtacgatagattacgaacgcacacttattcctgcatcacacgagcgcatacatacgtacgcgcgcacaacaaggggggtagctcgatatcactctcacgcgcacgcggagctcacggcgagggacgacgatacgggaggatcaatcagccgaagaagtggtgcttcttctcgccgacggcctgcttggactgcttgtggtccttcttcttctggtggcgctcgtagaaggcgaagccgacggagccgacggacgacgacgacgggacctcctcctcgatcttgcggtggtgcgcgtgctgcggatccttattagcctcgtgcttttagtagagagcaaaggcgccggcggcgatggcgccggactcgccgaggtgctggttgtgcttgtgctccttttactgcttcttgtactggtagtactcgttctcggccgaggacaccaactccgttaacgtggcctacgagtactcggaggactaagcgtacccgccgacggcgagctgctcctcgtccttcttgaggtggaacaggtggaggaggcaggagcttatactncggcatggataatgaaacgagctat

SEQ ID NO: 2066 - DNA, 1984 bp, Zea mays
  Clone ID: PAT_MRT4577_42559C.1
ctcgccgctgccgcatcctcaccctcgtccgctcctccgctgccccaaaccctagcctgaggaggggtcctcctccgctaccgagacccacgatgtcgaccatcgctgcctcccgccgctcgtcctcctcgtcctcttccgcgaccgccaagcgccccgcgattgcggacggccccgggggacccaaggcgaccgccgcacaggccaagaagcgcgtggcgctcggcaacatcaccaacgttgccgcgcggggagggagggcttccgttggcggcagccttgggaacgtcatggcgcccaccagcagcgcgaagttgaatccaacggtacccttgaagaagccgtctttggcaacaagtgctcggagtgtgagttcttccatccggggttctgctgacaaaccggcttccatcaagccagctccaccagtagcacgccatggcagcgcaacacaaaggcataacaatgttcctcctcctaaagtgcctaccattgccgatgtgccaagtcgtgctcctgccttggtgtcctgcaccggcttggtgtctcctggacgctcaggagattctgtttcatccgatgagacgatgtcgacttgcgactccatgaaaagcccagactttgagtacgtagacaatcaggacacctcgatgctggcttcgttgcagcgacggacaagtgaacatctgcgaatatcagaggatagagatgttgaagaaaataagcggaagaaaaatgccgtggccccaatggaaattgaccgcatctgtgatgttgacagtgaatatgaggatccacagctgtgcgctactctggcttctgacatttacatgcacttgcgagaggctgagacgaagaaaagaccgtcaactgatttcatggaaacgattcaaaaagatgtcaacccaagcatgagagcaattttgatagactggctcgtggaagttgctgaagaatatcgtcttgttcctgatactttgtacctgacagtcaactacattgaccgttatctttctggcaacgaaatcagccgccaacggctgcaattacttggtgttgcatgcatgcttatagctgcaaaatacgaggagatatgtgcaccacaagtagaagaattctgctacataacagacaatacatatttcagagatgaggttctagatatggaagcttctgtactgaattacttgaagtttgaaatgacagcacctacagcaaagtgctttttgaggagatttgctcgtgctgcacaagcgtgtgatgaggatcctgctttgcatctggagttccttgccaattacatcgctgagctatcactactggagtacagtctactctcttaccctccatcactaatagctgcatcggctattttcttggcgagatttatactacagccaacaaagtatccttggaattccacactcgctcattacacacagtacaaaccgtccaaactgagcgaatgtgtaaaggcattgcatcgcctttgcagcgttggttctggtagcaaccttccagcaatcagagaaaagtacagtcaacataagtacaaatttgttgcaaagaagcagtgtccaccgcagatccctactgaattctttcgggacgcgacatgctagactagaaacccagaagtgattccagttgcttactggattcttcttgatgtgtcttgaatgcccagtgtagcacagcacaactatgcaagtgctgataacccccaggttgtttcaggtgattacaggggtgtaatcaatgtttgtggtcatgttaggtcattggtgtggtttttcttttcctgcttccagtctttctgtatgtagatcagtgttttcaggcgcttgtaaatccgagttctgtagtagagcacaatatcttgtaagttaactgaagaaatttggtgatcaaccaagttacctacaacttatgttgagctggtgatcaggtttttgcgctagttgaaaaaaaaaaaaaaaaatgg

SEQ ID NO: 2067 - DNA, 1189 bp, Zea mays
  Clone ID: PAT_MRT4577_42575C.1
tgggacctccagccggcgggaattccgctttcctcacaacctcacccggctccatccacgcggctccaacgccagccacagcacgagccatggactcgcgcgtcgtggacggcgcaggtgggggtgccgacgcctccttgccggccgatccgccgagccccgtgcccgatccggccgcgggcgggatggatgcgcgcctcccatcggacctgcttcgtgcagtgctgcaaaggctgccgccgatcgacctcgcgcggtccgcctgcgtctgccgagcgtggcgcgcggttgcctccgaccgcgccgtggtcgaggccgccttctgtgcgccctggggagtgcggcgcgtcgtcggagagccggcgacgggggccttctggcgggccgcctcccttgggagatttgcgctgtcgcatgcgatccgccgcggggataccgtccccggtgtcgctctcaagtactccgtgcaggtgaccgatatcaaacgattcaacaacatgatgagtgaccatggcatctattcgagggagaggcttctggttccgatcagcaacccagaaatccttcttggcagcacctgctacatcgagatggaccataacgctaagagagaggttgcaatcttttaccccgagggacgcccaggtggcaaaactgactctgtggcaagcattgtctctgcggagaggagaaacaaaaggattctcgagtcggtgaggcggagcctgcacgtcgatgatggcactgctgcgtactacttatctgttactgagggtgatccgagggctgccatgacggagtactccgaggacctgaggtgggagcagcaacgcgcaggtcggtagattcatatatattccaatgacatatgttaagatcatggtgcttgatccttatcatttggtgtatatattgtacaatctggatggttgtaagtataaatacaaactttggtctaatgaatatagatgcatgtacgtgataataaataataattgccaaatggcatcggtgttgagaacaaaaatcgcgccgggtgacaattggctggtgaaaagtattacatgacattcgtgaacctgcttgtttgtaagtaacattgtttgttgttgctaaattccttgcggaatactcgattatgctgccgatttttagtttctgtatttaatgaaaaaaaaaaaaaaaaaaa

SEQ ID NO: 2068 - DNA, 301 bp, Zea mays
  Clone ID: PAT_MRT4577_42576C.1
gcgcgcacgcgtccggtcttctccttccataccggatcgggttcgggttcgtaagggtcggcagggttcggtttcgtgggtgagcggatcgagatggcggcgtcacgatgttgagtaccgctgcttcatcggcggactcgcctgagccacggacgaccactccatacacaacgcctacagcacctaaggtgaggacctcgagtccaagatcatccatgatcggcagacacataggtccctcagcttctgctatgtcaccttttccacggaagtagcgatgcggaacgccatctagggcatg

SEQ ID NO: 2069 - DNA, 1786 bp, Zea mays
  UNSURE (1)..(1786): unsure at all n locations
  Clone ID: PAT_MRT4577_42605C.1
  unsure (1)..(1786): unsure at all n locations
actccatagggcgattgggttcctcgaggccggccggggtccctctcccctgcctgcaccaattcctgaggcaccaaccaagcctctcttgttgactccgacgccgatcgaacgtacagacggccatggagacccaagcgccggagaaggagaactacctccctgaaaaggatgcgaggagcgcacgggagaaggccatcgacgagtggctcccgatcacctcgtcgcggaacgccaagtggtggtactccgccttccacaatgtcaccgccatggtcggcgccggcgtgctcagccttccctacgccttgtccgagctcggctggggccctggcatcgccgtgctggtggtgtcgtgggtgatcacgctgtacacgctgtggcagatggtggagatgcacgagatggtgcccgggaagcggttcgaccggtaccacgagctggggcagcacgcgttcggcgagaagctgggcctgtggatcgtggtgccgcagcagctggtcgtcgaggtgggcgtgaacatcgtgtacatggtgaccggcggcaggtcgctgaagaagttccacgacgtgctggtgtgcggcgacggcggggcgtcgtgcgaggggaaggacaacatcaagaccacctacttcatcatgatcttcgcctccgtccacttcgtcctctcccagctccccaacttcaactccatctccggcgtgtcgctggccgccgccgtcatgtcgctcagctactccaccatcgcgtggggcgcgtcggtggacaagggcaggatggcgggcgtggactaccacctgcgcgcgaccacgacccccggcaaggtgttcggcttcttcggcgcgctgggcgacgtggcgttcgcgtacgcggggcacaacgtggtgctggagatccaggccaccatcccgtcgactcccgagaagccgtccaagaagcccatgtggaagggcgtcgtcgtcgcctacgtcgtcgtcgcgctctgctacttccccgtcgcgctcatcggctactgggcgttcggcaacagcgtccaggacaacatcctcatcacgctcagcaggcccaggtggctcatcgcgctcgccaacatgatggtcgtcatccacgtcattggcagctaccagatctacgccatgccagtgtttgacatgatagagacggtgctggtgaagaagctgcgcttccctcccggtctgacactgcgtctcatctctcggaccgcctatgttgcgttcacaatgttcatcgccatcaccttccccttcttcggcggactgctcggcttcttcggcggattcgcctttgcaccgacgacctatttccttccctgcgtcatgtggctcgcgatctacaagcccaagaggttcagcctctcgtggttcaccaactggatctgcatcattctcggggtgatcctgatgattctgtcgccaatcggagggcttcggcagatcataatggacgcgaaaacgtaccagttctactcgtaaaatgctaccagacactgagtttttttgtcgtgccaacaacagaggggaacttcctggtaccatgtataagctgttacagatgttgggttagttatatatatacatgcatacgtattgtttcttaattaatgttccaaggtgaccgtgggttgtgtatatggtataaaggagaatcgatgatggtggttgtcccagatatttggtggtttaattctattcccttgtcccatgtatttgccgggttccccctaaaaaacnacatngggggggggggtggggggngaaatttaatt

SEQ ID NO: 2070 - DNA, 801 bp, Zea mays
  Clone ID: PAT_MRT4577_42655C.1
gcatccccatccgcacctctctccatctccctgckcctccgccttcttcttgatccagccaagccagggatcgcsagggbggactcggaggagcaccacttcgaatcgaaggccgacgccggagcstccaagaccyacccccagcaggctggcaccstccgtaaraacggcttcatcgtcatcaagaaccgcccccccmaggtgttgaggkttctacctcaaagactggkaagcatgggcatgccaaawgccactgtgttgycatagakatattcaacgggaaaaagcbcgaagagattgttccctcgtcacacaactktkataktccgcatgtkaaccgtactgagtatcagcygagtkadaaawcagargatggatttgtkagccttcttacttcagaaggcaacactaaggatgatcttagactcccmactkatgagactcttgttgcccacatcaaggaagggtttkaaagttgcaaggatyttgttgttacttttcagtcttcyattggggaggagcagaacybcsccccgaaggatgttggccccmagtaacttcccycccttggaatactgtatctcaaaaccyaaatygaaaaaagaagtgtattaaggatttctacagagacaaccatcttgcttkagccggcttttgcyawgtyaaacacaagttcagggatytctgggtgttgcaccctktcttchttaactgttgggacattctggaccccstattttctatkcctttatgcccccaccgtgtagtatwaattatcaataaatttgtttkggacggttg

SEQ ID NO: 2071 - DNA, 3408 bp, Zea mays
  Clone ID: PAT_MRT4577_42664C.1
cccattctctcacacccaacacccagctatcacaccctgatccccgaggccgcgcgtcggggtgaggaggaggaggggccatgatggagtcggcggcggcccagtcctgcgcggcgtgcggggacgacgcgcgcgctgcctgccgcgcgtgcagctacgcgctctgcagggcgtgcctcgacgaggacgccgccgagggccgcaccacatgcgcgcgctgcggaggggactacgccgctatcaacccagcgcgcgccagcgagggaaccgaggcggaggaggaggtggtggagaaccaccacaccgccggtggcctgcgtgagagggtcaccatgggcagccacctcaatgatcgccaggatgaagtaagccacgccaggaccatgagcagcttgtcgggaattggtagtgaattgaatgatgaatctggtaagcccatctggaagaacagggtggagagttggaaggaaaagaagaatgagaagaaagcctcggccaaaaagactgcagctaaagcacagcctccgcctgtcgaagaacagatcatggatgaaaaagacttgacagatgcatatgagccactctcccgggtcatcccaatatcaaagaacaagctcacaccttacagagcagtgatcattatgcggttaattgttcttgggctcttctttcactaccgtatcaccaatcctgttaacagtgcctttggtctctggatgacatcagttatatgtgagatctggtttggtttctcctggatattggatcaattcccgaagtggtatcctatcaatcgtgagacttatgttgataggctgattgcacgatatggagatggtgaagaatctgggttagcacctgtagatttctttgtcagtacagtggatccattgaaagagcctccactaatcactgcaaacactgtgctgtctattcttgctgtggactatcccgttgagaagatctcatgctatgtatctgatgatggttctgctatgctcacatttgaatcgctcgcagagactgcagaatatgctagaaagtgggtgccgttttgcaagaagtacgccattgagccacgagctcctgagttctacttctcacagaaaattgactacttgaaggacaagatacacccatcttttgtcaaggagcgtagggctatgaagagggactatgaagagtacaaggtgaggataaatgctttggttgccaaggctcaaaagacacctgatgaaggctggatcatgcaagacggtacaccatggcctgggaacaatcctcgtgaccaccctggcatgatccaggttttcctgggtgagactggtgcacgggactttgatggaaatgaacttcctcggttagtgtatgtgtcaagagagaaaagaccaggctaccaacaccacaagaaggcaggggctatgaatgctctggtccgagtgtctgctgttctgacaaatgccccttacattcttaatcttgattgtgatcactatgttaacaacagcaaagctgttcgtgaagcaatgtgcttcatgatggaccctactgttggcagagatgtctgctatgtacaattcccccagaggttcgatggcattgatcgcagtgatcgatatgccaataggaacgttgtgttctttgatgttaatatgaaaggacttgatggcctccaaggcccagtttatgtgggaactggttgttgtttcaataggcaagcactttatggttatgggcctccatctctgcccgcacttccaaagtcttcgatttgttcctggtgttgctgctgctgtcccaagaaaaaggttgaaagaagtgagagggaaatcaacagagactctcggcgagaagacctcgagtctgccatttttaaccttcgcgaaattgacagttgtttttcagactacgatgagtacgagaggtccatgctcatctctcagatgagcttcgagaagtcttttgggctgtcctcggtctttattgaatcgacccttatggagaatgggggcgtccctgaatctgcaaacccatctaccctaattaaagaagccattcatgtcattagctgtggatatgaagagaaaactgaatggggaaaagagattggctggatctatggttcagttacagaggatattctgactgggtttaagatgcactgccgtggctggagatccatctactgcatgccggtgagacctgcattcaagggatcagccccaatcaatctttccgatcgtcttcaccaagttctccggtgggctcttggttctgtcgagatcttcttcagtcggcactgcccgctgtggtacggttacggtggcggccgtctgaaatggctccagaggctctcctacatcaacaccatcgtgtacccgttcacttctcttcctctcgttgcctactgttgcctgcctgccatttgcctgctcacaggaaagttcattatacctacgctgtccaacgctgcaacgatatggtttcttggcctcttcatgtccatcatcgtgacgagcgtgttggagctgcggtggagtggcatcgggatcgaggactggtggcgcaacgagcagttctgggtcatcggaggcgtgtccgcgcacctgttcgccgtgttccagggtatcctcaagatgattgccgggctggacaccaacttcacggtgacggcaaaggccacggacgacactgagttcggggagctgtacctgttcaagtggacgacggtgctgatcccgcccacaagcatcctggtgctgaacctggtgggcgtggtggctgggttctcggccgcgctcaacagcggctacgagtcctggggcccgctcttcggtaaggtgttcttcgccatgtgggtgatcatgcacctgtacccgttcctcaagggtctcatgggccgccagaaccgcacgccgaccatcgtggtgctctggtccgtcctcctcgcctccgtcttctccctcctgtgggtcaagatcgacccattcgttggaggaaccgagaccgtcaacaccaacaactgcaacacgatcatctgctgattcaccatcggtcagctgctgtcgtgccgcggcggacgtgtttctggtgttgcaaacgtgggttgcctgcctgatgcgggtctcctctgtctatctcgcatctgggcttttgccccaggatctgaagcgggttgtgtaggttagctttattttgcgtccaagtgttgattgatgttgtctgtgttatgaaaagttttggtggtgaaacctgaaatgttaaaactgggctcaattgtgagaaggcactgttttttaagtgtgtgtaaataataggaacgtgggaaaaaggaactgagaatcatttgcctaccaaaaggtgaaaccaattacattagtggatcttgaaatcgcagctgtgtttagc

SEQ ID NO: 2072 - DNA, 1194 bp, Zea mays
  Clone ID: PAT_MRT4577_42708C.1
cctcgaggccggccgggccgtccctgatccgacggccccgcgcgcgcgttcacgcccgacccagcgcctcgcctcggctgctctacctctatcccgcgacccgcgagatcggaatcgcggcgccccgccgccctcctccaaaatggcgccgtctctgctcggggggttcaccaagtcgttggccatgacggtgctctccgagatcggggacaagaccttcttcgccgccgcgattctggctatgcgccatcccaggaaactcgtattggcaggctgtttaactgcactaatagtcatgacagctctatcggcttctctaggttgggttgcaccaaatctgatttcacgtaaatggactcatcatttgaccactctattgttctttctatttggcatttggtcattgtgggaaggcttcaaggaagatggagattcggaagaattggctgaagttgaagcagagctggatgctgcctttaagagtaataaaggtgaatctaaaaataaatttaaggcgaatgatgatatgaagaaacagcaaagaccatttctcatgcagttcttctcaccaatttttctgaaggcattttctattacattctttggtgagtggggtgacaagagccagattgctacaattggcttggctgctgatgaaaacccgttcggtgttgtcctgggtggaatcatagcgcaagcactctgcactactgctgccgttcttggtggaaagagcctagcgtcccagatatctgagaagatggttgaactgtcaagcggagtgctcttcctgctcttcggtatcatgtccttactctctggaccagaaggagaattgtaatccctgcttgagcctttttcagctagctgattaacatggctttctcttcttagacctatcttatttcagtacatgaatgatggcaacgaaagccatccatccatggcgaacaggatggtgatttaacagtttagccgacacgctgtaaacatttcagtcgcccttcaaaaattactacatgttacagaagtctgtagcgattgtatatttgtattctgtcgtgcccagcacgtgaaattttgttatcgcaattacatgcgttaacaaagctttgttcgtgaaccaagtattcaggcaattaatatggggcttatagcaggcctttgtcttcaaaaaaaaaaaaaaaaagcggc

SEQ ID NO: 2073 - DNA, 1334 bp, Zea mays
  Clone ID: PAT_MRT4577_42710C.1
cccccgaggtcggccgggccgacggccccgcgcgcgcgttctcacctgaccctgctcttcgcctcggctgctctaccagtctacctctaccccgcgccccctccgagatcggaatcgcggcgccccgccgccctcctccgccatggcgccgtctctgctcggggtcacctttcctcttcctctctccccttcttcttcattcaggtgtgttaattaagcagaggaagtggcttggcttcttgctcatggttctaggtgcgtgcgtgcagggcttcaccaagtcgctggccatgactgtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcacgtaaatggactcatcatgtgaccactctattgttctttgtatttggtatttggtcattgtgggaaggcttcaaggaagatggagattcagaagaattggctgaagttgaagcagagctggatgctgtctttaagagtaataaaggcgaatctaaaactaaatttaaggcgaatgatgatatgaagaaacagcaaagaccatttctcatgcagttcttctcaccaatttttctgaaggcattttctattacattctttggtgagtggggtgacaagagccagattgctacaattggcttggctgctgatgaaaacccgttcggtgttgtcctgggtggaatcatagcgcaagcactctgcactactgctgccgttcttggtggaaagagcctagcgtcccagatatctgagaagatggttggaactagactcattttctttgcactcctgtaaaatgtccagcattagttcgatgcttgtctggttgtaggttgaactgtcaagcggagtgctcttcctgctcttcggtatcatgtccttactctctggaccagaaggagaattgtaatccctgcttgagcctttttcagctagctgattaacatggccttctcttcttagacctgtcatatttcagtacatgaataatggcaaccaaagccatccatccatggcgaacaggatggtgatttaacagtttagccgacacgctgtaaacatttcagtcgcccttcaaaaattggtacatgttacagaagtctgtagcgattgtatatttgtattctgtcgggcccagcacgtgaaattttgttatcgcaatgacatgcgttaacacagctttgttcgtgaacctattcaggcaattaatatggggcttatagc

SEQ ID NO: 2074 - DNA, 2802 bp, Zea mays
  UNSURE (1)..(2802): unsure at all n locations
  Clone ID: PAT_MRT4577_42713C.1
  unsure (1)..(2802): unsure at all n locations
aattcggcacgatcggcacgagggttctgccgctggcgcaccgcgtcccgcccgcgccgcgtcctgccggcggacgcaccccgcccggcatcctgcgaccttccttcaaccttcaacggcgcaatccatgcgcaattcccgctccccaccgtatcggcctcgctcgcgcaatccatgtggcctaaccttcaatcaaggctccgggcaaggtttccatcgttggcgaagcaccaacctccatccttctccacgctctcctggaagactatcatccatggtttacggagaaatcacgcctccccagacgtccaccaggggctacaccatgaccccgccccctctcccacaccgccggccagcctccatcgtcgatggaagggcgcgatctccgcaatccgcaggccccttcccccacaaatgccgccatggatggcgggtgcagcggatttcgcctccatcccgcttggccccctccgcgcacagccagccgcatgcccgcgcatggcggatccgcctccccctccgccaacgagcatgcgccagcacccgatcctcgctcgctcagccatgccctcgctcggtcccctccgcgcacgcgcaaaccaccgttcccccgcccgctccactgatccccatccccctcagatcctccctgcaaatcaaatccccccacgcgtccgcccacgcgtcgcccgcagcgcctcgcctcggctgctctacctctatcccgcgacccgcgagatcggaatcgcggcgccccgccgccctcctccaaaatggcaccgtctctgctcggggggttcaccaagtcgttggccatgacggtgctctccgagatcggggacaagaccttcttcgccgccgcgattctggctatgcgccatcccaggaaactcgtattggcaggctgtttaactgcactaatagtcatgacagctctatcggcttctctaggttgggttgcaccaaatctgatttcacgtagatggactcatcatttgagcactcgttgtgcctcgagcctcgaccggccgggccccgtcccggatccgacggccccgcgcgcgcgttctcacccgaccctgctcttcgcctcggctgctctaccagtctacctctaccccgcgccccctccgagatcggaatcgcggcgccccgccgccctcctccgccatggcgccgtctctgctcgggggcttcaccaagtcgctggccatgacggtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcgcgtaaatggactcatcatgtgaccactctattgttctttgtatttggtatttggtcattgtgggaaggcttcaaggaagatggagattcagaagaattggctgaagttgaagcagagctggatgatgtctttaagagtaataaaggcgaatctaaaaataaaactaaggcaaacgatgatacgaagaaacagcaaagaccatttctcatgcaattcttctcaccaattttcataaaggcattttctattacattctttggtgagtggggtgacaagagccagattgctactattggcttggctgctgatgaaaacccatttggtgttgtcctgggtggaatcatagcgcaagcactctgcactactgctgctgttcttggtggaaagagcctagcctcccagatatccgagaagatggtcgaactgtcaagcggagtgctcttcctgctgttcggtatcatgtcattgctctctggaccaggagaattgtaatccctgcttgaacccttttcagctggctgattgacatctctctctccttagacctatcttatttcagtagatgaatgatggcgacaaaagccatccatccatatggcgaaccggatggtgattcgatagtttagccgacacatcggaaacatttcactcgtccttcataaataactacatgttacagaagtctagcgatttcattctgttgtgctcagcatgtgaaagtcagtctttagtactccctccatttttttatatttgtcgcgttttagtttaaaaataaactagaagacgataaatattcgagaatgaaggtagtagaagctacatgcagtatcatgaatatgataagattcttgttactaaatttttgttgtcgcaattacatgcgttaacaaagcttagtttgtgaatccgcaggccaaatcgtaaattccgaattcaactacataatacgggtttttaatccctgcttgtgaccggtcccttttccgctggctgattgacatctctctctccttanacctatcttatttcagtagatgaatgatggcgacaaaagccatccatccatatggcgaaccggatggtgattcgatagtttagccgacacatcggaaacatttcactcgtccttcataaataactacatgttacagaagtctagcgatttcattctgttgtgctcagcatgtgaaagtcagtctttattattccctccatttttttatatttgtcgcgttttagtttaaaaataaactagaacacgataaatattcgagaatgaaggtagtagaagctacatgcaggctcgtgaatatgataagatagttgcttctgatgtgtagtgaagccaagaacaacaacctggagctggtgctgctgacaacaccagccataccagaagacaggatgaagggagatcaccaa

SEQ ID NO: 2075 - DNA, 1928 bp, Zea mays
  Clone ID: PAT_MRT4577_42714C.1
ccggccgggaaccccgattcgtttccccttggcacctggcgccctgtcgccttcgaaaaacagccgccgccgtcgcccgtcccggatccgacggcccccgctccttcgtctagtatttatactagtgccttgccggcgctgctccaaaaaaaaaaagcctctcgcatttgccccgctgcccacgcccgcagcgcctcgcctcggctgctctacctctatcccgcgacccgcgagatcggaatcgcggcgccccgtcgccctcctccaaaatggcgccgtctctgctcggggggttcaccaagtcgttggccatgacggtgctctccgagatcggggacaagaccttcttcgccgccgctattctggctatgcgccatcccaggaaactcgtattggcaggctgtttaactgcactaatagtcatgacagctctatcggcttctctaggttgggttgcaccaaatctgatttcacgtaaatggactcatcatttgaccactctattgttctttctatttggcatttggtcattgtgggaaggcttcaaggaagatgggtaccgagattcggaagaattggctgaagttgaagcagagctggatgctgcctttaagagtaataaaggtgaatctaaaaataaatttaaggcgaatgatgatatgaagaaacagcaaagaccatttctcatgcagttcttctcaccaatttttctgaaggcattttctattacattctttggtgagtggggtgacaagagccagattgctacaattggcttggctgctgatgaaaacccgttcggtgttgtcctgggtggaatcatagcgcaagcactctgcactactgctgccgttcttggtggaaagagcctagcgtcccagatatctgagaagatggttgaactgtcaagcgaagtgctcttcctgctcttcggtatcatgtccttactctctggaccagaaggagaattgtaatccctgcttgagcctttttcagctagctgattaacatggctttctcttcttagacctatcttatttcagtacatgaatgatggcaacgaaagccatccatccatggcgaacaggatgttgatttaacagtttagccgacacgctgtaaacatttcagtcgcccttcaaaaattactacatgttacagaagtctgtagcgattgtattctgttgtgcccagcacgtgaaagtcaacctttagcaatagctgcctacaatatgatgtaagattcttgtcactgaaattttgttatcgcaattacatgcgttaacaaagctttgttcgtgaaccaagtattcaggcaattaatatggggcttatagcaggcctttgtcttaaaaaaggaaacagcaaagaccatttctcatgcaattcttctcaccaattttcataaaggcattttctattacattctttggtgagtggggtgacaagagccagattgctactattggcttggctgctgatgaaaacccatttggtgttgtcctgggtggaatcatagcgcaagcactctgcactactgctgctgttcttggtggaaagagcctagcctcccagatatccgagaagatggtcgaactgtcaagcggagtgctcttcctgctgttcggtatcatgtcattgctctctggaccaggagaattgtaatccctgcttgaacccttttcagctggctgattgacatctctctctccttagacctatcttatttcagtagatgaatgatggcgacaaaagccatccatccatatggcgaaccggatggtgattcgatagtttagccgacacatcggaaacatttcactcgtccttcataaataactacatgttacagaagtctagcgatttcattctgttgtgctcagcatgtgaaagtcagtctttagtaaaaaaaaaaaaaaaaaagcggc

SEQ ID NO: 2076 - DNA, 428 bp, Zea mays
  Clone ID: PAT_MRT4577_42811C.1
tccgggggtcgccttcacctacctgacaccagctagcaactctttctcttctgcaataatggccgctcgctcctgctggtgccaaccgcagctggtcgcggccgcggcggtcctggcagcggcgctgctgctgctgggtctgagggggccgggacggcatcagcggccgcgagctgccgccaggcgacatcgtcggtggcgccgtgcctagggtacgcgatgggcagcgcggcgtagccctccgcggcgtgctgcatcgaagtgcgctcgctcaacagacgtgcgtcgtcggcggctgaccggcaggccacctgcaactggctcacgagcatgaccggacagttcggctgcggcatcagcatggacaactgatgcgacataacagggacgtgctgcgtctacatgtgcttgcccatcagcccaaccgg

SEQ ID NO: 2077 - DNA, 364 bp, Zea mays
  Clone ID: PAT_MRT4577_42956C.1
attgaactataactcataataaatctaaaagcagggcaccaccaatgatgggttgttggtagaacactgctgggtttgtcaaagcaagttggtggggtggcgggggttgttgcagttgtcagagggtgccaccttcacgcgcaacgtgctgggggaacggcgacaactgtggttgtgtcaacaatgtaccagggctcacaccatctagctggctgagtggtagctgctgttgctgtggcaaattagcacgagagttcaggggggccagttggctgactggaagatcttgctgggggtccgcttcaggtagctggctgcgtgctcgttgttgttgttgcatgtcccatgcgtgcgtcagtggacc

SEQ ID NO: 2078 - DNA, 2559 bp, Zea mays
  Clone ID: PAT_MRT4577_43021C.1
cgcacgcacgcacgaccacgaccagttgccacggcagaccaccccgcccagcggccagcttgctcgccacgaccacgatgggcttccccgtggggtactcggagtcggagatgctgctcccgcgcgtgctgctgcaggtgctcctcctcctcggccacttccaccgcttcctcctctgggccttccacgccgtggggctcggcgacctgatcgacctcggctgcaactacccgccgccgccgccctccgcgtccacggcgcacgagatgatggagcaccagcaccagcaccaggggcgcgacgacgtggcctccccgctgcagcaccagcgcccggagttcaggcccgtcgcggcggcgctcatcgaggaggcgctccccgtggtgcggttcgacgagctgggcggcgcgccgtgcggcggcggcgactgcgcggtgtgcctgagcggcatcggcggcggcgacgaggtgcggcggctcggcaactgccgccacgccttccaccgggcctgcctggaccgctggatggcgcacgaccagcgcacctgcccgctctgccgcgcgccgctcatcccctgggccgccgacgccgactacgacatgtcctatccgtctcccctgccgcccacgccactgcggcggcctcacgagctgctgctgctgcttaccggcctgggcggcttccagtgatgcgcctgcgcgtgggcagcgtggctggcacttgggcaggccggccggaacgggccgtgtgtgtttccttctccgtcagccgcgccgccgcccgcctccccaactgtcaggcgccgcgatggaggctctccacgaggagatgcccttcgacctcgacttccacccgtcgtctccgctcgtcgtcacctccatcatcaccggagagctctgcctgttccgctacggcccggagtcgcagcctgagaggttacttttgttaaaagcccacaaggagtcatgcagagctgttcgttttgtggactcaggaaaagtgattttgtcagggtcagctgattgctcagttcttgcctcagatgtagaatcgggcaaggccattgcccgcttggaggatgcacatgagaatgccataaaccgccttgtctgtcttactgaatctacaattgccacaggtgatgatgaaggctgcattaaggtatgggatacccgggagcgatcttgctgcaacagttttgaagtccacgatgattacatttcagatatgacctatgtggctgagacaaatcagatactggccacaagtggggatggaactttgtctgtgaacaacctgcggaggaataaagtaaggtcacgatctgaattttcagaagatgagttgctatccttggtgttaatgaagcatggtaaaaaggttgtgtgtggaactccaagtggagcactcttattatattcatggggatactttaatgattgcagtgaccgctttatcggacacacgcagtctgtggatacaatgctgaagctggatgaagacactttggtttctggatcatcagatggtgtgatcagattggtgggcatcctacctaataggataaaacagccacttgctgaacattcagaataccccattgaggcccttgctttgtcaaacgacaagaaatatttaggcagcatctcacatgataaaatgctgaagctctgggacttggaagaactcttgagtggcccacaggtagccaatggtgatgaacctgctgaagctggtagtgatgacagcgatgacgatagcgatgatgatgtgatggatgtagacatggcggcaacctcttctaaaggttcaaggagtaaaaaggcaggtaaaggacagagttcgagtcggccggcatcggatttctttgcagatctatagtcgtcaagtttcctaagttagaagctgtgtactctcctctctggttttttttgggttactgtacgcgagtgcgtgtgcgagtgggcaactttgaccgccggtgcaaggcatgccaaatgttgttttatttataagtatattgctgatggcatttatcagaagtagaagcagtaagtgttgtggacatggtgctaatggtttggaatttggaaagcggaaaccaaaccttatccacgcgaatccgatccgtggcgaggcaaaccgcgtgctcatgtgcggcccagcacgcccggtcggtcaggcgggtgaccgccgccaaacctgctcagttgccagccgtacacgcttgccggcctcgtcttcggtcgtgtctccgactccgttggtttttttacagaggctcccagtcccaggtcaaacaaaaaaggaggcgaaacagacaaagcagtcggaaattaggcaggtactgtactaggttgatctgtaggccgattgggcgactccaaatctgtggagctgtgaatcctttggcagattaaactaaaaattgtctctatagatcagaccatcaaaaaaaaagccacgcggccgcggacgcgtggggccattccgcatcgatcgatcgatcactcactcgctcagtcactcgaaaaaaaaaaacccccccccccacccaac

SEQ ID NO: 2079 - DNA, 1113 bp, Zea mays
  Clone ID: PAT_MRT4577_43023C.1
cgcacgcacgaggccaccaccacgaccacgagcgcgcgcttgccacggcagaccaccccgcccagcggccagcttgctcgccacgaccacgatgggcttccccgtggggtactcggagtcggagatgctgctcccgcgcgtgctgctgcaggtgctcctcctcctcggccacttccaccgcttcctcctctgggccttccacgccgtggggctcggcgacctgatcgacctcggctgcaactacccgccgccgccgccctccgcgtccacggcgcacgagatgatggagcaccagcaccagcaccaggggcgcgacgacgtggcctccccgctgcagcaccagcgcccggagttccggcccgtcgcggcggcgctcatcgaggaggcgctccccgtggtgcggttcgacgagctgggcggcgcgccgtgcggcggcggcgactgcgcggtgtgcctgagcggcatcggcggcggcgacgaggtgcggcggctcggcaactgccgccacgccttccaccgggcctgcctggaccgctggatggcgcacgaccagcgcacctgcccgctctgccgcgcgccgctcatcccctgggccgccgacgccgacgccgacgcggccgactacgacatgtcctatccgtctcccctgccgcccacgccactgcggcggcctcacgagctgctgctgctgcttaccggcctgggcggcttccagtgatgcgcctgcgcgtgggcagcgtggctggcacttgggcaggccggccacgcgaatccgatccgtggcgaggcaaaccgcgtgctcatgtgcggcccagcacgcccggtcggtcaggcgggtgaccgccgccaaacctgctcagttgccagccgtacacgcttgccggcctcgtcttcggtcgtgtctccgactccgttggtttttttacagaggctcccagtcccaggtcaaacaaaaaaggaggcgaaacagacaaagcagtcggaaattaggcaggtactgtactaggttgatctgtaggccgattgggcgactccaaatctgtggagctgtgaatcctttggcagattaaactaaaaattgtctctatagatcagaccatccaaaaaaaaccc

SEQ ID NO: 2080 - DNA, 612 bp, Zea mays
  Clone ID: PAT_MRT4577_43051C.1
gcaaacaaaaaccttgctcattttttttttgattggtttcatagcgggagcaaacaaagggaacaacaggggtcccaacacctaatccaaaggtagaacggacactaacacggggacagaagccaacggtaacacgattctttaaatagataaaataactcggccgaagccaggatgggcccacacattagtcccttcagccgccgccgccccctccttagccaccaccaccacccttgcgccgaccggcgtagcccccaccgccttcgtagccgccgccaccacccttgggccgaccgccgaagccgccaccgccgccttaacccccgtcacggggcccgccaccataacccccgccgccgcgaccgccgatgtagccaccgctgtcaccgccaccgacacgggactgggcctggttaacggtgatgttacggccgtcgagctcctttccgttcatgttttcgatagcgtcaagcatggagttttcggaggagaaggtaacaaagcccaagccgggagaccttcccgtttcccggtcggagatgaccttggagtctaggatctcgcccaaggaggcgaaggctttctccaacgacttgtttttggtggccc

SEQ ID NO: 2081 - DNA, 418 bp, Zea mays
  Clone ID: PAT_MRT4577_43129C.1
ctcaaatggagtttttgaggtatctctgcgtaaccttcaagggaactcatggtggaaacgttttctgaatcactctttttttcattgtggaaacatcttctgaattacacactgttctgatttgattctatgtattgctactcaggtcaaagcaacaaatggtgatactttcttgggtggtgaagattttgataatacactattggagttcttggtgagtgatttcaagaaaactgagggcatagatctgtctaaagatagattggccctgcaaaggcttcgtgaagctgcttagaaggcaaaggttgaacttttcgtgactttttagacagaaatcaatctgccattcataacagctgatgcttcatgggcaaaacatttgaacatcacacttgcaaggtcaaaattttgaattttt

SEQ ID NO: 2082 - DNA, 2186 bp, Zea mays
  Clone ID: PAT_MRT4577_43220C.1
tcgagccggccggggccgtgtcgtgcagtgccatcctacctccattgtttcccggctcttcgtcccttgggagttgggccttggcatttccttaagaaaaaaaagggggaaatcggcttcctactccccgtccttatcgccagccgaaccgacattgttttctccccccttctcgccttctccttctccccctagtctagaggcgtttgctccccaatcccttcggcccgtccgcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaatagtagatttcttctctcaccacccagagagcctacacatgttcaccttcctctttgacgatgttggcatcccactcaactacaggcacatggagggctttggtgtcaatacctactccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccagactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattagtgttcctggaattcactattctgatgataagctgctccagacgagaatcttctcctatgctgatacccagaggcaccgccttggtccaaactatctgatgcttcctgtgaatgcaccaaaatgtgcccaccacaataaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcaggctggcgagagatatcgatccttcgaccctgcaaggcaagaccggttcatccagcgatgggttgacgcactgacagaccctcgcgtgacccatgaacaccataccatttggatctcctactggtcccagtgtgacgccgctcttggccagaagctggcttctaggctgaacctgaagccgaacatgtaagatcgacgaggaagaaagcaggcaccggtggccaaggttgcaacgcaacatggagcgtgtgatgtttacaccaatataattgaataaacaggggatgtgcgcgtcgtcctacttatgctgatgctgatggtcggtgatcggttatatatactggaacttctggtgtatgctcttctcttctggagagacgtaatgtaacgaagaagaatgtgtcattggggcctgtggtacaaaccctgctgtgtatgggcctgtctataagaaacagcgatgagctgtgacgtatgtttctgacagtttatttactagtgagcacatctttgatttactagaacgaagagaagtggaggaactgtcggacagatgcagcaaggatcctcattcaataatagaatcatactcttgtttgcaaaaaaaaaaaaaaaaaaaaaaggggggggg

SEQ ID NO: 2083 - DNA, 2181 bp, Zea mays
  Clone ID: PAT_MRT4577_43221C.1
taccctcgaggccggccggggccgtgccgtgcagtgccatcctccctccattgtttcccggctctccgtcccttgggagttgggccttggcatttccttaagataaaaaaggggggaaatcggcttcctactccccgtccttatcgccagccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaatagtagatttcttctctcaccacccagagagcctacacatgttcaccttcctctttgacgatgttggcatcccactcaactacaggcacatggagggctttggtgtcaatacctacaccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccagactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgatacccagaggcaccgccttggtccaaactatctgatgcttcctgtgaatgcaccaaaatgtgccccaccacaataaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcaggctggcgagagatatcgttccttcgaccctgcaaggcaagaccggttcatccagcgatgggttgacgcactgacagaccctcgcgtgacccatgaacaccgtaccatttggatctcctactggtcccagtgcgacgccgctcttggccagaagctggcttctaggctgaacctgaagccgagcatgtaagatcgacgaggaagaaagcaggcaccggtggccaaggatgcaacgcaacatggagcgtgtgatgtttacaccaatataattgaataaacaggggatgtgcgcgttgtcgtacttatgctgatgctgatggtcggtggtcgattatatatactggaacttctggtgtatgctcttctcttctggggagacgtaatgtaacgaagaagaatgtgtcattgtggcctgtggtacaaaccctgctgtgtatgggcctgtctataagaaacagcgatgagttgtgacgttatgtttctgacagtttatttactaatgagcacatctttgatttactagaacgaagagaagttgaggaactgtcggacagatgcagcaaggatcctcattaaataatagaatcactcttgtttgcattcaaaaaaaaaaaaaaggccccta

SEQ ID NO: 2084 - DNA, 448 bp, Zea mays
  Clone ID: PAT_MRT4577_43251C.1
caacaaaacaaacgggtcccggtttaaaaacactaaatgcccaaaaagaaaggcttttttaacacttccataatacaaaatttaggaagctaaaaaaaaacagaggcaaagttataaacaaaatatcgggccaaacatggggggcattttgctgaaaaacttgacaggatgagggggcccatggggggggccctgcgggggggactggggtttcttcttcctcctcagcgggaaaaacgggggcattatttttgagcactgggccgaaagaacaccacgcctgagggctattttcggatggaaaggggggacaggccctgcggcctggttttggttggttaaataaaaagggctggtttgcccttccccagggaaaagcctaacccagttgccttgggctccaaaaagctggttgggggccccccatcccccagtattcgattttagc

SEQ ID NO: 2085 - DNA, 250 bp, Zea mays
  UNSURE (1)..(250): unsure at all n locations
  Clone ID: PAT_MRT4577_43692C.1
  unsure (1)..(250): unsure at all n locations
gttgacttatcctccccctccggatcgagttcgagttcgtgagggtctccaanattcggtttcgtggctcagcggatcgagatagccgcgtccgatgttgagtaccgctagcttcgtcggcaggctctcctgggccacggacgaccactacctccacaacgccttcagcacctacggcgaggtcctcgagtccaagatcatcctcgatcaccagacccagagctcccacatgttctgcttcatcaccttc

SEQ ID NO: 2086 - DNA, 720 bp, Zea mays
  Clone ID: PAT_MRT4577_43716C.1
ccgggccgggccctcgtgtgcgctgctcccacctgtagcccgacaggcgaagccgccgccgttgcttggttcatagccaccgcaggagactgacatggggggttttggcaagacccacaagagcactgcatacttaaagcgcttccagatcaagatcaacagaaggcgcgctgccaaaacagactacacggccagaataaggctgtttaaccacgacacagacatgtacaatacacccaaatacagatttggggggcgatttaccaacaaggacataacagcgcacatgatctttgatagtatagcaggtgatatggttcttgcttgtgcttactcgcatgagttgccacgatatggtcttgaaggtggtctgaccaactatgcaagtgcctactgcactggccttatgatgcatcctcgcgttctcaagacccgctgtttacataccgaatatcagggcaatgtttaggccattggcgaagatttctctgttgagccaactgatgagatgacgccttctcaggctctcttggatgttagccttatcaggactacgacatggaaccgtgccttttgtgccctcaagggatctttggatggaggcctgaatattcctcacagcgagaagaggttcgctggtttcaagaatgatgacaagcagcttggatgctgatatccatcgcaagtacatatatggtggccagtgtgatgactacatga

SEQ ID NO: 2087 - DNA, 186 bp, Zea mays
  Clone ID: PAT_MRT4577_43883C.1
aacactctatagtgagtcgtattatgtgaatccggtcatcgcatgatgcactccgacccaagtggcgtgcatgttctgcaacatgaccgtcgaaatgggatacggcatggccaattacggtgacagctactacaccgcatgcgctagatgctggctatgcaaatgcgacgacgcgtgctccgccta

SEQ ID NO: 2088 - DNA, 432 bp, Zea mays
  Clone ID: PAT_MRT4577_43927C.1
acggagagcgctcgctcaacagctgtgcttctacagcggcggaccggcacgccacctggaactgcctcaagagcatgacgggccaactcggcaagcggagtcagcatggccaacgccggcaacatccacagcaagtgcagcgtatccgtcggcgtgcccatcagccgcaccgtcgactgcaccaagatcaactgatcgatggaaccatagtggagagagctcgctccttggataaccgcggacgtggccattatcagcatgcagtcagcgtagtaccatagatgtactagctacatgtgtgtcatgcatcagactggcacataatacaaaagtagatcatgcacgcactagtgatcactcaccccagtgtccctccgatcaatgtcgtcgtcttcgtcgtgtaccttacgtgacacgctgtaacacgtacgc

SEQ ID NO: 2089 - DNA, 500 bp, Zea mays
  Clone ID: PAT_MRT4577_43992C.1
gcttcgtcggcgtccttgcctgagccaccagcaacgagtcgctggagaatgccttcgtctcctacggcgagatcgtcgactccaaggtcatcaccgaccggtagacggagaggtcccgcggctttcgcttcgttaccttctcctgcgagaactacatgctcgacgctatcgagaacatgaacggctgggagctcgactgccgtaacatcaccggtaaccaggcccagtcccgtggcgggggcggtgtcggcggtgactacggcgtagtgcggggtggcggcggcggttatgatggcgggcgccgtgacggcggatatggcggcggtggcggctacggcggtcggcgcgaaggtggcagcgtcggctacagaggcggtggcggttacagcggtcgtcgcgagggtggcggtggcggatacggcgtcggcggcggcgtcggctggagggactgatgtgtggacccatcctggcttcgcgcgagttatcttatctatctatag

SEQ ID NO: 2090 - DNA, 2270 bp, Zea mays
  Clone ID: PAT_MRT4577_43995C.1
tggccataaggagacgcggcgatcaggccttccttaattttcttctgttccatcctcgctctacctgcctgctgccagtttcaactctccaaggtcaacgccagccctcgcgcgcttggtgtactctagtttagtacaccaatccgcatgcattcttttttgtttgtttgtttgtttgtttgttttgattgacaaatatatgcggcagagttaagaacgaatcgactccgtcgtctcggctagtcgaccgtacatatccacgacctccaaaggccgccaaaacacccgatccggccagccttgtcgtgtcatcgtccagttagatgtcaactcccatctgaatctcctcctccatggcggctttcctataaatacgtcgcctttccatgttggatgtcattccattccagcaggcaacagcagctatagtttccaagggaaagggatacatcacctgctgctctagctctgctatagcgctagcagcaatataatggcggccgtcggcgccccgggcagctctctgcacggagtcacggggcgcgagccggcgttcgccttctccacggagcacgaggaggcggcgagcaatggcggcaagttcgacctgccggtggactcggagcacaaggcgaagagcgtccggctcttctccgtggccaacccgcacatgcgcaccttccacctctcctggatctccttcttcacctgcttcgtgtccaccttcgccgccgcgccgctggtccccatcatccgcgacaacctcaacctcaccaaggccgacatcggcaacgcgggcgtggcctccgtgtcgggctccatcttctcccgcctcaccatgggcgccgtctgcgacctgctgggcccgcgctacggctgcgccttcctcatcatgctgtccgcgcccaccgtgttctgcatgtcgctcatcgacgacgccgcgggctacatcgccgtcaggttcctcatcggcttctccctcgccaccttcgtctcctgccagtactggatgagcaccatgttcagcagcaagatcatcggcaccgtcaacgggctcgccgccggatggggcaacatgggcggcggcgccacgcagctcatcatgccgctcgtctacgacgtcatccgcaagtgcggcgccacgcccttcacggcgtggcgcctcgcctacttcgtgccgggcctcatgcacgtcgtcatgggcgtcctggtgctcacgctggggcaggacctccccgacggcaacctcaggtcgctgcagaagaagggcaacgtcaacaaggacagcttctccaaggtcatgtggtacgccgtcatcaactaccgcacctggatcttcgtcctcctctacggctactgcatgggcgtcgagctcaccaccgacaacgtcatcgccgagtacatgtacgaccgcttcgacctcgacctccgcgtcgccgggaccatcgccgcctgcttcggcatggccaacatcgtcgcgcgccccatgggcggcatcatgtccgacatgggcgcgcgctactggggcatgcgcgctcgcctctggaacatctggatcctccagaccgccggcggcgccttctgcctctggctgggacgcgccagcaccctccccgtctccgtcgtcgccatggtgctcttctccttctgcgggcaggcggcctgcggcgccatcttcggggtcatccccttcgtctcccgccgctccctcggcatcatctccggcatgacgggcgccggcggcaacttcggcgcggggctcacgcagctgctcttcttcacctcctcaacctactccacgggcagggggctagagtacatgggcatcatgatcatggcgtgcacgctacctgtggtgttcgtgcacttcccgcagtgggggtccatgttcttcccgcccagcgccaccgccgacgaggagggctactacgcctccgagtggaacgacgacgagaagagcaagggactccatagcgccagcctcaagtttgccgagaacagccgctcagagcgcggcaagcgaaacgtcatccaggccgatgccgccgccacgccggagcatgtctaagtctactactaataagatggatcgatccatcatccatgttcacctgctacctacctctacgtgtatgccttgtaacgcgccggaccggagcacttgtttgatacaaaagcacatgttaccaacacatagttgagatgtgccaacgatattcatcatgatgagtgattaccaaaaagatatcatctttggtttacagttgact

SEQ ID NO: 2091 - DNA, 890 bp, Zea mays
  Clone ID: PAT_MRT4577_44045C.1
tcgaggccggccgggcctccattgctccaccagttgatacatgtcttgtgacttgtgaagtgtggtgtgttcctatctgcatcaccttccttcgccttgcaaccctttggctagttcattcatacgaatggattattctaatttgcgtcgccaagctgcatccatgaaaaagactctctttgatcaggggtacctagatgagcaattttgccaggtggaagacttgcaggatgaagctagtcctaatttcgcggaagaggttgtcactttgtttttcaaggactcggccaggctaatatcaaatgctgaacaggctctggaaaaataccccaaagatttcaatagatgggatgcatacatgcagcagctaaaaggcagctgttccagcattggtgcttcaaggatgaagagtgagtgcgtgtcattccgggattactgcggacagggaaatgttgaaggttgtatgagatcgttccagaaagtgaagagggagcacggtgccctgaggcagaaactagaggcctatttccagctgctacgacaagctggtcctgctggagctgccaccaggcctggatgtaagaactaggagttgcaggaaaacggagtatgacccaagaagatacctcactacaactgactggcccagtggccctgctgcgcagcaattaggggtcagcatacgaagcgaaacaagagatgatatgcatggatatgcacaaaactgtaataagagattgttttttcaagaacaaaaaaaaaatcagaggagaggaagggatgggaaccttgtgtagtgagtttacaagctttactgaaagatggtattattgtctcatgtgtaatatattccttccattttaaaatatatttattcttagagtcaaaaa

SEQ ID NO: 2092 - DNA, 1601 bp, Zea mays
  Clone ID: PAT_MRT4577_44373C.1
acgagctacaccacggtccacggaccacggctatgttccactccaggtggaggctgcagccccggtttcgcaagccgcgccgtggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagcttttgaatgtgttcatgatggctggggggttgctgtgctggtgggtgtgccacataaggacggtgagttcaagacccccccgatgaacttcctgaacgaaaggaccctgaagggggccttttttggcaactataagccccgccctgatttgccaaatgtggtggagctgtacattaaaaaggagctggaggtggaaaagtttatcacgcccagggttccgtttgccgagatcaacaaggggtttgaccttatggccaagggggagggcatccgctgcatcatccgcatggagaaatagatttcgctgtttagtttgtgatttggcctggggttggggttaataaaaaaggcaaaggtagcctgcccttttgatgaggaggtacaaacacgctggggatgggccgcgcttgtgtgttgggttcagtttgggttttgccaaacagtaggggagcttcccgggtcggtaattatatggtatgaaccctccccttttggctttacatggtatgaacgtaaaatacaaattcccattaaaaaaaaaaaaaaaaaaaaactcgagcctgcagcccggg

SEQ ID NO: 2093 - DNA, 1835 bp, Zea mays
  Clone ID: PAT_MRT4577_44375C.1
cagccccggtttcgcaagccgcgccgtggtttgcttgcccacggcggccaaaccgcaccctccttcccgctcatctcgctttggatcgattggtttcgtaactggtgaaggactgagggtctcggagtggatcgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccatgaggctggaggtatcatagagagtgttggagagggtgtgactgacgtagctccgggcgaccatgtccttcctgtgttcactggggagtgcaaggagtgcgcccactgcaagtcggcagagagcaacatgtgtgatttgctcaggatcaacactgaccgcggtgtgatgattggcgatggcaagtcgcggttttcaatcaatgggaagcctatctaccactttgttgggacttccaccttcagcgagtacaccgtcatgcatgtcggttgtgttgcaaagatcaaccctcaggctccccttgataaagtttgcgtccttagctgtggtatttctactggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccggtgcaggaggtacttgctgagatgaccaacggaggggtcgaccgcagcgtggaatgcactggcaacatcaatgctatgatccaagctttcgaatgtgttcatgatggctggggtgttgctgtgctggtgggtgtgccgcataaggacgctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcgtcccgttcgcggagatcaacaaggcgttcaacctgatggccaagggggagggcatccgctgcatcatccgcatggagaactagatttcgctgtcagtttgtgatctggcctgggcttgggttaataaaggaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaagctcaaaaaagaaaaaaaaaaaaaaattgccggccgggactaccggataaaagggcaaatccaaccaaagggggagccgtgtaaaaaggaatcccctgtggaaacaagttttggggtaacaagggcaaaaacttttccccggcgaaaaattaaaatccaataaccagggcccccaaaaaaagagacccaactcaaaaaagtgaaaacccggggacccc

SEQ ID NO: 2094 - DNA, 1787 bp, Zea mays
  Clone ID: PAT_MRT4577_44376C.1
ctcgaggccggccggtttctaagttaaatcctaaggaaaaaaatggtgcttcttggtgctgcaaaaaaaaaaaaaaaaaatgttccactccaggtggaggctgcagccccggtttcgcaagccgcgccgtggtttgcttgcccacaggcggccaaaccgcaccctccttcccgctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaggaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactacctctagctcgcttgtgtggtatctgtatcagtatacatgtgtttgtttgcttatgtgtttgtttgcttgtatttgctggtgtctgtatcgcgggatgcaatgagttgttgtttggttgtgtcaaccaggctcaaat

SEQ ID NO: 2095 - DNA, 1539 bp, Zea mays
  Clone ID: PAT_MRT4577_44377C.1
gattttctcgctcctacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaggaccacaacaagccagtgcaggaggtacttgctgagatgaccaacggaggggtcgaccgcagcgtggaatgcactggcaacatcaatgctatgatccaagctttcgaatgtgttcatgatggctggggtgttgccgtgctggtgggtgtgccgcataaggacgctgagttcaagacccacccgatgaacttcctgaacgaaaggaccctgaaggggaccttttttggcaactataagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaaaaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatccccttttggctttacatggtatgaacgtaagatacaaattccaaaaaaaaaaaaaaaaaaaaaaaaaaaaaaaaaaaaaacaaaaaaaaaaaaaa

SEQ ID NO: 2096 - DNA, 2424 bp, Zea mays
  Clone ID: PAT_MRT4577_44378C.1
cattgggtacctcgaggccggccgggactactactagctactagctttaatttgtaactgcttgtctgccatggaggaggaggagggatcgtcgacatcatcagtcgctgtgcctgtgccgccgcctaataagtacgactcctggacgacagatccggaggagctgatgatgatgatggtcgacgaggcggcggtgcagcaggaagggccccgtcgccggcgggactccatgctcaacaagctcatctccacggtctactccggacccaccatcagcgacatagagagcgcgctctctttcaccggcggcggcgacgtggatgctcgcaactacaacaactcctccgccggcccaggggctttatcgtccccggagaaggtgctgatgagcaagatggagaaacaggctcatctcgctttggatcgattggtttcgtaagtggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccatgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactataagccacgcactgatctgccaaatgtggtggagctgtacatgaaaaaggtaaattgcaaagtgctgttccttcggtttccttaccagccgagcttttgctgaaaaactgttaagaatcgttcctgcaattctgcttggctctgcacaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgcccattcgatgagaaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattcaaaaaaaaaaaaaaaaaaaaaaaaggtttttgggccgggccccccctaagggggaattttgggaaatttccttcacactgggggccgttcgaccttgcttttaaagggcccatttccccctttaggggggggtttaaaaattaatgggccggggtttaaaaacggggggacggggaaaacccgggggttacccaatttattggctttgaagaaaatccccttttggccagtgggggtaatagcaaaaaggccccaaccgttcgcccttccaaaaattggcccacccttaatgggaaatggaccccccctgttacggccctttaagcgcggggggggggggggt

SEQ ID NO: 2097 - DNA, 1211 bp, Zea mays
  Clone ID: PAT_MRT4577_44488C.1
cattgggtacctcgaggccggccgggcaccatcgcacccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattattccactaataattttctctctgtacgcactcagtaccacaatggggaaacctaataaagggctaatacagcagcaatttatggtaatattattgctccctgaattttgttaactaaagattctgtatcatgctatatgtatgtttccttttttcttcttctttgttttgacaattgcttctttctctacggtgtttatccatcagctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacatacc

SEQ ID NO: 2098 - DNA, 396 bp, Zea mays
  UNSURE (1)..(396): unsure at all n locations
  Clone ID: PAT_MRT4577_44618C.1
  unsure (1)..(396): unsure at all n locations
ccaaacgaaanaaaaggagcaaccaagcaagngaaacaggcacaaaaccnncagtacgaaaaacctgcagcacagctgcaaattaaaaaagctatagcagtggacaaactgccaaaatcgctaacagctaaacgacaaattcccacaacctttggaacaccaaggtggaccaaaacgcaaaggcagtatctttggcaacagaaaagccgtggacacgccgaggagcgtaagcagcctcacaaaaattcaccaagcaaaagggggtccctcccccttggacccccaccccacagtcaggagcccgatgacggatgaaaacccgatgcggagcaaggccacaacggactgaccggtgccgcataaccccaacgtcttcgcattttcaatggcaaaacc

SEQ ID NO: 2099 - DNA, 457 bp, Zea mays
  Clone ID: PAT_MRT4577_44721C.1
cccatcatttcttcagtgctcatgacctagagaaaattcaagaaacagcgaggaatctcatggacgagcacagcaaagataccatagtcttagttactgagaaggattatgaccgtgatccagaggccctcaagacactggacgcaaacgtttgggtgctgtcttcttcactgcagattatgcatcacagcaaacaaggagaagatgaattcatgaggaaagtcaatgagattatcacagttacctggtgtgcgaagtcacatgcagcggaccgggccacgggttgctgatggtgtgtggtttgatatggttgtacctgaaaacaactgatagtgaaacattttttgcctggagatatgaacattagcatgcgggttatagtttttccttgcaaccgagtcagtgtcccagtcaaacttacaagatttaaacatgagcaagtaacccgacagcaacg

SEQ ID NO: 2100 - DNA, 309 bp, Zea mays
  Clone ID: PAT_MRT4577_44955C.1
aaaaaaaaacaaattttattcataaacaaaaggggttcacagatttttctccatacgaacatgctcattggggaagacccagttgcccacctagggctgcatacttacttattcagactgatccagcatggggcaacatgggaggttaacatgcttacagacaacaaattttcataacaaaagcctggcttggctgtttcacagaataaccaaacgccacccccgaaattggggccatttaaaataaacaccttaaaagcaaatggaccccaaaagcccgttttaattaaaaagcactttggccttttt

SEQ ID NO: 2101 - DNA, 2232 bp, Zea mays
  Clone ID: PAT_MRT4577_45001C.1
gccatttggcagagacgagacggacacctctgcggcgccgcctcgggcctcggcagacgacagcaatcacagcagcggctctacaagaaaggagaaactgcagaaaccgcgagggcaggcgcggcagcgggcaggcagtccatccccatgtgtttgtgactttgtgctcgtcctcatacccccaccccccagctcccgtctcctcgtgctctccactgctgcatgcgcctcttgtcctgtccccctccccaccttgttcctcccatcccgcgccgtctctgcacgaagcagagcgccggtccaccgacaaggacagctacaactacgacgcgcaggcagagccatcgctcatctggggctgccctcggttactcctcccctccgccgctgcccctgccttgtccacagctgttgttaattccttcatgagttggcgtcggcgccagcggggcggaggggaaggaggcggggcttcagcttccccggcgccggccgccgcctgaagatcccttcttctcctgtagtcctgtcgtcgggcgggcgaggtccaagcatcatggggctcttaggtatgatgggcgactcttttggttgctcggcgactggggagcgacttgtgtctgctgcaagagatggagacatccaggaggccagggctctcttagaactcaatccccgccttgctcggtactccacgttcgggatccggaattcgcctctccattactcggcagcaaagggccaccatgagattgtctccctcctaatcgagtccggtgttaatattaaccttagaaattgcagagggcagactgctctgatgcaagcttgtctatatggtcactggaaagttgtacagattctagttctttttaaagctaatattcacaggagagattgttttagcggcgcgaccgctattcattttgccgcgctaaaaggtcatactcgctgcattcggcttcttgtggctgattatgtgcctagcttgtcagagttttggaccattatgcgtggaaagtccacagatgaaatgaaaaagggtgcctttgatgccgcgtctctccagagactagttaatggaaagtctgatggtggtgtcaccccgcttcacttggcagcccttcatggacatgctgagagtgtacagttgctgctagaccttggagcctctgtctctgaggtgactgtcaatgatggttcaacaattgacctcattggttcggggagcacacccctccattacgcggcgtgtggtggaagtgctgtttgctgccaacttctcattgcagcaggagcaaacatgggagctcaaaatgttaacgggttgactcctttattggtggctcgttcgtggcacaagactagcatcgaaggtattctaagcaagcaaccagaaaaccgaatgcgtattcttccttcaccatacctttgcttaccactgatgagcattgtcaaaattgccagggaatgtggatggaggaaaacttccgcctcatccacttgtcaggatccatgtgtcatatgtttggaggtggaatgcactgtagctgcagaaggttgcggccatgagttctgcaccaaatgtgcactctacttgtgctccaccactagcagctcaacatccacccgtggagttcctggctccatatcatgccctctgtgtcgccatgccatcgtctccttcatgaggctcaccagcactaccccgataaaggagcttccatggacaagcgcgtcactagctctatgtgcagcgggctcaaacactggccgccctgaacatggcgggtccttgcatcgaaggcctgacctgcgtcgactgcgctccatctcagttcagctgggatgctcttcttttagatccattggctctgggaagctgtcgtccatgaagctgaactgcacaggagctgaagaggcggtgccttgcctcgtcagctgcctcaggcccgatgtgcagcgttcatcgtcgtacaggggaagaattaggagatattcagagttttgaaaggatggttttgtggcgtccttcctgcgagtttttagggtttgggaatttaaacctgtgtcgtcatgttcctcttcgtttgtttccctgttgtttaatatgcatgcagtcctcgttgtgaagatctatttgtgtacatggcccgtttgtcttcattacttttacttatatgtgaattatataccatctctgttttgcaattaccgacaagttaatactcc

SEQ ID NO: 2102 - DNA, 827 bp, Zea mays
  Clone ID: PAT_MRT4577_45018C.1
ttcggtcgaaggtggtttcagcgttgcgttcgaccccctcgacggctccagcattgtcgacaccaacttcaccgtcggaaccatcttcggagtctggcccggcgacaagctgaccggagtgaccggcggcgaccaggtcgctgccgcgatgggcatctacggccctcgcacgacctacattgtcgccctcaaggactgccctgggacgcacgagttcctcctcctcgacgaaggtaaatggcagcatgtgaaggacaccacgaccattggggaagggaagatgttctctcctggtaatctgagggcgacattcgataaccctgagtacgacaagctcatcaactactacgtcaaggagaagtacacattgcgctacactggaggaatggttcccgatgtcaaccagatcatagtgaaggagaagggcatcttcaccaacgtgacgtccccgacggccaaggccaagctgcggctcctcttcgaggtggcgcccctgggcttcttgatggagaaggccggcgggtacagcagcgacggcaagcagtcggtgctgcccggcgggatcaacgagctcgacgagcggacccaggtggcctatgggtccaagaacgagatcatccggttcgaggagaccctctacggctcgtccaggctcgccgccagcgccaccgccaccgcccgcgcccttatctgaattgcccacttttttcatcaacttaagtttttagattaaacttttttgaaacaatcagacaggagatctgtcttatatattgatgaggagaaagatgcccaaaggcaaaaaaaaaaaaaaaaaaggggcggcc

SEQ ID NO: 2103 - DNA, 1577 bp, Zea mays
  Clone ID: PAT_MRT4577_45021C.1
gggtacctcgaggccggccgggccggggcgcttgtccagacgtgcatcatatcctccgtgtgatccattcatccccgcgccgtgctagcttgctagttgcaagcaccagccgaccaccaaacggtagcgcacgcggacaatttaacagcatcaggtttaggccctgctgccgtcgtcgagcgcccgggccaccgcacacctgaaagcaatggagatcgtcgccacgcgctccccggcttgctgcgccgccgtgtccttctcccagtcgtacaggcccaaggcgtccaggccgccgaccacgttctacggcgagtcggtgcgggtgaacacagcgcggccgctctcggcgaggaggcagtccaaggcggccagccgcgcggccctcagtgcccggtgcgagatcggagacagcctggaggagttcctgaccaaggcgacgccggacaagaacctcatcaggctgctcatctgcatgggggaggccatgaggacgatcgcgttcaaggtccggacggcgtcctgcggcggcacggcctgtgtcaattccttcggcgacgagcagctggccgtcgacatgctcgctaacaagctcctctttgaggctttggagtactcacatgtgtgtaagtatgcgtgctccgaggaagtccccgagctccaggacatgggtggcccagtcgaaggtggtttcagcgttgcgttcgaccccctcgacggctccagcattgtcgacaccaacttcaccgtgggaaccatcttcgcggagtctggcccggcgacaagctgaccggagtgaccggcggcgaccaggtcgctgccgcgatgggcatctacggccctcgcacgacctacattgtcgccctcaaggattgccctgggacgcacgagttcctcctcctcgacgaaggtaaatggcagcatgtgaaggacaccacgaccattggggaagggaagatgttctctcctggtaatctgagggcgacattcgataaccctgagtacgacaagctcatcaactactacgtcaaggagaagtacacattgcgctacactggaggaatggttcccgatgtcaaccagatcatagtgaaggagaagggcatcttcaccaacgtgacgtccccgacggccaaggccaagctgcggctcctcttcgaggtggcgcccctgggcttcttgatggagaaggccggcgggtacagcagcgacggcaagcagtcggtgctggacagggtgatcaacgagctcgacgagcggacccaggtggcctacgggtccaagaacgagatcatccggttcgaggagaccctctacggctcgtccaggctcgccgccagcgccaccgccaccgcccgcgcccttatctgaattactagaatccgggctcgtagatgctggagtacacagtacagggaaattgcccacttttttcatcaacttaagtttttagattaaacttttttgaaacaatcagacaggagatctgtcttatatattgatgaggagaaagatgcccaaaggcaaaaaaaaaaaagtcaatacaaaaacaacaaaaaaaaaaaaggcccctacgtccg

SEQ ID NO: 2104 - DNA, 581 bp, Zea mays
  Clone ID: PAT_MRT4577_45643C.1
tcaagagcagtcttgcaccatctaccttcaagtctcgctacgtagcagcgcaataaaagaagcacgccgcaatggcgagcagcaccaatggccctctcctccacggccatgcgccgtaaaggccgcgaacttgccgtcatcatccgccttcggcgaggcccgtatgtcgatgctcaatacggcgtttaaggtctagtcagcggatgcgtccgggagtccgtgttactgccccgaccgcgtgctgtacctgggcccactgtccggcgagccaccgagctacctgacggtatagttcccgggcgactacggatggaacaccgcggggctgtgggcgtatccggagacgttctgcagatatgcgaggtgaatgtgatccactgccgctggaccctgatgagcgccttcggctgcgttttcccccagctgactcgccgactgcgcgtgaagtgccgttaggacgagcggtgctagagaggatcacagatcttcaacatggaaggtgtgtgatacctcgggaacccgagactcctctacgcgcagagcatgctctactatttaggggatgccacggcgtgctcgtg

SEQ ID NO: 2105 - DNA, 1970 bp, Zea mays
  Clone ID: PAT_MRT4577_4573C.1
aaataccgccggccgggccgttgcgtccgtccatcctcatccccatccgccacccaccccgcgcccctccttctcactccagtgctggctgccggccagctccgcccccggggtccttgagctggaggtggcggtggatgaccagctctcggagttttctgaggcgaggatcggagggcgttgcgttaggtccgcggttggtgagcggcggtcggagcggtctcgcgcgcggcggggtcgttcgatgacgcaggaatcgcgctctgggagggtgggaatacctcgcgctcgcgctcaaggtgctcgattaatttactgcctgaggctgagggggggcgcgcctgtgagctgaaccgttcccgctgcactgactcctgagctcgggaaatggttgggagcgtgcacgtcaatggatcggtccacggcggcaatggcacggccacggaggagcggctggacgagctgcgccggctgctcggcaagtcggagggggaccttctcaagatcgtcagcgtcggcgccggcgcgtggggcagcgtcttcgccgcgctactacaggacgcgtacggccatttccgggacaaggtgcagataaggatctggcgtcgcccgggccggacggtggaccgctccaccgcggagcacctgttcgaggtgatcaactccagggaggacgtgctcaggcgcctcatccgccgctgcgcctacctcaagtacgtcgaggcgcggctcggagaccgcacgctgtatgccgacgagatactcaaggacggcttctgcctgaacatgatcgagacgccgctctgccctctcaaggtcgtcactaacctgcaggaggccgtctgggatgccgacatcgtcgtgaatggggtgccgtccaccgagacgagggaggtgtttgatgagatcagcgagtattggaaggagaggatcagtgtcccggtgataatttccctcgccaagggaattgaggcctcgttggatccaatacctcgtatcattacacctactcaaatgattagctctgcaactggagttccaactgaaaatatactctatcttggaggaccaaacatcgcctcggaaatttataacaaagaatatgcaaacgctcgaatctgtggatccaacaagtggaggaagcctcttgctaagtttttgaggcagccacatttcattgtctgggacaacagtgatcttgtcacccatgaggtgatgggtggcctgaagaatgtctatgcaatcggtgctggaatggtggcagctttaacaaacgagagtgcaacaagcaaatctgtatattttgctcattgcacgtcagagatgatattcattactcatttgctgacagagcaacctgagaaactcgctggtcctctgctggctgacacgtatgtaactctcttaaaaggtcgcaatgcatggtatgggcaaatgcttgccaagggagagttgagtcctgacatgggtgatagtatcaaggggaagggaatgattcagggtatctctgcagttggtgcattttttgagctgcttagtcaacccagcttaagtgtgcagcacccagaagaaaacaagcaggttgctccagctgagctatgcccaatcctgaagaggctttacagaatactgataaaaagggagctcccagcaagggacattcttcaagccctgagggacgaaacgatgaatgatcctcgggaaaggattgagatggcacaaagccatgcattctaccgcccgtctctccttggaaaaccatgatctagttagtcttgtagattagtagaatataaacggacgctgtgctgcaggtttctccactgtgcttgctgtccttgtgtccgagctacatggggatggggctttgtcagttgtcgaattctttgtgcttcctcgttgccatggtgtacaagagattactgaaccaataaatgttctaagtgcatattatatgaacacccaatttg

SEQ ID NO: 2106 - DNA, 973 bp, Zea mays
  UNSURE (1)..(973): unsure at all n locations
  Clone ID: PAT_MRT4577_4576C.1
  unsure (1)..(973): unsure at all n locations
gctccggcagtgctaagatccaggacacgcgctgtcccgctagcaccacgcctccccttgtcatcgtcctcctcccacgtgctgctgtgggggtgcagacgggagacacatccggacctgattgatttcttcgttttgttctgctggtttacatggctgcaagaaagaaaaagcctttgcttattgcttgccaagcaaccagtgccagaataacaagatctcaggctgctgcaaatagtacaagatctgggctggctccttctgtaccagtacctctgaaaacggagcataaccatgcagcgaaaaaaaagatgaaaagggaagcttcagatgaaaatgcttctgctgatgctggagcttcagctcctctgcctaaaaggcgtacagttctcaagaatgtaactaacataagctgtgctaaaatttccaaaaggtgcactgctgtgactgggctgaagttgggtccctcccagaaggctgggcagagcataaacaagcaatgcacaaacaagatctccatgcttctccctctggctgttggagggagttcacttgtggatgattctaataatgctgaagaaacacaaatggtagaccttttggcacagaaagagaagcagattgttttgcttaaggaggctcagccattacagaatactgaacaaaacaaaggcggtgcttgtgatgaggcatctgttgaggaaagaaatgccatgaatgtacacgaaactgctgccttaaaggctggggtctctaatggtttaaacattgtagatattgacaaaaataatggtgatcctcaaatgtgtgttacctacgttgcagagatatacagaaatctaatggcctcagaggtatgctatttatttttggtaaaaaatagaatcttttaactattgtttgngctgactgttggttccctcacatagtaacatttcacaagcttgtgatctaggggacaagcgttatgctc

SEQ ID NO: 2107 - DNA, 294 bp, Zea mays
  Clone ID: PAT_MRT4577_45936C.1
cagaaatgcacttctattatttctgggaagccacatacatcacgataaaaaactttattattgaactataactcataagaaatctaaaagagggcaccaccaatgatgggttgttggtagaacactgctgggtttgtcaaagcaagttggttgaatggctgaaattgttgcagttgtaaaagggggccggcgtttggcgcaacgtgctgttagaacggtaacaactgtggttgtgtcaaaaaggtagaagggtttacaccagcttaactggctgaatggtccttgttgttgctg

SEQ ID NO: 2108 - DNA, 512 bp, Zea mays
  Clone ID: PAT_MRT4577_46026C.1
gggggcgagcggtgcgcaggctggccgccccatgaagaatcggggacgcggcccgaacggccagcctgtagtaaaccttcggccggctctggctctacctcaagaaggccggtccgcgcagtgcgtgggcactggcgcccccgtttacctcaggcgccgacctggaatacctcgccttctaggttctagagttggcaaggaacgcggggagaagacaacaagaagacccccatgatgccgcgccacgtgctcctggcgatccgcaacgacgaggagctcgagaagctgctggtcggcgagaccatcgagcacggcggggtcctcgccaacatccactccgtgctcctgcccaagaaggcggcggagaaggcggccagcggcagcagtaaggagaccaagtccaccaagaagggcgccaagtcccccaagaaggcttaaaaagtagggttttcatttgcgctgtgtgctgtagcatgttcgtgtctagaactagggatgggatgtgttctgct

SEQ ID NO: 2109 - DNA, 283 bp, Zea mays
  Clone ID: PAT_MRT4577_46128C.1
cctgcgagggaagagcacaagaggggtggctttattatgacgctggggggggctccaactccagctcgacggacgacgacggcatgggcggaaggaggaagaagggaatcaaggagaagatcaaagagaagctgcccggatgccacaaggacgaccagcatgccacggcgacgaccggtggcgcctacgggcagcagggacacaccggcggcgcctaccgtcagcaaggacacaccggatgcgcctactccaccggcgccgatggcaccggcgagaagaaagg

SEQ ID NO: 2110 - DNA, 621 bp, Zea mays
  Clone ID: PAT_MRT4577_46237C.1
cattgggtacctcgaggccggccgggactaccagtctgggctgctcccgccaggagggctttggcctgatgaccgggacggccatttcaccggcgacccgatcctccatgacgccgatccacggcgatacaaggcattcttctactgcaacgccaccgcgttcatggcgtcggtggtcatagtcatcctgctgctcaacagcacaataagcaagtacaggaggtctctcctccccatgaaaacggcaatggtgctggacctgcttgctctgcttggggcttacgctgctggcagctgcaggaaactgaagacttctgtatacgtcttcgcgctcgtcgttgctgttttcatgtacattgtcgttcacatcttgctgtccttcgataaaatggcacgggtcatgaagaggactggagaacagtgggttccatgtctgaagaagatgtgggcactcattgaaattgaacctccaaaccatcagccatcttcagaggaaccatgagaggctgacccttgaccgtatgcttgtattgtgattaaatgaattgttcaattgatatgtacctaagtaccttagaatcaatatttgtttttcccaaaaaaaaaaaaaaaaaagcggcc

SEQ ID NO: 2111 - DNA, 486 bp, Zea mays
  Clone ID: PAT_MRT4577_462C.1
gggctaggaaaccttgctggctactcatgaaagcagcggcttattacattcaaccaactagctgcattgagctctgctagttatttgtgacaacaacaactaccattgagccagctacctgctggctacccgcagaaattgcttacattcagccaactggcagcattgtactctactgcttatttacagcaacaacaactactaccattcagccagctagctgaagtgagccctgctacctagttgatacaaccacagctggtggcgttataccagcacgctgagcgtaacgctgggaccctcttacaactgcaacagttgctgccattcaaacaactggctttgacaaacacaggagaggaataccaacaacccatgattgagaggagcacctcttttagatttcttatgagttataggtcaataataaaggattcaggctgatgtacgcgggttcccaaaaataagaaagtacattagtagatt

SEQ ID NO: 2112 - DNA, 467 bp, Zea mays
  UNSURE (1)..(467): unsure at all n locations
  Clone ID: PAT_MRT4577_46345C.1
  unsure (1)..(467): unsure at all n locations
ctccccgaggggcgacagaggcaatttcgacctcgattcgaccgcgattagtcggcccgcgaaagggataccctccgacaagagaggatctgaaagatgagatccgtgacaccgctcgaatacgacatgaagggggccaaatccaaaggagccgccaaggccgaagccaagctggaggtgaagagcaaaggggnggagaagaccgccaagggcaggaaagggaaggacggcaaggaccccaacaagcctaagagggctcccagcgctttcttcgagatcatggaggaatttcgcaaggggttcaaggagaagaaccctaagaacaagactgtcgctgcggtggcgaaagctgctggcgacaggcgcaaatcccctgagcgagttcgcacaaagctcccctatgcagccaaggctacccagccacaagctccagtaccacaaggccctcgctgcctaccaacaagggc

SEQ ID NO: 2113 - DNA, 236 bp, Zea mays
  UNSURE (1)..(236): unsure at all n locations
  Clone ID: PAT_MRT4577_4657C.1
  unsure (1)..(236): unsure at all n locations
agtnccttttttattaagaatgctctggagggaagcaagttattcataagcnncagaatnncttgagcaaatcccttacaaatgataatcagataagtagagccaacaagacaaaactgtatctggcaacgcacatcgccttaccccagccgactacaccattattcttcagcaaaagcaagcaggtcctttcgtcccccttcagctcaagcgataaccataagaaaacctgctac

SEQ ID NO: 2114 - DNA, 725 bp, Zea mays
  Clone ID: PAT_MRT4577_46737C.1
gtcgacccagcgtccggacccattggtcgtcggcaatgttgtgggagatattgtggatcccttcatcacaacggcgtcactgagagtgttctacaacaataaggagatgacaaatggttctgatcttaagccatctcaagtgatgaatgaaccaagggtccacgtcggtgggcgtgacatgaggactctttacacacttgtcatggtggacccagatgcaccaagccccagtaaccctacaaaaagagagaaccttcactggttggtgacagacattccagagacaactgatgccagtttcgggaacgaaatagttccgtacgagagcccacgtccaatcgccggaatccatcgcttcgcattcgtcctgttcaggcagtcagtgaggcagaccacctatgcgccgggatggagatcaaacttcaacactagagacttcgcagccatctacggccttggctcccctgtcgctgcagtgtacttcaactgccagagagagaacggatgtggtggaagaaggtacataaggtgatatatcaaccaagcataacaacaaattggagtgaaaaaaatatatatcatgtgtgtggtgaacattgcaagtacgatgttcacaatcataagagccattattggatcacatattattctaatgtaatgtggctggggcgttctattggaaaaatagccacggtttgagatttacatataaatttgtgttaacg

SEQ ID NO: 2115 - DNA, 864 bp, Zea mays
  Clone ID: PAT_MRT4577_46740C.1
gcgtccgtaagctcggaattcggctcatatcctaaccaggctcactaatccttaccaatcctttcacccaaatcatacataagatagatgttcaatatgtctagggacccattggtcgtcggcaatgttgtgggagatattgtggatcccttcatcacaactgcgtcactgagagtgttctacaataataaggagatgacaaatggttctgagcttaagccatctcaagtgatgaatgagccaagggtgcacgtcggtgggcgtgacatgaggactctttacacacttgtcatggtggacccagatgcaccaagccccagtaaccctacaaaaagagagaaccttcactggttggtgacagacattccagagacaactgatgccagtttcgggaacgaaatagttccgtacgagagcccacgtccaatcgccggaatccatcgcttcgcattcgtcctgttcaggcagtcagtgaggcagaccacctatgcgccggggtggagatcaaacttcaacactagagacttcgcagccatctacggccttggctcccctgtcgctgcagtgtacttcaactgccagagagagaacggatgtggtggaagaaggtacataaggtgatatatcaaccaagctatgtgtgcttctctctctctcaagggagagaagcataacaacaaattggagtgaaaaaaatatatatcatgtgtgtggtgaacattgcaagtacgatgttcacaatcataagagccattattggatcacatattattctaatgtaatgtggctgggcgttctattggaaaaatagccacggtttgagatttatatataaatttgtgttgacgaaaattctgatattgg

SEQ ID NO: 2116 - DNA, 237 bp, Zea mays
  UNSURE (1)..(237): unsure at all n locations
  Clone ID: PAT_MRT4577_46795C.1
  unsure (1)..(237): unsure at all n locations
cgcagcgcgggcggnggnaatggcgatggccttcacctacgcgccaggcggaggcgcgggggcgctcgcgcagggtagatgcagggtcctcggtcccgcggggctgggctttctcgggccctccaagggcggcgggcttccccggcccctcgccctcgcccttgccagggggatgagcagccccgtctcggtgggcgccaggctgcgatgcgcggcgtctttcgtccccgcgggggg

SEQ ID NO: 2117 - DNA, 891 bp, Zea mays
  UNSURE (1)..(891): unsure at all n locations
  Clone ID: PAT_MRT4577_46815C.1
  unsure (1)..(891): unsure at all n locations
ccggccngggcccgggacgaaaccatccacacgagaagaagaagaaacaagccataccatagcacacaccaaaggttactcagtcacatggcaacatccagcacgggctgtctcgtcttgctctgccttgcgtctcccctcctcctccttcccagtgcggtggtccttggccacccatggggtggcggcggcggcttgtccccacagttctacgaccactcgtgccccatggcggagaagattgtgcagtccgttgtggcgcaggctgtggccaaggagaccaggatggcggcgtccttggtcaggctgcatttccatgactgctttgtcaagggctgcgacgcttcggtgctgctggacaacagcagcagcatcgttagtgagaaagggtccaacccgaacaggaactccatcagggggttcgaggtggtagaccagatcaaggctgctctcgaggctgcctgcccgggcacagtctcctgcgccgacattctcgccctcgccgctcgtgattccaccgccctggttggtggcccatactgggacgtggcgcttgggcggagggactcgctgggcgcaagcatccaggactccaacaatgacatcccagcccccaacaacacgctccccaccatcatcaccaagttcaagcgccagggcctcaatgtcgctgatgtcgttgccctctcaggcggtcacaccataggcatgtctcggtgcaccagtttccggcagaggctgtacaaccagacaggcaacggcatggccgacagcacgctggacgtgtcctacgccgcgcggctgaggcagagctgcccccgctctggcgccgacagcaccctcttcccccctggacgtcgtcgccccagccaagttcgacaacttctacta

SEQ ID NO: 2118 - DNA, 1172 bp, Zea mays
  Clone ID: PAT_MRT4577_47013C.1
ggccggcaccgctgctagcttgctagcatacttcccctacacgcgcgcgcaaccgcaagcagtcgatcgtcgcatggcgccaggaggcagcggcgagcggtggagcctggccggcgcgacagcgctggtcaccggtggcagcaaggggatcgggcaagccgtcgtggaggagctggccaggctcggcgcgcgcgtgcacacgtgcgcccgcagcgcggcggacctggaggagtgccgccggcggtgggccgagaaggggctccgcgtcaccgtctccgtgtgcgacgtcgccgtgcgcgccgaccgggagaggctcgtcctggacacggtcagcgcggccttcgacggcaagctcgatatcctggtcaacaacgctgcgctgctgctgctcaagccggcggcggagtgggcggcggaggactacgcgcggatcatggcgaccaacctggagtcgtgcttgcacatctcccagctcgcgcacccgctgctcctcaacgcctccgtcgccggaggggcgagcatcgtcaacgtctcctccatcgccagcgtccttggcttcccgcaggaagttatgtacagcgtcaccaaaggaggactgaatcagatgacgagaagtctagctgtggagtgggcctgcgataggatccgtgtgaactgcgtcgcgccgggcgtgatcatgacggacatgggtaaagagctaccggcggcgttggtggagcaggagcggtcacgcatcccgctgcggcggaccggcgagccggaggaggtggcgtccctggtgtcgttcctctgcatgccggcggcgtcctacgtcaccgggcaggtcatcttcgtcgacggcggccggaccattagtggcgcctgatcgacgacgacggccagctatatattctctattctactgtatttgaatttgttttcgttcttgatcggccatgtatcaccgtcagacgtcagcggcaataatccggccgccgtcagctagcgccatgcaagctgcccgatcatgcaaggtgcagacactgtcgttgcctgcagttctgttcctttttctactatggtttcttgtattcactgcccactggtgatgtttctgtgataacgacttcgacagaggggatacattttaaaaaaaaagaaataaaaaagggcgcccgccaactagtgagctc

SEQ ID NO: 2119 - DNA, 1085 bp, Zea mays
  UNSURE (1)..(1085): unsure at all n locations
  Clone ID: PAT_MRT4577_47014C.1
  unsure (1)..(1085): unsure at all n locations
tttttggnnttttgggggggggttggcgaatgtttcctcgaggtcggtcgggtcgggagattaccaaagatgccggcaccgctgctagcttgctagcatacttccggtcggcaagcagtcgatcgtcgcatggcgccaggaggcagcggcgagcggtggagcctggccggcgcgacagcgctggtcaccggtggcaagctcgatatcctggtcaacaacgctgcgctgctgctgctcaagccggcggcggagtgggcggcgcagcgactacgcgcggatcatggcgaccaacctggagtcgcgcttgcacatctcccagctcgcgcacccgctgctcctcaacgcctccgtcgccggaggggcgagcatcgtcaatgtctcctccatcgccagcgtccttggcttcccgcaggaagtcatgtacagcgtcaccaaaggaggactgaatcagatgacgaggagcctagctgtggagtgggcctgcgataggatccgtgtgaactgcgtcgcgccgggcgtgatcatgacggacatgggtaaagagctaccggcggcgttggtggagcaggagcggtcacgcatcccgctgcggcggaccggcgagccggaggaggtggcgtccctggtgtcgttcctctgcatgccggcggcgtcctacgtcaccgggcaggtcatcttcgtcgacggcggccggaccattagtggcgcctgatcgacgacgacggccagctatatatatatgcgaagaataaatgtgggtctattctactgtattttaatttcttttcgttcttgatcggccatgtatcaccgtcagacgtcagcggcaataatccggccgccgtcggcttgccgggagggaggtacccaactagtgccatgcaagctgcccgatcagtcgtctcgtctcgcctcgccggaaggcaaggcccccccactgtcgttgcctgcagttctgttcctttttcatactatggtttcttgtattcactgcccagtgcccactggtgatgtttctggtgataacgacttcgacagaggggatacattttaaaatncttgtgctaaaaaaaaaacacccaccc

SEQ ID NO: 2120 - DNA, 1367 bp, Zea mays
  Clone ID: PAT_MRT4577_47015C.1
tacctcgacccaagcctgcaagactgccggcaccgctgctagcttactagcatacttccaaatatgggcaggcactagctagctaggcggcaaagagccaaagactgccggcaccgctgctagcttgctagcatacttccggtcggcaagcagtcgatcgtcgcatggcgccaggaggcagcggcgagcggtggagcctggccggcgcgacagcgctggtcaccggtggcagcaaggggatcgggcaagccgtcgtggaggagctggccaggctcggcgcgcgcgtgcacacgtgcgcccgcagcgcggcggacctggaggagtgccgccggcggtgggccgagaaggggctccgcgtcaccgtctccgtgtgcgacgtcgccgtgcgcgccgaccgggagaggctcgtcctggacacggtcagcggggccttcgacggcaagctcgatatcctggtcaacaacgctgcgctgctgctgctcaagccggcggcggagtgggcggcggaggactacgcgcggatcatggcgaccaacctggagtcgtgcttgcacatctcccagctcgcgcacccgctgctcctcaacgcctccgtcgccggaggggcgagcatcgtcaatgtctcctccatcgccagcgtccttggcttcccgcaggaagtcatgtacagcgtcaccaaaggaggactgaatcagatgacgaggagcctagctgtggagtgggcctgcgataggatccgtgtgaactgcgtcgcgccgggcgtgatcatgacggacatgggtaaagagctaccggcggcgttggtggagcaggagcggtcacgcatcccgctgcggcggaccggcgagccggaggaggtggcgtccctggtgtcgttcctctgcatgccggcggcgtcctacgtcaccgggcaggtcatcttcgtcgacggcggccggaccattagtggcgcctgatcgacgacgacggccagctatatatatagcgaagaataaatgtggatctattctctattctactgtatttgaatttgttttcgttcttgtcttcttgatcggccatgtatcaccgtcagacgtcagcggcaataatccggccgccgtcggcttgccgggagggagatacccaactagcgacatgcaagctgcccgatcagtcgtctcgtctcgcctcgccggccggcaaggtgcagccactgtcgttgcctgcagttctgttcctttttctactatggtttcttgtattcactgcccactggtgatgtttctgtgataacgacttcgacagaggggatacattttaaaaaccttgtgctaatcattttttgtgcacatcagagttttttgagaacagggaaattaattccg

SEQ ID NO: 2121 - DNA, 3113 bp, Zea mays
  UNSURE (1)..(3113): unsure at all n locations
  Clone ID: PAT_MRT4577_47028C.1
  unsure (1)..(3113): unsure at all n locations
caaaatattgcattattcataaaacaaaaaggacagcttcagctgagtggtgagcgagacagattccacagcaatttgctcctcttccacgcacaggcaagactgctccccagaaaagattgtagttttcatcgatttagccggtttctgcccggggggatcgctgctggagatctcagagaaccgggaggctccgagcttttgctccgtttgcgtcgaatctgcctcgggagcggagaaaggagcggccttccgagctcgtaggggccgtccctgagaaggcgagaggggacgcggcggcggcggagtcagctctagggcgctcgtggaagtcggtgatgccggtggtttgaggacgaggcggcctcggtggttttgaggaagccagcctctgccgcggcaaggatggactccagcggggaggaactcctgaagaagatccgggaactggaggttgggcaggcgcagctcaagcaggagatgtctaagctaatacccggcgctggggagcgtcggcgctcgcaatccgtctcgccgcggcgcggcgtgccggtgccgccgccaccgccggccaaggcgaaggcgggggcgccaggtaggcggctgtccggggggtttgagggcgggcagcgcgcgtgggcccgtgggtcggcgtctttcccgcactcatcaccgctgcagcgggagggccgcgcaacgggcgctggagacgctagcaccagcgctaggctgccggagaggcagtactccagggtgcttcagtcaatggggcagtccgtccacattcttgacctcgacgggaggatcatatactggaatcagtctgcggagaatctgtttggctatcctgcatcagaagcccttggtcaggatgccctcatgcttctggttgattcccatgaccacaatgcggtaaataacatcttccaacgtatttctatgggtgaaagttggactgggaagtttccagttaagaacaagcaaggacatagattttcagttgttgccaccaatacacctttctatgatgaagatggcagtttgatgggtttcatttgtgtttcaagtgattcccgccaattggagcagatattttgtaagcctccgacctctgcaaggtcccagtcagaatcatctatgacatcttgtgatgggagttgcagcaacactagtcacagaatcaattcgttgaatagaagttcttttgattctaatctacccctgcaaagcactttagcatccaagataacgaatttggctaccaaggtcacaaataaagttcgttctcgggtcaggacagacgagaatgacgatggtggcagtggtgagagccattgcttggatcgtggtgcaaaggaagagccaacatctagcggaacaagcacaccaagaggggatgcaccacatggtccctttgctacagaagagaactcacctgggaaatcaacgaacccaaacagcgacgaatcagaaggaaaagtaggtctgcacaagattttgggttctaaggcagaggcactattgaacaagaaagggatatcatggccttggaaagggcgcgagaatgagggacctgatgaaagaaaccatgtgatattgccgtggttgcatggtggccaagagaatggtgtgaatcatcagaaggtttctgattctagtatatctccagacgcccaaggcgctgaacacaaccaacctagcaaaaatgaggcatcaggttcctggtcctctttcaacaataacagcacaggcagtgcaagcagcacgggaagcactaatagcagtgctctctacaaagtagatcatgaagcagattgtctggattatgagatcctgtgggaagaccttgtcattggagaacaaataggtcaaggctcttgtgggacagtatatcatgctttgtggtatggttcggatgtggctgttaaagttttctccaagcaagaatattcagaagaagtgatactgacctttcgacaagaggtatcccttatgaagaaattgcgccatcctaacatactgctcttcatgggtgcggttatgtctccacaacgcctttgtattgtatcagagtttctcccccgtggaagcttgtttcgcttacttcaaaggagcgctaccaagttggatgtgagacggcgtgtccacatggctttagatattgtaaggggcatgaattatcttcaccattccagcccgcctatcattcatcgagatttaaaatcatctaaccttttggtcgacaagaactggattgtgaaggtggcagactttggtctttcacgtctcaaagcgtgaaactttcttgacaacccaaaaacaggaaaaggaacaccccaatggatggcgcccgaggtgttgcgcaatgaaccttccgatgagaagtctgatgtgtacagttacggggttatcctgtgggaacttgttactcagaagataccctgggaaaatctgaactcgatgcaggtcattggtgcagtgggttttatgaaccaaaggttggatatcccaagtgaagtagatcctcagtggaaatcaattatcctgagctgctgggaaagcgacccgcagcaacggccgtcgttccaggagcttcttgagaggctccgggagctgcagaggcactacgccatccagcaccggaacacaaagaacagcatcgaggagtgaagaacacaatgcgacctctcagagcgctgtggcttgcttcgaagcattttgcgagcgaacgaacgaagaaccccaggtctctagaagggcctggaccctcctgtactgtatggttttgctttggcggaacagccaaggctggaagaagtttgttgtacagacgggggtacgttcttctttgtttgacagggcaattgtgactgtaatctctgggtcctaacacccaagggtagggtagagactatagagtgagtagtgactgagctccggattgctggcgcatttgggttcttctgattcgtggcaatgcaaatgcgtggttaacaataacatccaatccggggcttgtgtttctggaaaagggcatgatgatgtgtagattgtttgctctgacaaaaaaaaaaaaaaaaaaaaaaaaaagggcggccccgactngagtactc

SEQ ID NO: 2122 - DNA, 223 bp, Zea mays
  Clone ID: PAT_MRT4577_4741C.1
actaaatatttgggtgaagggattgtttacattccagggaggatttactgcagcaaaagtttacaaaggaccaggaccgcatactatctctctgtctttttctctccctttgcctttgccaatcgcaggtggctggcacaattttccccaccaaaaaaaaagcgtttcagtacgaatcggcaaatgatctcgcgaaccattgagggaacatagaaacctgggg

SEQ ID NO: 2123 - DNA, 364 bp, Zea mays
  Clone ID: PAT_MRT4577_47512C.1
taacaacatagaacgcacagtagtgtgccaacaatggccgtcaaaatattttggtttcttatgctccttggacttactgcaagtgctgttaccgcaaccattatccaacaatgatcacaagctcctatagctatcttttttgccccatacctctcaccagcggagtattgagtatgtgaaaacccaattgttcaaccctacaggatccaacacgcaatcgtagcacgcatgttacctttatcacccttgatcctgcaacaagccgaagccctattacagcagttacctttggtgcatatcgttgcacaaaacatcaatgtagaacaactacgacaacttgtgctaggaaaccttgatgactact

SEQ ID NO: 2124 - DNA, 335 bp, Zea mays
  UNSURE (1)..(335): unsure at all n locations
  Clone ID: PAT_MRT4577_47534C.1
  unsure (1)..(335): unsure at all n locations
ggccgctttttttttttttttttttttaatagccgacacgttgtgtgttcgtgtaaaacttttcctttacaacccagcgaaacagattgttcgtcatgatccggcctagaaatggtttaggcctcggaagcggccttgagaacaaacacctggccgtccaactcccaaaggtaaaagaatcgtgaagggggggggaccatgcatcctaaagttgtgatcatcagtgccctcctcccatggagacggaccggaagctgcccttgggctgctttggcagcatgatgatccctgcgacgcccgcggtgaaggcgaacacggcgncccccccccccgcg

SEQ ID NO: 2125 - DNA, 453 bp, Zea mays
  Clone ID: PAT_MRT4577_47692C.1
gtcacatatagaacacgatcgagcacacaggcactaagactggtgtaggataatccataaactcaccaagccgtgcaagcatcatggattacggtcagcaggagcagcgcggtcacggcgccacggcccatgtgagaccagtacggcaactcagttggtggcgtcgagcacggctccgtcgggatgaggcacggctcgggaaccaccggaggcatgggccagctgggtgagcacggcggctctggcatgggtggcggacagttgcagtctgcgagggaggagcacaagaccggcgagatgctgcatcgctccggcagctccagctccagctcgtctgaggacgacgtcatgggcggaaggaggaagaagggaatcaaggagaagatcaaagagaagctgtctggaggccacaaggacgaccagcacgccacggcgactaccggtggcgcctat

SEQ ID NO: 2126 - DNA, 482 bp, Zea mays
  Clone ID: PAT_MRT4577_47706C.1
aagaatctagaaatgtactttcttatttgtgggaagccacaaacatcagacaaaaaactttattattgaactataactcataagatatctaaaagagggcaccaccaatgatgggttgtcggtagaacgctgctgggtttgtcaaagcaagttggttaaatggaagcgattgttgcacttgtaagagggtgccagcgttaggcgcaccgtgctggtagaacggcatccactgtggttagatcaagaaggtagcagggctcacaccagctaactggctgaatggtagtagttgttgctgctgtaaataagcaggagagttcaatgctggctgtcgctagaatggaagatactgctgggggcaggcagcaggtacctgtgtgaatggtagttggtgttgatgcaaatcacaagcagagttcattgcaactagatgggtgaatggaagacactgctggtgctgatagtcagcatcaaggtttgct

SEQ ID NO: 2127 - DNA, 680 bp, Zea mays
  UNSURE (1)..(680): unsure at all n locations
  Clone ID: PAT_MRT4577_47708C.1
  unsure (1)..(680): unsure at all n locations
tagcgtgnngtcgcggccccgaggtactcaacattaggcagcgtagaaatatcatgcctccttatgctccttgatctttcgtgcagtgctgctacggagaccattttaccacactgctcacagagctcctatagcttccattgttgccccgtacctctcaccaacggggtctaatggatgtgaaaacccaattcttctttttacacgatccaacaggcaatcgcatctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagattcttccattcaaccaactagctgcattgaactctgctacttatttgcgacaacaacaactaccattcagccagctatctgctgcctacccacaacgatttcttgcattcaaccaactgacagcattgaactctcctgcttatgtacagcagcaacaactactaccattcaaccagctagctggtgtgagccactgtaccttgttcacacaaccacagttgatgacgctctacgcagaacgctgcgcctaacgctggcaccctattacaactgcaacacatgctgacattcaaccaac

SEQ ID NO: 2128 - DNA, 531 bp, Zea mays
  UNSURE (1)..(531): unsure at all n locations
  Clone ID: PAT_MRT4577_47712C.1
  unsure (1)..(531): unsure at all n locations
gtgnaccaatagcaacatagnaaagccgatagtgtgccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcgaggggggaaaacccaattcttcaaccctacaggatccaacaggcaatcgcagcaggcatcttacctttatcaccctggttcctgcaacaaccgtgagccctattacagcaggtacctttggggcatttgttggcacaaaacatcaaggcccaacaccttcaacaaccggggctatgaaaccttgcttcctactctcagcaacatgagtttcttccattcaaccaactggctgcattgaactctactgcttattcggcacaacaactaccattccagcacctagttgctgcctactccccagcaattctttgcattcaaccaactgggaagcttcgaacctctgctgcctta

SEQ ID NO: 2129 - DNA, 418 bp, Zea mays
  UNSURE (1)..(418): unsure at all n locations
  Clone ID: PAT_MRT4577_47714C.1
  unsure (1)..(418): unsure at all n locations
cggggatcgcacatattcattganaccaactagcaacatagtaaagcacaatagcgtaccaacaatggcagccaaaatattttgcctccttatgctccttggtctttctgcaagtgctgctacggcgaccattttcccgaaatgctcgaaagctcctatagcttcccttcttcccccgtacctctcaccagcggctgtcttttgtatgtgaaaacccgggggttcaaccctacaggatccaacaggcaatcgcaggtggcatcttacctttgttacccttggtcctacaacaatcatcagccctattacaacagttacctttgatgcatttattgggacataacataagggtacaacaactacaacaacttgtgctagcataacttgctgtctactttcagcatcagcattttcttcc

SEQ ID NO: 2130 - DNA, 679 bp, Zea mays
  UNSURE (1)..(679): unsure at all n locations
  Clone ID: PAT_MRT4577_47715C.1
  unsure (1)..(679): unsure at all n locations
gcggggccgggaactattatttgagaccaactangcaaatagaaaagcacaatagtgtaccaacaatggcagccaaaatatttgcctccttatgctccttggtatttctgcaagtgctgctacgggcgaccattattcccgcaatgctcacaagctcctataggttcccttcttcccccgtacctcataccagcggtgtcttcggtatgtgaaaaccgggggcttcaaccctacaggatccaacaggcaatggcaggtggcatcttacctttatcacccttgttgctccaacaatcatcagccctattacagcagatcctttggtgcatttattggcacaaaacatnagggcacaacaactacaacaacttgtgctagcaaaccttgctgcctactctcagcaacagcagtttcttccattcaaccaactagctgcattgaactctgctttttattttgaacaacaacaactaccattcagccaggtacctgttgcctacccccaggaatttcttccattcaaccaactggctgcattgaactcttctgcttatttacaggagcaacaactactaccattcagccagctaagctgtgggagcccctgctacctttttgacacaaccacagttgttggccggtcctaccaacacgcttgcgcgctaacgctgggcaccct

SEQ ID NO: 2131 - DNA, 496 bp, Zea mays
  Clone ID: PAT_MRT4577_47716C.1
ctctcaccagcggcgtctttggtttgtagaaaacccaattcttgaaccctacaggatccaacaggcgatcacaggtgggatcttaccttgatcacccttgatcctacaacaatcatgagccctattacatcagttacctttggtgcattcattggcacaaaacatcatggcacagcatctacaacaacttgagctagcaaaccttgctgcctactctcagcaacagcaggttcttcgcttcaaccaactagctgcattgaactctgctttttatttgcaacaacaacaactaccattcatacagctacctgctgcctacccccagcaatttctttcattgaaccaactggcagcattgtactctgctgcttattgacagcagcaaccactactaccattcacccagctagctggtgtgagcccccttaccttattgatacgagcacaggtggtgccgttctaccagaacgctgcgcctaacgctggcaccctctta

SEQ ID NO: 2132 - DNA, 600 bp, Zea mays
  UNSURE (1)..(600): unsure at all n locations
  Clone ID: PAT_MRT4577_47717C.1
  unsure (1)..(600): unsure at all n locations
actttacttatttctgagaagcccaaactcagacaaaaaactttattattgaactctaactcataagatatctaaaagagggcaccaccaatgatgggttgttggaagaatgctgtagagtttgtcaaagcaagttgcttgaatggcaacaattgttgcacttgtaagagggtgccagcgttaggcgcagcgtgctggtagaacggcaacaattgtggattgtgtcaagaatgtagcaaggctcacaccagctagctggctgaatggtaatagatgctgctgctgtaaataagcaggatagttcaaagctgtcagtaggttgaatggaataaattgctgggggtaagcagcagatagctagctgaatggtacttgttgctgttgcaaataagaagcacagttcaatgcagctaataggctgaatggaagaaactgttgttgctgatagtaggcagcaaggacttgctagcacaagttgttgtagttgttgtgacctgatgctntgtaccaataaatgcaccaaaggtaactgctgtaataaggctgatgattgttagaggaacaagggtgataaaggcaagatgccagctgcaattacct

SEQ ID NO: 2133 - DNA, 270 bp, Zea mays
  Clone ID: PAT_MRT4577_47838C.1
cgtcgtcacgcgccggaccagctcccagctgctccctgcagacctccctcctccatctccagcgtgtgttctgactcacctgcaccaatggctgctctttctgctgctggtgctcccccggcctcagctatcgtcgtttgagggctatgagaagcgcctcgcgatccacatcctttgaggcacctgtttttgcggacccccatggaaccggtccgcgtgccctttccaggtcccagtctgactctgttctggatctcgtacggcgcacga

SEQ ID NO: 2134 - DNA, 467 bp, Zea mays
  UNSURE (1)..(467): unsure at all n locations
  Clone ID: PAT_MRT4577_47967C.1
  unsure (1)..(467): unsure at all n locations
gccggccgggngagactctctcacgaatccatttccccatctcccatatctacttcgcgagttctccctcctctgccgccatggcgctctctgaggagaagacctcgtctgcacgggagtacaaggtctaggatctctctctgcggacttcggacggctcgatattgatgtggccgaggtagaaatgcccggcctcatggagtgccgcgccgagttcggcccgtccaagcccttcaccggcgctaggatctcgtgctctctccacatgaccatccagaccgacggcctcatcgataccctcaccgcgctcggcgccgacgtacgctggatgcttctgcaagatcttctccacgcaagaccacgccgccgagcgtcatctcgcgcgagtcggtcgccgtgctcgcctgtaagggcgagaccctacaccagtactgtgcgtgtgcaccgcatcactgcctcgactgggg

SEQ ID NO: 2135 - DNA, 532 bp, Zea mays
  Clone ID: PAT_MRT4577_47978C.1
ggataatcgataattgatgatgtattgaaaaacacgagttttgaaccatggagcagtttggaagttttacctgactggggaaaaaaaggacctgggattggaacttttatgaacactggtactaataatggtcacataacatggctttgtaataatactggtgatcaccacattcaccaacagcaggcaattcggttgccaatgaagaagcagccttaaacaagcacctgaactgcaactagcctaacaatcggaaccctgaaaggggaacaagaaacgtaatccaacccaaccttcgcgaaaaaagccacaaaagaaggctcttcaccgtgttcttcacaaatgcccacctttaagttaagcctaactttgcgggccctttctggagcaaggttcaccaacttgcccacttccctttggtccaagaactccaaagggtcatggtggagaatgccctgagcaagataaaccggaatgaacttttccacattattcctgctggacccaaaagtcatttgcgtcaagtcggtcg

SEQ ID NO: 2136 - DNA, 336 bp, Zea mays
  Clone ID: PAT_MRT4577_4804C.1
acacatccttattgagaccaactagcaacatttaaagcacaatagtgcacctgcggtggcagctaaaatatcatgcctccttatgctccttgctctttctgcttgtgctgctacggcgaccattttcccacaatgctcacaagctcctatcgctaccctccttaccccgcacctctcaccaacggtgacttcgaggtgctgaaaacccagttgttcaaccgtacaggatccaacaggcaatctcacgtggaatgttacctttatacacacattgttactccaacaatcatcagctctgtatcacagaaccttccttagcatgcattcattgcaaca

SEQ ID NO: 2137 - DNA, 385 bp, Zea mays
  Clone ID: PAT_MRT4577_4816C.1
acgcaactagcaacatagaaagcacaatattgtaccaacaatggcagccaaaatagggcggcttcttatgctacttggtctttctgcaagtgctgctacggcgaccattttaccgcaatgctcgcacgctactatagcttcccttcttccaccgtacctatcaccagcggagcattcagtatgtgaaaacccaattcttcaaacttacacgatccaacagggcattacagcatccattttacctttatcaccctcgatccttcaaccatcataagctctattacatcagttaccttcggcgcatttattggcacaaaacatcatggcacaacaactacaacaacttgagctatgcaaaccttgctgcctactctcagcaacagca

SEQ ID NO: 2138 - DNA, 607 bp, Zea mays
  UNSURE (1)..(607): unsure at all n locations
  Clone ID: PAT_MRT4577_48206C.1
  unsure (1)..(607): unsure at all n locations
ctcgaggccggccgggagcctctggccgctgcccgaccccgacgcctgctgcccaggtcttcgccggcgacgagcactccaccagacgagaggggattccaagatgccgagggccaccagcgacgcgaagctcctgatccagtccctcggcaaggcgtacgctgccacaccaacaaatctcaaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgccctaaanaaaanaaaaaaaagcggcc

SEQ ID NO: 2139 - DNA, 1021 bp, Zea mays
  Clone ID: PAT_MRT4577_48208C.1
gaggccggccggggccttgcattttcatcccctcccatctcccgttcgaattcgcgtcgggccgccacatcccagttccacctccctcctcgggccgccgtatcctagctgcctctcttgcttcttcagcaacggcgcgctagctactagtaagagtataagaaagaaagtgaatcaaggaaagagagtgagggatagagagaaactgcaaaaaaaaaaaaaacacgtagagaaggaacgacggcccagcccaggaaacacgatacggtccagagtcgagaggaagagaaaaaccacgtccccctcggccgcagaagcgaaacagcctctggccgctgcccgaccccgacgcctgctgcccaggtcttcgccggcgacgagcactccaccagacgagaggggattccaagatgccgagggcaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctagtgatcatgaatttcctcggataagcaactgctgcaccatgttggttaaaggttttgtagccccaggttgtggtcgctgattgttgcctttaaatgtttggaactgtcgtgatcgtgatgtcgaatatccatatgatctgttgaaggattacttgtgtaagctgagtattcccggagggagctattagtcgaatggacagtttgcccagcgctgagaatgtgacctagcatgttctttatttgaagaataattcatttttcaaaaaaaaaaaaaaaaaaaaaaaagcggcc

SEQ ID NO: 2140 - DNA, 863 bp, Zea mays
  Clone ID: PAT_MRT4577_48209C.1
ccgtccccctcggccgccgaagcgaaacagcctctggccgctgcccgaccccgacgccagctgcccagttcttcgccggcgacgagcactccaccaggtacgcccaccccttcccttcctccctgctgccgtgcgaaaccgatcacccgaaccctcactcgagctacttgcttacctccgcgtcttcggatctggcctgattgcgtcttcggatctggcctgattgcgtcttcggatctgatctgactatgacctgctcctttctggttatatcctcacctcacgtggagaagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgcccaaaaaaaaaaaaaaaaaagcggcc

SEQ ID NO: 2141 - DNA, 1754 bp, Zea mays
  Clone ID: PAT_MRT4577_48210C.1
cctcgaggccggccgggattttattgcatccttttcgccttccggctaatttattattatgtgacttgcggtctagtacgcggtggtggtatggtttacgcgggcatgttatgggttcgcaatcctgataggataatccgcggaacgcggataatctcgttttaaatctggcgcatgctgtcgcaagatgctctatactagctggactggattgcgctatattgattgggatttgagctgagacgcaaaaaaaagaagattacatgagcatcgaccggctacactaatctcacctcctcatgctcaggacgcgcgcccgcgtagagactctccgcgttgatgcgtgtcgcccgatgctgctgaacgacgacgacctgatctcgagcgcgaaattctgtatgctcttcagtgtttgactggatatatgaacttatcgtccttattttcttaaattatggaatttatctgccctcaaacatgattcgtagatataggcacaatgtgtcttatgctcttgctttgtcaactgtacattcttattcagtttgcaactcttctcagccaccggttacaacacagcagtcaacttgcaaatctcagctttatctagctgttggcaacctgattgcgtggatgttgtggcaccattcttaccactgtaacttttgcaaaccgtatgttcttcagtggctgataggatatatcaacttgttagctgtcattttctcaaaaaaatcaaagaattcgttgtcctcaatcatggttcttaggttgaggacaagctatctttgcgcacttgtgttgtcaactgaacattattatttgagttgtttctgcaacatatctagtaatcgcccttggatgctagtagaaacgaaacaccttcagagacttactggtatgctatttattgtggaaaataaaactctacgtgggttttgcggttgcccctgcccctcggccgcagaagcgaaacagcctctggccgctgcccgaccccgacgcctgctgcccaggtcttcgccggcgacgagcactccaccagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgtcgcctttaaatgtttggaactgtcgtgatcgtgatgtcgaatatccatatgatctgttgaaggattacttgtgtaagctgagtattcccggagggaactattagtcgaatggacagtttgcccagcgctgagaatgtgacctagcatgttctttatttgaagaagatataattcatttttcactgaggtgtgctgcaagcggccaattcctgggaaaaaaaaaaaaaaaaaaaaaaaaaaaaaaaaaaaaaaaaaaaaaaagaaaaaaaaaaaaaaaaaagcggcc

SEQ ID NO: 2142 - DNA, 323 bp, Zea mays
  Clone ID: PAT_MRT4577_48218C.1
gtcagctagctgctgcctacccccagctttttctttcattcaaccaactggcagcattgaactcggctgcttatttacaacagcaacagctaccaccattcagccagctagctgatgtgagccctgttgccttcttgacacaacaacatttgttgccgttatacttgcacgctgatcctaacgctatcacactacttacgactgcaacaattgctgccattcaacctacttgctttgacagaccctacattgttctaccatcaactcataactggtggcacccttttttatattgctcatgatgcatacaccgattttgaatc

SEQ ID NO: 2143 - DNA, 419 bp, Zea mays
  UNSURE (1)..(419): unsure at all n locations
  Clone ID: PAT_MRT4577_48232C.1
  unsure (1)..(419): unsure at all n locations
ggccgccctttttttttttggggggttggtaataaggagacctgcgttttttcccggcancaaagnnananctcagatctcaacaactgaacaaaatgtgttgggatgatgtacattgtatgctcagttcctgcattgcctgtttcaatatacagaatctataaaccacagacttgggttcagcctacacccctacttcatcgtaggaggatccacccatccgccatggtccttgatcagcttgatcaaagcgttacttgcacctttcaaggcgatggcgcaccttacaacaggtttcgccaaccataaagggcgatcttttcgggagcgcctgcgacgtatacgaaatgggcatgacccatctctcctgggccatttgacaatacaacccattatagcgaacgaaacacctgccatat

SEQ ID NO: 2144 - DNA, 757 bp, Zea mays
  Clone ID: PAT_MRT4577_48321C.1
cccgaacgcatctctggccaccatcgaccttcaagtctctgctacgtaggcagtgcaatatagaaagcagtcgcaatgacgagcatgaccatggacctctcctccacggccttcgccggcgatggcgaggacgtgtcgtacgtctccgccttccgcgaggcccgcgtgacgatgcgcaagacgggggagaaggtcaagccgtcggcggcgtccggcagccctgtggtacggccccgaccgtgtgctgtacctgggcccactgtccgtggagacgtcgtagctacctgacgtccgagttcccgggcgactacgggtgggacaccgttgcgttgtccgaggacccggagacgtatctccaatgaaccgggagctggatgtgtatccactcccgctgggccatgctgtgcgcgctcgtgtgcgtcttcccggagctgctcgcccgcaacggcgtacaagttcggcgaggtcgagtggtatcaaggtcgcctcccatatcttcatcgagggtggactgtactacctcgggaacccgagcctcatccacgcgcagagcatcctcgccatctgggcctgccaggtcgtgctcatgtgcgccgtcgagggctaccgcatcgccggcggaccgctcggcgaggtcgtctacccgctctatcccggcggcagcttctacccgctcggcctcgtcgacgaccccgaggccttcactgagctcaaggtgaaggagctcaagaacgtgcgcctcgccatgttctccatg

SEQ ID NO: 2145 - DNA, 1266 bp, Zea mays
  Clone ID: PAT_MRT4577_48555C.1
ggccgggccgcattccaaagtcggcctgttccacgcgctctgcgcacgcgcgcacacctacctaccccctgcgcttgcacaaaatccttcttgatccgcacaggaaggtcccggcagaagaacttggcgggcgaaaggcgaaaccgacgtgctcccgggcgggcggcgacagcggcatggagcgagagcggcaggcagtggcgaggaacaggaaggtggtgctgcgcgggtacatcgaccgcgcgcccagagaggaagacatggagctcgtcgacggcggcgccgtggagctgcgcgtccccgagggcggcggcggccccgcggtgctggtgaagaacctctacctatcctgcgacccttacatgcgcggcaggatgcgggacttccgcaactcctacatcccgcccttcaaacctggatcacctattgaagggtttggcgtggggagggtggtcgactccactcatccaggattcagtgctggtgacgttgtttccgggatgactggatgggaggactacagtctgatcaccaagcctgaacagctcaggaagatccagcaaagcgacataccactctcctatcatctgggccttcttggcatgcctggctttacagcttatgttggattctatgagatctgttcaccaaagaaaggggagtttgtttttgtttctgctgcatcgggagcagttgggcaaattgttggtcaacttgcgaagctccatggttgctatgttgttggaagcgctgggacagatcagaaggttgagctcttaaaggaaaaattcggatttgatgcggctttcaattatgaggaagagcctgacttgactgctgccctgaaaaggcacttccctgaaggcatagacatctacttcgagaacgtaggcgggccgatgcttgatgctgtactactcaacatgcgagtacatggccgcattgcggtatgtggcatggtttcccagcacggggtgactgctcctgccggaatccacaacctgttctccttgataagcaagaggatagagatgaaggggttcatccagagcgattacgtgaagatcgtgtatgtggaagacatgagcgttgggctggagagtgggccggcttccttcgtcggtctgttcagcggtaaaaatgttggcaagcaggtcgtctgtgtgtcgcgggattgaaaggcctggattttgttccctactggccagtacccttaaataaaatcaggaaaacattattttcaaaaaaaaaaaaaaaaaagcggcc

SEQ ID NO: 2146 - DNA, 1368 bp, Zea mays
  Clone ID: PAT_MRT4577_48559C.1
aatacaggagaaaaaataaacatgaccttgggccgcttttttttttttttttttagtggggtccttctcggagttgaaaataatgttttcctgattttatttaagggtactggccagtagggaacaaaatccaggcctttcaatcccgcgacacacagacgacctgcttgccaacatttttaccgctgaacagaccgacgaaggaagccggcccactctccagcccaacgctcatgtcttccacatacacgatcttcccgtctctgtaatgcctggtgatgtcatcgacgaactgcgggaacaggtgcacgtaatcgctctggatgaaccccttcatctctatcctcttgcttatcaaggagaacaggttgtggattccggcaggggcagtcaccccgtgctgggaaaccatgccacataccgcaatgcggccatgtactcgcatgttgagtagtacagcatcaagcatcggcccgcctacgttctcgaagtagatgtctatgccttcagggaagtgccttttcagggcagcagtcaagtcaggctcttccttataattgaaagccgcatcaaatccgaatttttcctttaagagctcaaccttctgatctgtcccagcgcttccaacaacatagcaaccatggagcttcgcaagttgaccaacaatttgcccaactgctcccgatgcagcagaaacaaaaacaaactcccctttctttggtgaacagatctcatagaatccaacataagctgtaaagccaggcatgccaagaaggcccagatgataggagagtggtatgtcgctttgctggatcttcctgagctgttcaggattggtgatcagactgtagtcctcccatccagtcatcccggaaacaacgtcaccggcactgaatcctggatgagtggagtcgaccaccctccccacgccaaacccttcaataggtgatccaggtttgaagggcgggatgtaggagttgcggaagtcccgcatcctgccgcgcatgtaagggtcgcaggataggtagaggttcttcaccagcaccgcggggccgccgccgccctcggggacgcgcagctccacggcgccgccgtcgacgagctccatgtcttcctccctgggcgcgcggtcgatgtacccgcgcagcaccaccttcctgttcctcgccactgcctgccgctctcgctccatgccgctgtcgccgcccgcccgggagcacgtcggtttcgcctttcgcccgccaagttcttctgccgggaccttccaccgcgcgccaggaagcacgtcggtttcgcctttcgcccgccaagttcttccggcgggccggacgcggggagtcgaccacgtcgacgcggccgcgaattcga

SEQ ID NO: 2147 - DNA, 394 bp, Zea mays
  Clone ID: PAT_MRT4577_48688C.1
cgcatccagagcagcctctgccgcctcacctggaagtgcttctcgtggcagggcgggtccagcctgcccagcttcttcatgctctccctcgcattcgtcgtcatgctctgcctcgacacccagaacttccagattctcgtactcatcgcaaacctcctcaaggacccctagctcgcattgtcctcactctctgcctgcatgacaatgtcagggaggatgttcatgatctccaatgcattcaacgcagcaaccagcggcagagtgagcaacgagctcaaccccagcaacccaaggtcggccgcgttctccgtgacggtagtgaccctactcttcttagtactgtcggtcctcgtcttccccctcatcctgctctgcctgaactacatcatctaca

SEQ ID NO: 2148 - DNA, 377 bp, Zea mays
  Clone ID: PAT_MRT4577_48719C.1
cggacgcgtgggcgccgactaaaccagaccatctaacaagtgccagcgccctctcgcaggggccgcaatggagagcaccttcatcatgatcaagcctgacggcgtccagaggggcctcattggtgagatcatcagccgttttgagaagaagggcttctacctcaaggccttgaagcttgtgaacgtggagaggttttttgctgagatgcactattttcatctcgttttcaagcccttcttccagggcctttgtggactacatcatctttgttcctgtggtggccatggtctgttaggtcaagagctgtcattctactggccgtacgatcattgctgccaccaactccctggcttttgagcccgttactaatccgtgt

SEQ ID NO: 2149 - DNA, 317 bp, Zea mays
  Clone ID: PAT_MRT4577_48854C.1
aaagatgagcggcgccggcggcatggagtgctcagggagcggcggcacggtggcgccgttcgtggcaaagacgttcgcgatggtggacgacccggccaccgacgcggttgtcaggtgggggccgcccagcaatagcttcgtcgtcgccgaccccttcgccttctcgcacgcgctgctcccggcccacttcaagcacgccaacttctccagcttcgtccggcagctcaacacctacggctttcgcaaggttgaccccgaccgctgggagttcgcgcacgcctccttcctccggggccagacgcacctcctgccccgca

SEQ ID NO: 2150 - DNA, 453 bp, Zea mays
  Clone ID: PAT_MRT4577_49002C.1
ttatttctgggaagcgcaccctcatcccacaaaaaactttattattgaactatcacttatttaaatctaaaggaggcaccaccaatgatgggttgctggtagaacgctgctgggttggtcaaagcacgttggttgaatggctgccattgttgccgttgtaagagggtgccagcgctaggcgcagcgtgctggcagaacggcaacaactgtggttgtatcaagaaggtaccacggctcacaccagctagctggctgattggtactagttgttgctgctgacaataagcatgatagttcaatgctgccacttggttgaatggaagaaactgctgggcgccggcagcaagtaactggctgaatggcagctgttgctgttgcacactactagcaatgttcagtgccgccagctgctaccatggaagaaactgcttgtggtgagacctgctaccttgt

SEQ ID NO: 2151 - DNA, 348 bp, Zea mays
  Clone ID: PAT_MRT4577_49004C.1
ttatttctgggcaagcgcacccacatcaccacaaaagactttattattgaactatccctcattgaaatcttaacagaggcaccaccaatgatgggttgctggtagaacgctgctgggttggtcaaagcacgttggttgaatggctgccattgttgcccttgggagagggtgccagcgctaggcgcagcgtgctggtagaaccgccacaactgtgcgttgtatcaagaaggtaccacggctcacaccagctagctggctgattggtactagttgttgctgctgtcaataagcatgatagttcactgctgccagttggttgaatggaagaaactgctggcggtccgcagc

SEQ ID NO: 2152 - DNA, 2883 bp, Zea mays
  Clone ID: PAT_MRT4577_49018C.1
gccggctcttatacgactatctatacggaaagctggcgcgctccgcagagcaccgatcctgtatagccggcgcgggcgcccggccggcctcggcacgagaattcggcacgaggaaagaggagctggccgcgtcgtatcgactcctgccgccgaaaggccgagcccgagcccgtgtcccggtgcccgttcccgcaaccctaatccccttcccccgtcggctctcgccggcgaagaagagggagccgcgcggcgtcgccagggagcacgcgccccctcccttcccggctccctccgcgccgtggggaggcgcgtccacccggatccgccctcaccgcgaggcagaggggaggagagggagccaggtccggcgcacccgctgtcgtccgcgccgaagagcgttaagagtctccccacaggcttggctgagggaaacttgtgctctgcgcatcttggacactacttcaccatttaccaagtcttgagttattgctccggtgccagacaaaaaaccaaactctctggccgaacacagtgatggcgcaagcctgtaagaagaggagaggagtttatataagcagtgaatcaggagactctgatacagattctgatgttgagggaagcaaacactctcaaaagtctggggtgacatcaatttctacatgcgagcaccagtcatcttataacctcaaggctgcaagtatgaaaagtagcaggatgataaggctgtgtggaaatatcgtaaggaagctcatcgatcacaaatgtggctggcttttcaaagaacctgttgatccagatctatatgggattccagactactttgatgttatccgcagtccaatggatttgggcactattaagaataaactcacaaaaaagaaatatgtaagcattgaggagtttgcagcagatgtgaggctaacattttcaaatgctatgaagtataatcctccaggcaatgatgtgcatatttttgctaaagaattgaatgaaatgtttgattcagaatgggaatcagtagaaaggaaatttagaggccgaaaccttggtcaagaccagcagacaatgaaggccataaaagttcgagctatgatggattcaaagtctacagttgctagagggccggttgcatgctcaaaccctaaaactttggttgctagaggtccagtagcttgctcaaattcgattgcaaagaagacactgacagatgcattatcctccaaagtaaaaatcaaattttccgtgcgcagctctgcgcatacctcttccaaagatatactcgttcaagcagctggtagcaaagaggggtccttaaatcactctgtccctactggcaacaaagaggcatcttcaaattgtactcttcctatcgctaaggaggctaaaatatcaagggcacgagaaattgagcgctgctctggttcaattggaaaacaatcatggtcttgcaatgacacttctacttcacctctcgcttcctctgtgcaaggtgaggaaagttaccttcatgatgaacctttgtcaccaagcagggctcttcgtgcagcaatgctcaggagtcgttttgctgggactatagtgaaggctcaacagaaggcacttctagatcatgggaagaatatagaccctgtgaaattgcaattggaaaaggagaggctggaaaagaggcagcaagaagagaaagcaaggatcgaggcccaggtgaaggctgctgaagcagctgcacaacaaaagtttgaggaagaaatgaggatgaagagaaagcaggaaagggaggcagcacgcctggcactacgcatgatgaagaagactgttgatattgacaacagtgacttcctaaaggagctggagaacttcagcaaaacatggcaggcaaatccacctggcaaattaatcgtggattttatcagtggggacttgccaccggggttagggagtccgctggagaggctcggcctcttcatgaaggaagatttcgaggatgaggtagaacaggaaatggaggacagagtgtcaccctcaatggatgttgacatcaggaaagatttccaggaagacttaggacatgaaatgcaggacagtgcatcacccgtgactgtcattggcacaaagaatgacgtacagggagtggcaggacatgaaatggaggacagcggatcaccagccacagtcattgacacgaagaaagaagagacagaacatgagatggtggacagcgtatcacctttgatggatgttgacacggaggaaggggagatcagctgctgacggtagctacacctctcttcacccgcataatttattgaggcagacatccttgcttggttgttagattaggcaatttcataagcagagtgatgcagaaacattagttttatctgctttcatcgtagaaccatgtggtgtggagaacatgtctcagacgaaatgacgagtggttttggatttgctgcggattttaattttcgtggtcttgtcagtctggcaagagtatgatgactctgtatgttgaatttgacctcccccgctggatgacatgtataaaaggatgagaaaaaaaggatagtttggagctagtgtatgttgttggagtttatggtggagccagatttggtgagcgtgtcgtggacgtaaatgtaggtatagctatatacttgaaatattgataagagtgtttggttcaaaggatcaattcattccagttaaacatcatgagcttgttaatgggtgtttggttcgagagttcgttaatgggtgtttggtttgaggaataagctagtctactattttttttatttagttgttgaatgtaattttttgacctgtcatctcatttcttacaagtgaatgattatttctaagtctaaaaaaaaaaaaaaaaaa

SEQ ID NO: 2153 - DNA, 475 bp, Zea mays
  Clone ID: PAT_MRT4577_49027C.1
gcgcccgggatacacatattattgagaccactagcatcatagaaagccaatagtggaccaacaatggcagacaaaatattttgccttcttatgctccttggtctttctgcaagtgctggtacggagaccattttcccacaatgctcacaagctcctatagctgaccttcttgccccgtacctctcaccagcggagtgttcggtatgtgaaaacggcaatacttgaaccctataggatccaacaggcaataggaggtggcatcttacctttatgacccgtgttcctgcaacaataatcagccctattacagaagggacctttggagcattgattgggacaaaacattagggcacaacaactacaacaactagagctagcaaaccttgatggctactctgaggaacaacagggggttccattcaaccaactaggtggatggaactgtggttgttatttggagcagcagcaactacca

SEQ ID NO: 2154 - DNA, 368 bp, Zea mays
  UNSURE (1)..(368): unsure at all n locations
  Clone ID: PAT_MRT4577_49100C.1
  unsure (1)..(368): unsure at all n locations
ggggaaattcccaaaagcacaattttgggaggaccaggcaaaaaaaaacattaaaagaggaccaaatattcaaaggagaccctcggttccccacaagacagcaaaaataattttcgggacaatctagcagccccaaaaaggccccaaatagttagttaaaaaaaagctacaaactctttaattccaaagttaaacaggtccccaattaaaagggcaaggggtttaaagtttaaacatcctcagggccgaccaaacgggaggttttcaaattcactcgaaataaaaccccttctccgggagctccgggacgacctcattcctcatccgaacccacagtttcggggcttccggctcgaacttntaaaacg

SEQ ID NO: 2155 - DNA, 1763 bp, Zea mays
  Clone ID: PAT_MRT4577_49162C.1
gcaaaaagaaagctaaatttcaagaccttattttaccccataacttcggggatagctcttattgctaatgttataaacatggctgccaggaagttctcctttggtcctcctttggatcctttataaatatatatggctaactgaagagcggtacaactcaccaatggactcacggatcaatagtcgaattcgacacacagattaccaatttttcaccaagcaaacggtttgaacagctatgtctgaatagtgcaaccgatatgttaactatcttgcagtttgcgccgcttctcttgggagatcttagatctgtcgcctgtggctacttcggtaccagattcttcgatctctacgagtttctgttttacacctaattcagacgaacgttctcccagttctgcagtccgtgcgatgtctcctgttccatttgggtccatggttgcaccactatccttgtttgtagactggctctgattagatgacggtttagctgttgtatcccttgaggatggatcctggactttctccgtgctcgattgactctgcttttcaaacatcatctgcagatactttccttgctcttcaatccgcaactgcaattttctctgaatctcaagctgttcatgaagccgtttctggacttccatctgaaggcgcagcgcttcagtaagatccatgctcgttttcaggtccaggaccagctcttcagtggctgtccttttttccgatgtaccttctgacaggtctggtttatagcgggctgtgcggtacttctgcaggtggcttttgacatgatatatagtcaaaccatcaactttcataagctttagcacacccttaggagtagctttttcgctaccgccaagctgatttacagcatctacaaaacattcatggagttctggggtccatctcatccgttgtttggcaactgaagcattgctgctattgggaggactagcaacaggacaaatctccctactatgagatgaagctgactgatttactgcaggtagtgatgtagctgagttggaaatttgaatcatggcttttgagtgggaatcagtagctgttgcgtcaagaatatctttccaatcatcattcattatatctgcccaccaatcattttgtgtagcactctcatcagatgtcatagcaggacgtatactatggatttgattaacatcagaagcagcaatattatctgtgttgagtggtgaaacatccatagaagatgtgaaccaggctgccttagtgtgtgtttctggggtattatcagatagagactggagagcttcaaaattggatgagagaaataaagggtgcagccattgtctggctatcaaggttagacacagaatcaagtggactagcagtgtagcctgaatatggtaccccgataacaccagctcttgggtgcaaactaacagactgatgtgtgtcaatacacaagggcatagagtcatcaggaagctgcctcaacataggaatatgctgggggttatgaggccttgggaagctccctttcaaaggatttggcagaataggcaaagaggatgacattgctcccaaaactctgctcttttgagactgcatcagattaaacttcctcattcagaacagtgaacaagctccttcctttccataagtcacttctggtacatttcattaccttgcttaaagcattaatccattactctgctgcgcaaagaggaggacgacacccaccagttgcccggctcacggggaagcgcacctctgcc

SEQ ID NO: 2156 - DNA, 392 bp, Zea mays
  Clone ID: PAT_MRT4577_49219C.1
gaccaactagcaacatataaagcacactaacggaccaacaatggcagccaaaatatgttgcctcacttatgctccttgatctttctgcaagagctgctacagcaaccattttcccgcaatgctcgcaagctcctatagcttgcctctttcccccgaacctatcaccagcggagtatctagtatgtgaaaacccaattcttcaaccctacaggatccaacaggcaattgcagctggcatattacctttatcacccttgttcctacaacaatcatgaggcctattacaacagttacctttgctgcatttattggcacaaaacatgacggcacaacaactacaacaacttgtgctagcaaaccttgctggctactattagcaacagcaggttctt

SEQ ID NO: 2157 - DNA, 3715 bp, Zea mays
  UNSURE (1)..(3715): unsure at all n locations
  Clone ID: PAT_MRT4577_49229C.1
  unsure (1)..(3715): unsure at all n locations
cattgggtacctcgaggccggccgggatacctatctcctcctcctcgcctacgactacgagttcgccgtggcgcgccacccgccaccagtcagtcccgccgcgccgataaaccctccctccccgaatcggagaaccgcatctctgagattcccctccgacacccgccgtccgcgctgggatctcccatccggacccgtcttccatcattgcccctcgaatttctcctccacagactcagtttcgtcatccgcgcttggtttcgtcagttccggcgggcctagcagattcgtggctcttcctcgtacacaatccgggctgggtgagtggggccccttttccgcctagcgggttgcgtgcggccggcggtgttgcttggaaggcaaatcgagtgtttagggggccgcgtgcgggggcggtggtaaataaagctaccagggttggtggggtcattagcggagctgtgactctgtgaggcgacgatggggctgggggctgcgatggcgctggcgctgggcgacccgccagcggactacgcctccatcgcggcggtggggctgttcgtggcgctcatgtgcgtctgcatcgtcgtcgggcacctcctcgaggagaaccgctggatgaacgagtccatcaccgcgctcttcatcgggctgggaactggagcggtcatcctgttcgcgtcgagcgggaagcattcgcgcgtgctggtgttcagcgaggacctcttctttatttacctgctgccgccgatcatattcaatgcagggttccaagtgaagaagaaacagttctttcgaaacttcattactattacactgtttggtgcagttggcaccttgatctcttttactgtaatatcccttggcgctctaggactaatatcaaggcttaatatcggcgcacttgaactgggagactatcttgcacttggggcaatattctcggccacagactcggtttgcaccttgcaggtgttaagccaagatgagacaccattcttgtacagcctcgtgtttggtgaaggtgttgtcaatgacgcaacttctgttgtgttgttcaatgcaatccagaactttgatcctggaaatatcagcagtgccaaattactgaacttcattggcagtttcctttatctgttcggctccagcaccattcttggagtagcttctggacttcttagtgcttataccattaagaagttgtacttcggcaggcattcaaccgatcgtgaagtttccattatgatgctaatggcttatttatcttacatgctagctgaattgctcgatttgagtggcattctcactgtgtttttctgcggtatcgtaatgtcacactatacttggcacaatgtaacagaaagttcgagggtcacaaccaagcatgcctttgcaacattgtcgtttatctccgagacttttctgtttctttatgttggtatggatgcattggatatagagaagtggaagattgtcggtcaaacttatagcccggtaaagtctatcgctttgagcagcaccattttagccttggtgctggtttcaagagctgcttttgttttcccactatcctttgtatcaaatttgaccaaaaaaaactccaaatggaaagatatcttttaggcagcaggttattgtttggtgggcgggtctcatgagaggtgctgtgtctattgcgttggcttacaataagttcacaagatcaggccatactcaacaacctagcaatgctatcatgatcacaagcacaatcagcgttgttcttttcagcacaattgtctttgggctgctgacgaagccactgatcaggctcttgatcccgtcaaggcacctatccagggaaccaagcgccctttctgaaccttccagcccgaagtctttctttgagcagctggccgccaacagccctggacacccggatcttgagaatggcataagcctacgacgcccggcgagcctccgttttctcctagtaagcccggcacggtccgtccaccattactggcgcaagttcgatgacagtttcatgcggccggtgtttggtggccgtggcttcgttcccttcgtccctggttcacccactgagagcagcttgccattgcttcctggcaatgagaactgaaaccagcgtatcgaggggctttaattcagcagaagttttgtaaattggcttcgcttatggttataatattttgtgtaaatctaggtttgtagattcaacttggtagcatgtacatgttgatgtaggctagttaactgaccagcgaccaaacggctgtgcatattgatatctcgtcgctctcaatgagtttgtatttataaaatactctgtacatcggatcactatatatgtatcgtctccaacttaataaatactcatccgttctaaaaaaaaaaaaaaaaaaacggccaaaaaaaaaaaaaaaaaaaaacgaaaaaaaggaccagatcgcgagcggcggcgccgatcttttagttctttggtcacactaaagtggtcgcattcaaggcaatctgtacattacaatacacgtgaccatcacacgtaaaggtccaactaatacctcagcgacattcttatggctgggagtacaatacatagtgcttggcgtgggtcgtgatttcgactatatcactatacatataaccatctatcatgtgattatggccctgtttggcacagcttattttcagcttcttcacaaatttaagctgaagtcctgccaaacagtcagcttctgcagcagcttatcagttcagctgcttctcaaaatgcactaaaagcagccaacaagcagaagctgcttttcaccagcttatcagataagctgctttttcaacaagcagcagttgtgccaaacagggcctatatacaatcttataataagtattatataccttctcgaatatttatcgttcgcttgtttataaatggaggagtcaaatatatatgccatgcacgagcacgcttgtcttggatgacgtaacagcatcatgcgtactgtatgctgtgcgatggttacgttggtggacgcgatcggcgctctagacggggtaggacggcagcttggcgagaccgcagnnnnnnnnnnngcacgagtattgccggatccggacgtatccnnnnnnnnnnnnnnnnnnnnnnnnnnngttcttcatcagccagtaccttgtgccgtcgttcgccgtgccgtacccgacggccgtgatggcgtggttgaggtccgnnnnnnnnnnnnnnnnnnnnnnnnnnnngtcgtagaagcggaacgccgggtcctcgccgttgatggccacggacacgggctggttggccannnnnnnnnngagcgcggcctcgttgttgcgcggcacgtcctcgtggccccggatggacgcggcccgcgcggcggcggcggacgagcggcagggcccgtcccggccctggtacgggtagcccgactccgaggccagcccgccgcggcgcgcgacgaactggaaggcgttgtccatgaggccgccgtcgcagccctggtccacgccgctgacgtcacagtccaccagctcctgctccgacagcgacaccagccgccccgtccggatcttgttcagcccttccaccgccgccaccgccgagaacgcccagcagcagccgcacgctccccgtgtgtgttgtgcatggtggctatgttggattaattgcgtagaaatactgggaaccttttaacttaattgg

SEQ ID NO: 2158 - DNA, 385 bp, Zea mays
  Clone ID: PAT_MRT4577_49279C.1
tgccggacactcaggaatgttctactacatgctcaggggcttatttcatctttgcatctgtatacgctgtcttagttcaagtaacatggcattgcgtggggatatttttggcttcatcatcaactattctctacatcatgattctaatgtcccggaaatgtttaagccatatgccccagtacttgatgctaaataaggttttcagacattcatggaacaacattcatcttcgcagctgtcaaattctctactggccaattgtcttccaagatgcatccttaagctccactgtgaatgttgaatatgcacacaaagctgcaattcggaagcatgctttgtggtcaagtatcattgtggatctcctgatgggttttgtccttggagc

SEQ ID NO: 2159 - DNA, 374 bp, Zea mays
  Clone ID: PAT_MRT4577_49351C.1
gtgggtcggcttctcctccccctccggctcggtttcggattcgcgaggttcttcggggctcggtttccttaatgagcggatcgagatgcccgcataggatgttgagtaccgctgcttcatcggcggtctcgcctgggccacggacgaccactacatccacaacgccttcagcacctacggcgaggacctcgagtccaagatcatcctcgatcgggagacgcataggtccagcgggttcggctatgtcaccttctccacggaggaggcgatgcggaacgccatcgagggcatgaaccgcaaggagctggacggccgcaacatcaccagcaacgaggcccagtcccaatgctgccgtagaagcagtggaagaggcg

SEQ ID NO: 2160 - DNA, 624 bp, Zea mays
  Clone ID: PAT_MRT4577_49427C.1
atggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgtgcgtgccgtttcctactccctggctatcaaaaatcctggagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgaggaggcacttgataatggactgacgaacctgaatgagaaactgactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattag

SEQ ID NO: 2161 - DNA, 1459 bp, Zea mays
  Clone ID: PAT_MRT4577_49429C.1
ccggcccgggaaaaaaaaaaaaaaaaaaaaaaaaaaaaaaaaaaaaaaaaaacccaactacaccacaccgaaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgaggaggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccactcgccgaggatttcacccagccaccaccgctggcttgtatgccctcgtgcgctggcaactgtatctttatctttccggtatgtttggatgaacgtataatgtgtgtcagtgtcggtcgcatgacgtgccgatgtcgtgcatctctctctctctctgccagagcagcggaactctgcaccgtgagtaacttaattggtaccgtatgatctgccggacagtgaatagtttatgtgagtgggacaaaccataatgtgtaatatttgtgtccaactgtcaatggcacgcatttggattttcactacacgttacatatgaagggatatacatccatttgtcgccgcaaaaaaaaaaaaaaaaaatttgcggccggcttgtatgccctcgtgcgctggcaactgtatctttatctttccggtatgtttggatgaacgtataatgtgtgtcagtgtcggtcgcatcacgtgccgatgtcgtgcatctctctctctgccagagcagcggaactctgccccgtgagtaacttaattggtaccgtatgatctgccggacagtgaatagtttatgtgagtgggcccccaaaaaaaaaaaaaaaaaaaaaaaaaaaaaaagtactctgcgttgttaccactgct

SEQ ID NO: 2162 - DNA, 234 bp, Zea mays
  Clone ID: PAT_MRT4577_49460C.1
attgcagcaccaagaagctccattttttccttaagattaacttagaacaaatcctgacaggagtaacatcatccattgatccacagttcatgctggttgatgcatgggtctgctggagcctaggatgaacacagtactaacaactgacacatatcgaccttgcaattataaacacagatggtcaacaacaaactatactaactaagataaactccttggactagggttaacatt

SEQ ID NO: 2163 - DNA, 2050 bp, Zea mays
  Clone ID: PAT_MRT4577_49736C.1
tgtgaggtgccggtgctcgcagatggcgacctcacgctcttcggtaagttgagttcatcatcatccatcgtcggcccgtgcccgtctattataattcggtttttgctctacaaattatatatatcctctcgattataaaatttacccttttgattctacgggttcttcatcttctaagcgcgtgatatgtaatgcaacatcctccggctcgagctccgccgcgcactagcgggagcgcggagtagcgaggaaagcagtgaggacgtccgcacactcgcacaattccagctgctgatcttgatcctgcaccccgagccgtacacaagagctagtgggtagaacttgcgggagcggagcagaactaagtgcagagaacaggacatatggctacgccggcggggaaggtttacgggggggctatctcgccgttcgtatcgcgcgctctgctgcgcctgggggggggctgcctccacggccggccccaccagatgaagcgccagctctaacgtcacctctgatttctctctcctctctattgctagctgctttattataagtagcagctgcagccgggcggggcgggacacacccatccaattccagctgctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagcagacggcgatggtggacgtgtggctggaggtggaggcccaccagctgagcccgccggcgatcgccatcgtggtggagtgcgtgttcgcgccgttcctgggccgcgagcgcaaccaggcggtggtggacgagaacgtggagaagctcaagaaggtgctggaggtgtacgaggcgcggctggccacgtgcacgtacctcgccggcgacttcctcagcctcgccgacctcagccccttcaccatcatgcactgcctcatggccaccgagtacgccgctctcgtccatgcgctcccgcacgtcagcgcctggtggcagggcctcgccgcgcgcccggcggccaacaaggtggcgcagttcatgccggtcggcgccggagcgcccaaggaacaggagtgacgatgaagcgatcgaagcgacttgtgttgttgtgcttgattagttaattggaaaccttctcactcatctagtccatcatggtgcctgcttttctttatactatttgtcttaattttgctgctttctccacggaataatagtagagatttggaaatgtaatgtattttatcaaaatatattggattttcaagcaatatagtatggttttcgctgcaaaaaaaaaaaaaaaaaaaaaaaaaaaaaaaaaaaaaaaaaaaaaaaaaaaactcagactagttctcctcgtgcaccctacccaaacactcacgaccaagcgctcccgcacgacagcgcctggcagggcctcgccgcgcgcccggcggccaacaaggtggcgcagttcatgccggtcggcgccggagcgcccaaggaacaggagtgacgatgaagcgatcgaagcgacttgtgttgttgtgcttgattagttaattggaaaccttctcactcatctagtccatcatggtgcctgcttttctttatactatttgtcttaattttgctgctttctccacggaataatagtagagatttggaaatgtaatgtattttatcaaaatatattggattttcaagcaaaaaaaaaaaaaaaaaaaaaaacccacgcgaccgcggacgctgggcgacccgggagtttcggtccg

SEQ ID NO: 2164 - DNA, 1778 bp, Zea mays
  Clone ID: PAT_MRT4577_49800C.1
ccggccgggaactcactgcatatctgacatctcagttgctgaacgcctgaaccgcaagtcatccatgacctcttctattccgaagctgcttctcctcctcttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgccgacgttggaggagacgctccaccgcgatcagctccgagctgcctacatccagcggaagttctcaggcggcggtggcgctggtggtgacgtccagcgatcggacgccaccgtgccgacggccctgggcacctccctgaacacgctggagtacctgatcaccgtaggcctgggctcgccggccacgtcccagaccatgctcatcgacaccggcagcgacgtgtcgtgggtgcagtgcaagccgtgctcgcagtgccactcccaggcggacccactcttcgaccccagctcgtcgagcacgtactccccgttctcctgcggctccgccgactgcgcgcagctcggccaggaaggcaacggctgctcctccagctcccagtgccagtacattgtcacgtacggcgacggctccagcaccacggggacctacagctccgacacgctcgccctgggctccagcgccgtcaggagcttccagttcgggtgcagcaacgtggagtcgggcttcaacgaccagaccgacgggctcatggggctcggcggcggcgcgcagtcgctggtgtcacagacggcggggacgctcggcagggccttctcgtactgcctcccgccgacgccgagctcctccgggttcctcacgctcggcgctgctggcggtagcggaacctcgggcttcgtcaagacgccgatgctcaggagcagccaggtccccacgttctacggcgtgcgcctccaggccatccgggtgggcgggaggcagctcagcatacccgcctcggtcttctccgctgggacggtcatggactcgggcacggtcatcacgcggctgccgccgaccgcctactcggcgctgtcgtcggcgttcaaggccgggatgaagcagtacccgccggcgcagccgagcggcatcctcgacacctgctttgacttcagcggccagtccagcgtcagcataccgtccgtcgcgctagtcttctccgggggcgccgttgtcagcctcgacgccagcggcatcatcctcagcaactgcctcgccttcgcgggcaacagcgacgacagctccttgggcatcatcggcaacgtgcagcagcggacgttcgaggtgctgtacgacgttggccggggcgtcgtggggttcagggctggggcgtgctgatcgatcgtgatcggcgcaaggacattgacaataccggccgggagtacgtactgtgctcgtttgggttgcgagtgcaacgtaaatggaagaagtgcaaaacatatacatactacttcgattttaattatctttgcgatagcatgcaataacgtcatgcatgcaagtgtgcaaactactaaaagctaaaagataatcttaatgtcacctgattgatgactataaaagattaatgatatattattgtattgcgcttggtgcgatgattaattatggtgtatacagccttttgggcgagctaatgttccttatatattactcactccgtctc

SEQ ID NO: 2165 - DNA, 2353 bp, Zea mays
  Clone ID: PAT_MRT4577_4996C.1
gaacgacctgtccggcgggatccccgcgcagctcgcgcggtgcgccaacctgacgctgctcaacctggcgtacaaccgcctcgccggcgaggtgccggatgttctcggcgagctcaggagcctgcaggagctcatcgtttccggcaacggcctcggcggcgagttcccgagatcgatcctgcggtgccggaacctcagcaagctggacctgagctacaacgctttccgtggagacttgccggagaacatctgcaacgggtcacggctgcagttccttgtgctcgaccacaacgagttctccggaggcatcccagcagggattgggggctgtacccggctgcttgagctgcagctcggtagcaacaacctcagcggcgaaatcccagccgagataggcaaggtgaagagcctgcagatcgcgctgaaccttagctccaaccacttcaccgggccgctgccccgcgagctcgggcggctcgataagctcgtcgtgttggacttgtcgcgcaacgagatatccggccagatcccaggcgacatgagagggatgcttagcttgatcgaggtcaatctgtcgaacaaccggctcgcgggcgccataccggtgttcggaccgttccagaagagcgcggcctccagcttctccggcaatgccgagctgtgcggcgacccgctgaccgtagactgtggatcatcaatctatggctccagctatggaacggagacggaccacaggggaatatcttacagggtggccttggcagtcgtcggttcctgcgtgctcatcttctcgctggtgtcgttgctggtggcgttgttcatgtggcgcgagaggcaggagaaggaggaggaggaggcgaagaagaaggcggcggaggtggcggtggcggcagcagccccacaggtggtggcctcggccgtgttcgtcgagagcctgcagcaggccatcgatttccagagctgcgtgaaggcgacgttcaaagacgagaacgaggtgggcgacgggacgttcagcaccacctacagagccgtcatgccctccggcacggtggtgtcggtgaagaagctcaagtccgtggaccgcgcggtcgtccagcagcggacgaaggtggtccgcgagctggagcgcctcgcccacatcggccacgagaacctggtccggcccatcgggtacgtcctctacgacgacgtcgcgctgctgctgcaccagcacctggcgaacggcaccctgctccagctgctgcacgacaacggcgagaggcggaaggctgactggcccaggctgctgtccatcgccgtcgacgtcgcccaggggctggcgttcctccaccaggtggccaccgtccacctcgacgtctgctcggggaacgtgttcctcgactcgcgctacaacgcgctgctcggcgaggtcgagatctccaggctgctggacccgacgaagggcacggccagcatcagcgcggtcgccggctcgttcggctacattcctccagagtatgcgtacacgatgcgggtgacggtgccgggcaacgtgtacagcttcggggtggtgctgctggagatcctgacgtcgaagctgcccgccgtggacgaggcgttcggcgagggcgtggacctcgtgaagtgggtgcacgcggcgccggcgaggggcgagacgccggagcagatcatggacccgcggctgagcgccgtgtcgttcgcgtggcgccggcagatgctggccgtgctcagggtcgccatgctgtgcacggagcgcgcccccgcgaagcggccccggatgaagaaggtggtggaaatgctgcaggaggccagggacagctgagtggtctggttcctctgctcaatgatgtgtggttggctgcttggaacttggaacttggaagtcgaggcgagaaactctgaactgatcatcgttggagttcgagtatggagtccatccggtagcgtttgattctctgtatatattcggtaattagtatcccgatcatgcgccatggatcactggatgttcggtcttggagcaatgtctggaactctggatgcgtctttagcaaagcaattcggtgttctgcattgagggttttattttcatttgtttttgtttttgtttttttttttgaaaaaaaaaggagagagaagagaaattctatcccgatgtcgtccgctagaggaggtggttgtctgggtgctatttcttctctctaggagagcctggcccatggcgacgtggcagggatggcctctgtctgctgaggaagaggaatcgtgcctgtctgttaatacatgtatatagtatttttcttatttggtagaagaatatctgtggcacaaaaaaaaaaaaaaaaaagcggcc

SEQ ID NO: 2166 - DNA, 1444 bp, Zea mays
  Clone ID: PAT_MRT4577_49992C.1
cattgggtacctcgaggccggccgggactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggcaatgggaccgccctggtgctcttcctctccccggtgcctacgttcatccgcatctggaagaaggggtcggtggagcagtactcgccgatcccgtacgtggcgacgctgctgaactgcatgatgtgggtgttgtacgggctgccgctggtgcacccgcacagcatgctggtgatcaccatcaacggcaccggcatgctcatccagctgacctacgtggcgctcttcctcgtctactccgcgggggcggcgcgccgcaaggtgtccctcctgctggccgccgaggtcgccttcgtcggcgccgtcgccgcgctggtgctcgccctggcgcacacccacgagcgcaggtccatggtggtcggcatcctctgcgtcctcttcggcaccggcatgtacgccgcgccgctctccgtcatgaaaatggtgatccagacgaagagcgtggagtacatgccgctgttcctgtcactggcttccctggtgaacggcatctgctggaccgcctacgcgctcatccgcttcgacctctacatcaccatccccaacgggctgggcgtgctgttcgcgctggcgcagctggtcctgtacgccatctactacaagtccacccaggagatcatcgaggcgcgcaagcgcaaggccgaccagatcgccatgaccggggtggtcgtcgacggcggcaagaccaacaaccaagccggcgcgggccaatatgctcaagcaagaagccagcggcaaatcaattatgtcgccgctgggttttatgtattttgtgattctatatgcacgctagctgcttgtccgtcccggccaatggaaaaaaaagggggaagaaaaaatgtctgtcggtatatgtgttctcgccgaataactctcgcgcatagctggtggggctgagtcactgccttcgctatatgtatacgtgcaaaaattagaggtggagggttgttttagctaatccccccttaattccaaggcagagtgacctttttttccttctgtttcggctaggattttgctataattgagcaatttagcgcgacttgttattggggttggtgtgtctcaatcaaatagtaaaatgttcattttactctttccaaaaaaaaaaaaaaaaaaaaaaaaaaaaaaaaaaaaaaaaaaaaaaaaaaaaaaaagggcggcc

SEQ ID NO: 2167 - DNA, 1678 bp, Zea mays
  UNSURE (1)..(1678): unsure at all n locations
  Clone ID: PAT_MRT4577_49995C.1
  unsure (1)..(1678): unsure at all n locations
gttgcccaaaggaaaggacgggctatatatattatatactcacttttgggtttcttttctggtatgggtgtctcgcaggcaatgggaccgccctggtgctcttcctctccccggtgcctacgttcatccgcatctggaagaaggggtcggtggagcagtactcgccgatcccgtacgtggcgacgctgctgaactgcatgatgtgggtgttgtacgggctgccgctggtgcacccgcacagcatgctggtgatcaccatcaacggcaccggcatgctcatccagctgacctacgtggcgctcttcctcgtctactccgcggnggcggcgcgccgcaaggtgtccctcctgctggccgccgaggtcgccttcgtcggcgccgtcgccgcgctggtgctcgccctggcgcacacccacgagcgcaggtccatggntggtcggcatcctctgcgtcctcttcggcaccggcatgtacgccgcgccgctctccgtcatggtaagtactgtagtatatgtatgcctttgttcctacatgtacgccgcgcctaatgcccttcttttaatttgttaccctcgtatgatgcgtgcgtgcgtggatcagggaggatgtacgtactaaccgaaggacgtattatacaacgtacgtacgtacgtacgaacatgcaggcctacgttcatccgcatctggaagaaggggtcggtggagcagtactcgccgatcccgtacgtggcgacgctgctgaactgcatgatgtgggtgttgtacgggctgccgctggtgcacccgcacagcatgctggtgatcaccatcaacggcaccggcatgctcatccagctgacctacgtggcgctcttcctcgtctactccgcgggggcggcgcgccgcaaggtgtccctcctgctggccgccgaggtcgccttcgtcggcgccgtcgccgcgctggtgctcgccctggcgcacacccacgagcgcaggtccatggtggtcggcatcctctgcgtcctcttcggcaccggcatgtacgccgcgccgctctccgtcatgaaaatggtgatccagacgaagagcgtggagtacatgccgctgttcctgtcactggcttccctggtgaacggcatctgctggaccgcctacgcgctcatccgcttcgacctctacatcaccatccccaacgggctgggcgtgctgttcgcgctggcgcagctggtcctgtacgccatctactacaagaacacccagaagatcgtggaggcacgcaagcgcaaggcgggccaggtcgccatgacggaggtggtcgtcgacggcagcagggcctccaacaacaacaacggtggcagcggcacctactgatgatgatgagtacgacgacgtaatatggtggtgaccacgccaacacaacaccaagcaacacgggggggcaacgccaacgccgtgcgtatctagcactagcaagcgtccttcttcctgacgaagggatgatctatgcatcttaagcagccgtcgtcttcttcttcttcttctgttaatcactagcttttactttctccatgcttcctagtaacgaagctttgcccactgattagtacttatatgttgaatcataatattacgacttcggcagcccaaacacttctcttaatccatttaatcaatagaccttagccaagtcaacttaatc

SEQ ID NO: 2168 - DNA, 2010 bp, Zea mays
  UNSURE (1)..(2010): unsure at all n locations
  Clone ID: PAT_MRT4577_49998C.1
  unsure (1)..(2010): unsure at all n locations
actcacaaagaagccggggacggagagcggagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctactcagggccattgggtccctcgaggccggccgggagcactcaccaagaaccagagaggagcttcatcagctcattcaattctcgttccatccctcgtctcttgtgtcccgcctccgttccataattcaccagcgtcgtcctacccatatctcccatcgtcttctccctcgcgccatcagcttccccaagccagcggcgaccatgatctccccggacaccatccgcacggccatcggcgtcatcggcaatggaactgcactcgtgctcttcctctccccagtgcctacgttcatccgcatctggaagaaagggtcggtggagcagtactcgccgatcccgtacgtggcgacgctgctgaactgcatgatgtgggtgctgtacgggctgccggcggtgcacccgcacagcatgctggtgatcaccatcaacggcaccggcatggcgatccagctgacctacgtggcgctcttcctcctctactccgcgggggctgcgcggcgcaaggtggtcctgctgctggccgccgaggtgggcttcgtcggcgccgtcgccgcgctggtgctcagcctggcgcacacgcacgagcgcaggtccatggtggtcggcatcctctgcgtcctcttcggcaccggcatgtacgccgccccgctctccgtcatgaaaatggtgatccagacaaagagcgtggagtacatgcccctgttcctgtcgctggcttccctcgtgaatggcatctgctggactgcttacgcgctcatccgcttcgacctctacattactatccccaacgggctgggcgtgctgttcgcggtggcgcagctggtgctgtacgccatctactacaagtccacccaggagatcatcgaggcgcgcaagcgcaaggccgaccagatcgccatgaccggggtggtcgtcgacggcggcaagaccaacaaccaagccggcgcgggccaatactgaccgacgatcaagtgacgatcgacaccaatatgctcaagcaagaagccagcggcaaatcaattatgtcgccgctgggttttatgtattttgtgattctatatgcacgctagctgcttgtccgtcccggccaatggaaaaaaaagggggaagaaaaaatgtctgtcggtatatgtgttctcgccgaataactctcgcgcatagctagctggtggggctgagtcactgccttcgctatatgtatacgtgcaaaaattagaggtggagggttgttttagctaatcccaccttaattccaaggcacagtgacctttttttttctccttctgtttcggctaggattttgctataattgagcaatttagcgcgacttgttattggtgttggtgtgtctcaatcaaatagtaaaatgttcattttactctttcaaaaaaaaaaaaaaaaaaagcttcttcttcttcttctgttaatcactagcttttactttctccatgcttcctagaacgaagttgcccactattagtacttatatgttgaatcatagcggcacctactgatgatgatgagtacgacgacgtaatatggtggtgaccacgccaacacaacaccaagcaacacgggggggcaacgccaacgccgtgcgtatctagcactagcaagcgtctttcttcctgacgaagggatgatctatgcatcttaagcagccgtcgtcgtcttcttcttcttctgttaatcactagcttttactttctccatgcttcctagtaacgaagctttgcccactgattagtacttatatgttgaatcataatattacgacttcggccgnnnnnngnnngnnnnnngnanncaagg

SEQ ID NO: 2169 - DNA, 1830 bp, Zea mays
  Clone ID: PAT_MRT4577_50069C.1
cattgggtacctcgaggccggccggggcatttagttcttacgacgcgcccaaagctcacgccggacctgctcctctccgacggcggaatcggcttcgtgctccgctactttcccaaggcgttcaagccccgcccccgcccaggccacgaggtggacgacctcgccaacctcatcaagctctacgcggactgggactcccgcctgattccctactactccttcgaacagttcgtgcgcaaactcgagaaattgggtgccggcaaccgcgtcaggagatgtgtttccgttctggtgcgttcttgatcgccagaggcgaggatcctagggttctgcggacgcctggggtccaacagcggcacagcccacgggccacgcccagttgatatccctgatggcctgatgtcgcaactcgcaaccctagctcccagcctcccactcccacgcgcttcaagtcttcccaggcggccggcggcgtactcccagagtcccagacggccaatcttcccagcatcgggtggcgtcctcactccaggcggcaggcggctgcaccgccgcagtcacgaactcacgcgcaccgcgggcccgcggcagcgcgcacacgcgcacacgcgcacggcgcaccagcagccgtgagccggccagtccggcagtcccagcctcccaggcggccagtcctcccagtcccagtcccagctgcctaggtctgccgcctgtcttgaccccacccactggccacttcccctcctgtccgttcccaaatcccgtcccctccacccgcactccattggcgccgctcccctcccctcgccgccgccggagatctgatccgatccgtttgtgcttgtgctggacgatggtgggcctctctgaaggggagaaacacttcatccgcggcggcattgcacaagaccttcgcactgatggacgtaggcggctgcagttccggtccctctccgtccaaaccggagtcattccacaggcgaatggctcagcgcgtgttaggttgggggccactgaaataatcgctagtgtcaaggctgaactaggaaaaccaagcattcttcaccctgacaaaggaaaagttgctatttttgtcgactgtagtccaaccgctgagcctctgtttgagggtagaggctctgaagaattgtctgctgagctctctgtttccctgcaaagatgcttgttgggtggtaaaagcggtgctggtgctgcaattgatctgtcatccctaattgttgttgatggaaaggtctgctgggatctgtacattgatgggcttgtggtcagttctgatggtaatttgctagatgcgctagctgttgcgataaaggttgctttgagtgatacaggtataccaaaagttaatgtttctgttagtgctgcatctgatgaggaacctgaagttgatgtaagtgatgaggaatttctgcagttcgacacatccggtgtgcctgttattattacattaaccaaggtgggtcggcactacatcgttgatgccacctcagaggaagaatcccagatgagttctgcagtgtcggtgtcagtcaacaggcatggccagatatgcgggcttaccaagaggggaggggcagggctggatccaagcgtcatcttcgacatgatatctgtcgccaagcatgtgagccagcagttcatctccctcttggattcagagattgccgccgccgaagctgaagaagaggctcagtgattgatgaaaaggaaaaaggactggttgcgtaaatgctcgtgtgttccaacttcaaccaaatgctgtagaaatcttcaggaacactctatatttacaaagtcattttgctctct

SEQ ID NO: 2170 - DNA, 1635 bp, Zea mays
  Clone ID: PAT_MRT4577_50070C.1
ggagtctgttggagttggtctaattggctccctcgaggccggcggggaggatttaggtcttacgacgcgcccaaagctcacgccggacctgctcctctccgacggcggcatcggcttcgtgctccgctactttcccaaggcgttcaagccccgcccccgcccaggccacgaggtggacgacctcgccaacctcatcaagctctacgcggactggcactcccgcctgatcccctactactccttcgaacagttcgtgcgcaaactcgagaaattgggtgccggcaaccgcgtcagggacgatggtgggcctctctgaaggggagaaacacttcatccgcggcggcattgcacaagaccttcgcactgatggacgtaggcggctgcagttccggtccctctccgtccaaaccggagtcattccacaggcgaatggctcagcgcgtgttaggttgggggccactgatataatcgctagtgtcaaggctgaactaggaaaaccaagcattcttcaccctgacaaaggaaaagttgccatttttgtcgactgtagtccaaccgctgagcctctgtttgagggtagaggctctgaagaattgtctgctgagctctctgtttccctgcaaagatgcttgttgggtggtaaaagtggtgctggtgctgcaattgatctgtcatccctaattgttgttgatggaaaggtctgctgggatctgtacattgatgggcttgtggtcagttctgatggtaatttgctagatgcgctagctgttgcgataaaggttgctttgagtgatacaggtataccaaaagttaatgtttctgttagtgctgcatctgatgaggaacctgaagttgatgtaagtgatgaggaatttctgcagtttgacacatccggtgtgcctgttattattacattaaccaaggtgggtcggcactacatcgttgatgccacctcagaggaagaatcccagatgagttctgcagtgtcggtgtcagtcaacaggcatggccagatatgcgggcttaccaagaggggaggggcagggctggatccaagcgtcatcttcgacatgatatctgtcgccaagcatgtgagccagcagttcatctccctcttggattcagagattgccgccgccgaagctgaagaagaggctcagtgattgatgaaaaggaaaaaggactggttgcgtaaatgctcgtgtgttccaacttcaaccaaatgctgtagaaatcttcaggaatttggttccatttttatgttattattagtagtagtaaacaccgaggatttggatcctgggaacgaacgacgtcgtgttggctttggctgggctcagaggaacgaatactgaatcttgggtctgatgatctgatcctcttgtgcccccaatccgatgataaatttggcccctctcacaccaaaccaaacactatggatttcctccgtccgttttcaaacaattaagcacgcaaaaaaaaaaaaagttgccccatgtcggtgtcagtcaacaggcatggccagatatgcgggcttaccaaaaggggaggggcatggcttgatccaaacgtcatcttcgacatgatatctgtcgccaagcatgtgagccagcaattcatctccctcttggattc

SEQ ID NO: 2171 - DNA, 647 bp, Zea mays
  Clone ID: PAT_MRT4577_50147C.1
ttatactaatcttgttttttgaaaactgcatcaacaacaagctggaagcaagaaagaaagaaagaaaaaggcaaaataatggaagcaagaaccaaccaataacagtcacgcaattcaagaagcagcaagcaagctagaagcagaagatgcctccccaatctcaaggggtgaggggaaaaaaactaaaagaagcagaaaaaaactagtgtagtgtagtgtagctcatcagcgcccaagcaagatctggagccacgtgactacatacgcagagcagaccagatcagagcatcctgttgaggagcagagcagcggcggcggcggcagccatgggcgtggcagcgaggagtgacggtggcggcgcggcgctggtcttggccttggacttcttggcgggcggcgagggggaggaagtgtcgtcgtcagaggaggaggaggagtcagatccggacgaggaagaggaggatgactttgctgtgacgtggagcttcatgccgttgtagcagtagccgtagctgcagatgaagtagtagtccttggcgtccttgagctggaaggcgtaggtgtgtcccttgctgtagctgctcagcgcgttggccttgtcgcagttgtcgtagccgacctcgtccacctgcaccacgtccgaccgc

SEQ ID NO: 2172 - DNA, 839 bp, Zea mays
  Clone ID: PAT_MRT4577_50148C.1
acggcggcccgtttggggtgtttttagataataaatagagctcttcattcacacttgacattatactaatcttgtctcttgaaaaaaaaactgcatcaacaacaagctggaagcaagaaagaaagaaagaaaaaaaagggcaaaataatggaagcaagaaccaaccaataacagtcacgcaattcaagaagcagcaagcaagcatgctagaagcagaagaggcctccccaatctcaaggggtgagggggaaaaaagctaaaagaagcagaaaaaaaactagtgtagtgtagtgtagctcatcagcgcccaagcaagatctggagccacgtgactacatacgcagagcaaagcagaccagatcagatcagagcatcctgttgaggagcagagcggcggcggcggcggcagccatgggcgtggcagcgaggagtgacggtggcggcgcggcgctggtcttggccttggacttcttggcgggcggcgagggggaggaagagtcgtcgtcagaggaggaggaggagtcagatccggacggcgacgacgaggaggaggaggaggatgaggatgacgactttgctgtgacgtggagcttcatgccgttgtagcagtagccgtagctgcagatgaagtagtagtccttggcgtccttgagctggaaggcgtaggtgtgtcccttgctgtagctgctcagcgcgttggccttgtcgcagttgtcgtagccgacctcgtccacctgcaccacgtccgaccgcccgttctggtactcgaagatgagccagtctcccttgtagaacggcttgtgcttcttcacccacgccgtgtagtccacgtccaggtt

SEQ ID NO: 2173 - DNA, 1304 bp, Zea mays
  UNSURE (1)..(1304): unsure at all n locations
  Clone ID: PAT_MRT4577_50149C.1
  unsure (1)..(1304): unsure at all n locations
cgataataataaatagagctcttcattcacacttgacattatactaatcttgtctcttgaaaaaaaaaaactgcatcaacaacaagctggaagcaagaaagaaagaaaaaaagaaaaggcaaaataatggaagcaagaaccaaccaataacagtcacgcaattcaagaagcagcaagcaagcaagctagaagcagaagaggcctccccaatctcaaggggtgaggggggaaaaaaactaaaagaagcagaaaaaactagtgtagtgtagtgtagctcatcagcgcccaagcaagatctggagccacgtgactacatacgcagtaacgcagaccagatcagatcagagcatcctgttgaggagcagagcggcggcggcggcggcggtagccatgggcgtggcagcgaggactgacggtggcggcgcggcgctggtcttggccttggacttcttggcgggcggcgagggggaggaagagtcgtcgtcatcgttgtcagaggaggaggaggaggagtcagatccggacggcgacgaggaagaggaggatgaggatgactttgctgtgacgtggagcttcatgccgttgtagcagttgtcgtagctgcagatgaagtagtagtccttggcgtccttgagctggaaggcgtaggtgtggcccttgctgtagctgctcagcgcgttggccttgtcgcagttgtcgtagccgacctcgtccacctgcaccacgtccgaccgcccgttctggtactcgaagatgagccagtctcccttgtagaacggcttgtgcttcttcacccacgccgtgtagtccacgtccgggttccaccccttctcgtcgcccaccgtgtagttggccgccacgagccgccgccggcagctgccgacgccgccaccaaggcggccagcaggagggccagcgccagccgcgacgtcgccgccattcctctgaccccggcctcttgctgatcgacagagacggatgagcttgcagctagctggagcctggacctggaggaagaggtctgagctagtaattggagtggggtattggtggtggtggcctgggtctggtgagtggggacgaaccgacggacagcagtgcagacaagtcacgacgagctaaaagctggtgacctctctctctgcttgcttgcttgcttgtatattgccaagaaccctccataagcagaggcagtcaggaggagactggcgtgtgcagtaattattcatgcatgatttggcacaatcagtcaattgagccccngntnaaaatatatagattttactataatggtaacttaattg

SEQ ID NO: 2174 - DNA, 349 bp, Zea mays
  Clone ID: PAT_MRT4577_50413C.1
agcaacatagaaagcacaactatgtaccaacaatggcagtcaaaatatttcgcctgcgtatgctccttggactttctgcaagtgctgctacggcgaccattttcccgcactgctcgcaagctcctatagcttactttcattccccgaacctctcaccagcgtggtctttagtatgtgaaaacccacttcttcaaccctacatgatccaacaggcaatctcagctggcatcttaccttaatgaccctaggttctgcaacaatcatcatgcctattacaacagttacatttggcgcatctactggcacaaaacatcatgtcacaacaactacaacaacttgagctagcaaa

SEQ ID NO: 2175 - DNA, 535 bp, Zea mays
  Clone ID: PAT_MRT4577_5049C.1
ttttttttttttttttatacggcaccaaaaggaaaggaggaattactattctagcggcacataatctcatggcaaaagcgatgtcaccaacatagaaggcagaggaaagtactacaacaggacagaggtgtacaagcattatgagacggaggtaataaggagaaatgagggaggggtcttatgcgccaaaaccgtagagtgttcggccctgtcgttttagggcgtatacgacatcgagcgaagtgacggttttccgcttagcatgttcggtatatgtgaccgaatcccggatcacgttctcaaggaagattttcaatactcctcgggtctcttcgtagatcaggccagagatacgtttgacaccacctcgacgagccagtcttcggatagcaggcttggtgataccttgaatgttatcacgaagaatcttgcggtgacgtttggcaccgccctttccgagaccttttcctccgcttttaccacgtccggacatgttgtgcttggggttgagtttgaagggttgggggaagtgggt

SEQ ID NO: 2176 - DNA, 671 bp, Zea mays
  Clone ID: PAT_MRT4577_50571C.1
aaatctccgctccttctcgtcccctctcgctcgcgtgcgcgtgaggtgcgcaatggcggcggcggcggtggcgttgtcgaacggctccggtggcgactccaaggccgagttcgcggaaatatacagcaggctcaaggaggagatgctcgaggaccccgccttcgagttcaccgacgagtcgctccagtggatcgaccgcatgctggattacaatgtcctaggaggaaagtgcaaccgtgggctctctgtcatcgatagctacaagacattgaaaggtgtagatgttttgaggaaggaggagacatttcttgcctgcacccttggttggtgtattgaatggcttcaagcatattttcttgtgcttgatgatatcatggacaactcccagacacgacggggccagccttgctggtttagggtgcctcaggttggccttattgctgtaaacgatgggattatccttcgcaaccatatttcacggatccttcaacgccacttcagaggaaaaccgtattatgttgatctcattgatttgttcaatgaggttgaattcaagacagcttcagggcagttgttggatcttatcactactcacgagggagaaaaggatctcacaaaatataacttgaatgttcaccggcgcattgtgcaatacaagacagcgtactatt

SEQ ID NO: 2177 - DNA, 1464 bp, Zea mays
  Clone ID: PAT_MRT4577_50591C.1
cgttctctccttcctatcggctccacacctccacgcaactggaagcttcgctgcaatctgccctactcctcttccgccgcctccaacaccgcagacgcagctgccgcgggcgggagcttggacgtgctacgctgctctcatctcgtttccgcgcagttcaggaattgttctcaatggcccgcgtgtatgttggcaacttggattcacgggtgacttctggggaactcgaagatgagttccgcgtgtttggagttctgcgaagtgtttggattgcacgtaaaccacctggctttgcatttattgattttgacgacaggagggatgcggaggatgctattcgtgatctagatggtaagaatggatggagagttgaactatctcgtagcaccagtggtcgtggtggtcgtgatcggcatggtggatctgagtcaaagtgctatgagtgtggtgagactgggcactttgcacgtgaatgtcgtctgcgcattggctctggaggtctaggcagtggaagacgtcgcagcaggagcaggagccgcagtcgcagccctagataccgcaggagtccgagctataatagaaggagctatagccctcgttatcgttctccaaggcgccgtactccttcaccggctcgtggacgcagctatagcaggtcgccatagtacaactgtgacaaatatgcatctccctcgttaacggagtaatgatggcagatactggtgtagcaggagcttggcctgaagcccgtgcctgattcttctctgtgtgaggacttggttcttggtttggctgtggggaacaaatttggaactgtcgtcaactgcatgacttcagttcaggcatgttctgcttaaacgactcggccaactacggctctcagttgtagtcttcatggttttgttcctccattcttggcacgtccttatctgcaaacaaatgtcaacgttccattactagctgccttcgatgtttcatcatgaaattcttcaccgaagatgctacttcatcacaaattagtaacatcctttcccctcatatagttgatatggtttgagtgtactgagcactaacaaatgcagctcatgaaaataaggcccttgattttcgtcatagaacaagagcggctattttaattgcagcactcgtgtgaaaataaatctactctgcatgccggggattgaggcgactgaagtgtgagccttcagctgcacgtagttggccatccaaggaacctagtcaggctgatttcagcaagaggcgcagcctacgactgaacttggttttattttttgtggttttgattcttcacttcttccttgtgttctgccttcactgcatcttattggtagtggtcgaataatgcttctgtatgtggtaaatcattcttggtacaatggctctcttttttctgctaaaaaaaaaaaaaaaaaaaactcgagatagttctctctctcctcgtgc

SEQ ID NO: 2178 - DNA, 1076 bp, Zea mays
  Clone ID: PAT_MRT4577_50592C.1
ctcgaggccggccgggacccgcccggtctccagaacagacaacccgtccttctccttcccatcggctccacacaaccagaaggttcttcgcttcactctgccctgcgccgccgccaacgctgcagccgcagttgccgcaggcgggaacttggacgtgctactcgcgactgctctcatctgttcccgcgtaggattcgttcacaatggcccgtgtgtatgtcggcaacttggatgcacgcgtgacttccggggaactcgaagatgagttccgtgtgtttggagttctgcgaagtgtttgggtcgcacgcaaaccacctggttttgcatttattgattttgacgacaggagggatgcagaggatgctattcgtgatctagatggtaagaatggatggaaagttgaactatctcgtagcaccaatggtcgtggcagtcgtgatcggcatggtggatctgagtcaaagtgctatgagtgtggtgagactgggcactttgcacgtgaatgtcgtctgcgcattggctctggaggtctaggcagtggaagacgtcgcagcaggagcaggagccgcagtcgcagccctagataccgcaggagtccgagctataatagaaggagctatagccctcgttatcgttctccaaggcgccgtactccttcaccggctcgtggacgcagctatagcaggtcgccatagtacaactgtgacaaatatgcatctccctcgttaacggagtaatgatggcagatactggtgtagcaggagcttggcctgaagcccgtgcctgattcttctctgtgtgaggacttggttcttggtttggctgtggggaacaaatttggaactgtcgtcaactgcatgacttcagttcaggtttaaaaccttatctagcttattgtgattgtcttgattatgccattaaagaacttttaagatttgtgtattatgccactaagacatattaccttctctgtgttaaaaaggcatgttctgcttaaaaaaaaaaaaaaaaagcggaaaaaaaaaaaaaaaaaaaaaaaaagtactctgcgttgttaccactgcttaagggcgaat

SEQ ID NO: 2179 - DNA, 834 bp, Zea mays
  Clone ID: PAT_MRT4577_50627C.1
ccggatcactcatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttgaattgcatgcaaaaaaaaaaaaaaaaaaaaaaaaaaaaaaaaaaaaaaaaaaaaagtactctgcgttgttaccactgct

SEQ ID NO: 2180 - DNA, 663 bp, Zea mays
  Clone ID: PAT_MRT4577_50630C.1
tcgaggtcgctcgggtcgctgcagcttatcacttatcatccgcgtttgcacctctctccatctccctgctccgccgcctccttcttgatcgagccaagtcagtgatcgccatgtcggactcggaggagcaccacttcgaatcgaagggcgacgacggagcgtccaagacctacccgaaggaggctgccaccgtgcgtaagaacggcttcatcgtcatcaagaaccgcccctgcaaggttgtggaggtttctacctcaaagactggtaagcatggccatgccaaatgccactgtgctgccatagacatattcaacggggaaaagctcgaagatattgctccttcgtcacacttttgtgatattccacatgtgaaccgtactgagtaccagctgattgatatatcagaggatggatttgtgagccttcttacttcagatggcaacgctaaggatgatcttagactcccaactgatgaaactcttgtggtccagatcaggcaagggtttgaaagcgcgaaggatcttgttgtgactgtccagtctgctatgggggaggagcagatctgcgcgctgaaggatgttgcccccaagtaacttccctgccttgtaaatctcagaagctatatcgagaaaagaagtgtatcaaggattgctacagagacgt

SEQ ID NO: 2181 - DNA, 711 bp, Zea mays
  UNSURE (1)..(711): unsure at all n locations
  Clone ID: PAT_MRT4577_50631C.1
  unsure (1)..(711): unsure at all n locations
gtaccctcgggactcgccggggacacttatnatggcataaacgaacctctgtccatatccctgctactcagactgcttcttgagccaaccaagaccagcgatcgccatgacggacggggaggagcaccacctgggcaacgaacgccgacgcgcggaacgtccaacacctaccacaagaaaggtgcgaccgcgcgcaggaacgggtccattgtgatgaagaaccggacctgcaagggtgcggaggcttctacctgaaaaactggtaagcatggccatgccaaatgccactttgttgtcatagacatattcaacgggaaaaagctcgaagatattgttccttcgtcacacaactgtgatattccgcatgtgaaccggactgagtaccagctgattgatatattagaggatggattcgtgagccttcttacttcagatggcaacactaaggatgatcttagactcccaactgatgagactcttgcggcccagatcaaggaagggcatgaaagcggcaaggatcttgttgcgactgtccagtctgctatggaggaggagcagatctgcgcgctgaaggatgttgcccccaagtaacttgcctgacttggaatactgtatctcagaacctaaatcgaataaagtagtgcatcaaggattgctacagagacatccatctggcttgagctggctgttgctatggcacacacaagtgca

SEQ ID NO: 2182 - DNA, 2623 bp, Zea mays
  UNSURE (1)..(2623): unsure at all n locations
  Clone ID: PAT_MRT4577_50635C.1
  unsure (1)..(2623): unsure at all n locations
gagaacaaataaacgtgacatacaaaataatgcgccgaattgaggcagaggagtggtctcttgatgcgtctgaaatagttatcgctagcacaaggcaagaaatagaagaacaatggaacttgtatgatggttttgaagtcatgcttgcgaggaagctccgtgcgttagtcaagcgtggtgctaactgttatggtcgttatatgcctcgtatggttataattcctccaggagttgaattcggccaattgattcatgattttgatatgtatggagatgaagataaccaatctccagcctcggagccatctatttggtttgagataatgcggttcttcacaaatcctaggaaacctatgattttggctattgctcgtccatattctgaaaagaatattgcaacacttgtgaaggcatttggtgaatgccatccgttgagggaacttgctaaccttacactgataatgggcaaccgtgaggctatttccaaaatgaacaaaatcagtgcagctgttttgacatcggtgcttacattgattgatgaatatgatttatatggtcaagtggcatacccaaagcttcacaagcactctgaagttcctgatatttatcgtttagcagcaagaacaaagggcgcttttgtaaatgttgcttattttgaacaatttggtgtcaccttgatagaggctgccatgcacgggttgcctgttattgcaacaaaaaatggggctcctgttgaaatttatcaggttctggaaaatggtctccttgttgatccccatgatcagcatgcaattgcagatgccctctataagatgctttctgaaaagcagttttggtcaagatgtcgagaaaatggattgaaaaatatacaccaattttcttggcctgaacattgcaagaattacttgtcaaggatatcaagtcttggtccaagacatcctgctttcgcatgcaaagaagaccacaaggtgcctgtgaagtgcaggaagcatatatctatcattgctgtagactctgttaacaaggaagatttaattcaaattatcagaaactctgttgaggctacacgcactggaactatgtcaggttctacaggttttgtgctgtcgacttcactgacaatagcagagctacagtctgtaatagtacgcacaggcatgctccctactgactttgatgcctttatatgcaatagtgggagcgatatatattatccattacagtctagtgatgtgccaagcaattcccgtgttacatttgcattggaccataactaccgatcacatattgagtatcgttggggtggagaaggtttaaggaagtacttagttaagtgggcctcttcagtagtagaaagaagggggagaacctgaaaagcaagtcatctttgaagattcggaacactcttcaacatattgtcttgcatttaaagtgattaatccaagtcatttgcctcctttgaaggagctgcaaaaattgatgagaatccagtcactgcgttgtcatgcactgtataaccatggcgccaccaggctatctgtaattccaattcatgcatcgcgatctcaggctctaaggtatttgtctatttgctggggcatagagttgccagatgctgtggtcattgttggtgaaactggtgattctgattacgaggaactgtttggaggtcttcacaagacagtcatccttaagggtggattcaacactcctgccaataggatccatacggttagaaggtaccctttacaggatgttgttgctcttgatagctcaaatatcattgcaattgagggatttagcactggtgacatcaggtctgctatgcaacaacagcttggtatacccacacgatgacaccaagtgcgatctattttgttattaatagaaagaaagaaacagacaatagaaatatacgatacaaatacttagtttccattctatcggaaatgtccgattttgcctgccagtcatttaatgtatgtgtgccagtgtgtggtctctgcatgggttatgaatgacattcccttggatccatgcactggagattttttggattgaagagcttgttaatggatacatccaactgtacagacggaacaaatttgtatcggcgctagcggctcgaggtcgtttaatgtatgtgtgccagtgtgtggtccctgcatgggttatgaatgacattcccttggatccctgcactggaaatttttggagcgaagagcatgtcaatggatacatccagctgtacagaagaaacaaatttgttcaaatgttgatagtgaaaacattttatggaagcattttcagcaacaaagcttccaatatacaaagctcacactttcacatcacttcaaagtggagcttatgattacagagcaaccctctaaaccttttttttccctttctaagaggggtgtcttatatttgtgtaaatactgtgtagcaccaatgcaccatcttgttttcttgtttcctgaattaatatgcgtaagcgtttactctctttctatatgtatgtccaccagcttgttttgtggtgacatcatgaacacgtttatgcatctgctgagtattggttatgaaattatagaagccagcgtggtgctcccaantatgcctt

SEQ ID NO: 2183 - DNA, 642 bp, Zea mays
  UNSURE (1)..(642): unsure at all n locations
  Clone ID: PAT_MRT4577_50641C.1
  unsure (1)..(642): unsure at all n locations
gtcggtcggttctccaagctgatcacttataatccccatccgcacctctctccatctccctgctcctccgccttcttcttgagccaaccaagccaggtgatcgccatgtgtggactcaggaggagcaccacttcgaatcgaaggccgacgccggagcgtccaagacctacccgcagcagggtggcaccggccgtaagaacggcttcatcgtcatcaagaaccgcccctgcaaggttgtggaggttctctacctcaaagactggcaagcatgggcatgacaaatgccactttgtggccgtagatatattccacgggaaatggctcgaagatattgttccttcgtcacacgactgtgatattccgcatgtgaaccgtactgagtatcagctgattgagatatcagaggatggatttgtgagccttcttacttcacatggcgacactatggatgatcttagactcccaactgatgagactcttgtggaccagatcgaggaagggtttgaaagtgtcaaggatcttgctgtgactgtccagtctgctatgaggcaggagcatatctgcgcgctgaaggatgttgtccccaagtaacttcactgccttgncatactgtatctcagaacctacatcgaaaaaagaagt

SEQ ID NO: 2184 - DNA, 1217 bp, Zea mays
  UNSURE (1)..(1217): unsure at all n locations
  Clone ID: PAT_MRT4577_50802C.1
  unsure (1)..(1217): unsure at all n locations
cctcgaggccggccggtaaagatacctactcgacctacaccagcccttttcggccggctactgcccatgggatccgtgagcccctcacaccgcttacttgactcctcccgaacttccacatctctgctctgccttcccagtctcccatccctgaaaacctcacaaaacccctcgctccccaccaccccgccgcgccgccgcctgtaccagctgcgtcaagatgagtcggcaccctgaggtgaagtgggctcagaggatcgacaaggtttacatcactgtacagttacctgacgcaaaggatgctaaggtcaatttggatccagatggtgtcttcacattctctggcagtgctggtacaaacttgtatgaattgaaactagatctgaatgacaaagtaaacgttgaggctagcaaaataagtgtgggtgtcaggtccatattctgtatcgtagaaaaagctgaagccaaatggtggaagaaacttgttcgagatgatcaaagggcacctcactttgtgaaagttgattgggacaaatgggttgatgaagatgatgatggtgctgatatcaacatggatgggatggacttctcgaatttcggtggcatgggtggtatgggtggcatgggtgatatggctggtatgggtggtcttggtggcatgggtggtatgggtggtatgggcggtatgggaatggatgatttcgaagatgagagtgatgaagaagaagtgtcgaaacctcaagctgcggacaatgctgttgaggctgaggagacggagtcagcggaagccaagactgaggcggctcagagcagttgaagatgcttcatgatctaagctagttgtatcctcatgttaattctgctgaatcggaggacaaacctctacgttgtggcactggcaaatcccagtgacttgccctaaaatttacgttctgtctttacatgggcatcctagtgttgtgctcatcacattattgatattgtttctgtgatgcttcctttggtcgacaatcatgtgctggagtttggtttactggattgcttttcttctgtggtttttggctttatacctgtatggaaagctggagccgcaaatggagaaatagggacgacgtgtatttttgttaaaaagcatgcctctgcataaaaaaaaaaaaaannaagtcctctgcgttgttaccactgcttaagggcgagaaccagcacactggcggccg

SEQ ID NO: 2185 - DNA, 591 bp, Zea mays
  Clone ID: PAT_MRT4577_50804C.1
tcgaggtcttgccggaaaaaaaaaactcagaaaacctacaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttttcgaattttggcggcatgggtggtatgggtggcatgggtggtatgggtgatatggctggtgtgggtggtcttggtggcatgggtggaatgggcggtatgggtggtatgggaatggatgat

SEQ ID NO: 2186 - DNA, 1084 bp, Zea mays
  UNSURE (1)..(1084): unsure at all n locations
  Clone ID: PAT_MRT4577_50808C.1
  unsure (1)..(1084): unsure at all n locations
cctgaaaacctcacaaaaccctcgctcgctccccaccacaccgccgcgccgccgcctgtaccagctacgtcaagatgagtcggcaccctgaggtgaagtgggctcagaggatcgacaaggtttacatcactgtacagttacctgacgcaaaggatgctaaggtcaatttggatccagatggtgtcttcacattctctggcagtgctggtacaaacttgtatgaattgaaactagatctgaatgacaaagtaaacgttgaggctagcaaaataagtgtggggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcaacatggatgggatggacttctcgaatttcggtggcatgggcggcatgggtgatatgggtggtcttggtggcatgggtggtatgggtggtcttggtggcatgggcggtatgggaatggatgatttcgaagatgagagtgatgatgaagaagaagtgtcgaaacctcaagctgcggacaaggctgttgaggctgaggagacggagtcagcggaaaccaagactgaggcggctcagagcagttgaagatgcttatgatctaagctagattgtatcctcatgtttaattctgctgaatcggaggacaaaccttacatttgtggtgctggcaagtcccagtggcgtgccatgaaaatttacgttccgtcttttaactgggtatccgagtgtgtgctcagcatattatggatattgtttccgtaatgcttcctttggtcgccaatcatgtgaagagtttgttttntgctatgtactttcttatagtcttgggtactactgaaggaaattaactagggtgacacacaaattgatacatgcacaagacatgatgtcaatatgggtagatttgttttaagtgtttaacattcccaagtttagtggacagtgatgaaccatgatctttgtgaaccacagacaccggcaagagctttgttacttattaatg

SEQ ID NO: 2187 - DNA, 1160 bp, Zea mays
  Clone ID: PAT_MRT4577_50812C.1
cggacgcgtgggcaggcctatcgtacctacgaggctacgaccatatcccagcccatttcgggatcagtcacttcaacggttcgaacttccatatctctcctctgctctcactctcctcccacccactccagaaaacctcacaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgctggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttctcgaattttggcggtatgggtggtatgggtggcatgggtgatatggctggcttgggtggtcttggtggaatgggtggtatgggaatggatgattttgaggatgatagtgatgaagaagaagtatcgaaacctcaagctgccggacatgctgctgaggccgagaagactgagtcggcggaagccaagactgagtcggctcagagcagttgaagatgcttccgacatgatctaaactagttgtatcgtcaagttaattctgctgaatcggtggacaaacttctacgttgtggcactggccgatcccagtgacttgccctaaaatttacgttctgtctttacatgggcatcctagtgttgtgctcatcacattattgatattgtttctgtgatgcttcctttggtcgacaatcatgtgctgggagtttgtttactggattgcttttcttctgtggtttttggctttatacctgtatggaaagctggagccgcaaatggagaaatagggaacgacgtgtatttttgttctttgggggtacttgtgcacatttgtttggttccttaccgtataatactctaaattttaagct

SEQ ID NO: 2188 - DNA, 1160 bp, Zea mays
  Clone ID: PAT_MRT4577_50814C.1
ccacgcgtccgaccgcttacttgactcctcccgaacttccacatctctgctctgccttcccagtctcccatccctgaaaacctcacaaaaccctcgtttgctccccaccaccccgccgcgccgccgcctgtaccagctgcgtcaagatgagtggcattgtcttctgtagtcggcaccctgaggtgaagtgggctcagaggatcgacaaggtttacatcactgtacagttacctgacgcaaaggatgctaaggtcaatttggatccagatggtgtcttcacattctctggcagtgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcaacatggatgggatggacttctcgaatttcggtggcatgggtggtatgggcggcatgggtggcatgggtgatatggctggtatgggtggtcttggtggcatgggtggtatgggtggtcttggtggcatgggcggtatgggaatggatgatttcgaagatgagagtgatgatgaagaagaagtgtcgaaacctcaagctgcggacaaggctgttgaggctgaggagacggagtcagcggaaaccaagattgaggcggctcagagcagttgaagatgcttatgatctaagctagattgtatcctcatgttaattctgctgaatcggaggacaaaccttacatttatggtgctggcaagtcccagtggcgtgccatgaaaatttacgttccgtcttttaactgggtatccgagtgtcgtgctcagcatattatggatattatttccgtaatgcttcctttggtcgccaatcatgtggtgaagagtttgttttactggattgctttatttgttttttggtcgccaatcgaatggtctggtcaaaaggactagtggcgacgtgattttgttatttggttctctacccagcaatacaactcccacggtaaagtgctacagaggagcaccttcaaaaaaaaaaaaaaaaaaaagg

SEQ ID NO: 2189 - DNA, 1000 bp, Zea mays
  Clone ID: PAT_MRT4577_50828C.1
cattgggtacctcgaggccggccgggccgggaagctatagctagccagccatcctactgtcacacacacacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtggctccccttgtcaggctcatgtttatccgtattgaatcctggcaccatgcatgactgaggatctggatgtctatgaagcaccgtgtatctatcatcacttttgcaaaaaaaaatattcttatatttcttgaaataaaaaaaaaaaaaaaaaagcggcc

SEQ ID NO: 2190 - DNA, 635 bp, Zea mays
  UNSURE (1)..(635): unsure at all n locations
  Clone ID: PAT_MRT4577_50839C.1
  unsure (1)..(635): unsure at all n locations
ggtacccccgnagtctcggccgggccggggacacatattattgttgaccactagcagcatcacaaagcacaatagtgcaccaacaacggcggccaacaattatgcctccttatgctccttggtgctttcgcaaggggtgctacggcgaccattctcccgcaatgctggtaagctgctatagattcccttcttcccccgtacctctcaccagcggtgtcttcggtatatgaagaccccattgttcaaccctactggatgcaacagggggtcaccgctggcatcttaccattatcacccttgttcctccaacaatcatcagccctattacaacaggtaccttcggtgcatttattggcgcaaaacatcatgggaccacaactacaacaacttgtgctagcaaaccatgttgcctactgtcagcaacaggaggttcttgcatgttaccaactacctgcattgaactctgcttcttatttgcaacaacaacaactaccattctgtcaggtacctgctgcctacccccagcaatttcttgcatgtacccaactggctacatagaacactcctgctgatttacagcagcaacaactactaccattcatgcacctagttggtgtgagcactgctaccttctt

SEQ ID NO: 2191 - DNA, 674 bp, Zea mays
  UNSURE (1)..(674): unsure at all n locations
  Clone ID: PAT_MRT4577_50881C.1
  unsure (1)..(674): unsure at all n locations
ttttttttttnnttttgatctcgattttaacatttcattactgcaaagaaagatacatcttgatcttgatttcccagcactgctgggacacatgattccacccaataacgaagcacatcagagatattttaatctgataactctctacatcaagccaagcaaggcagagggaactgaggaaacgccaccggcagccgctgcatacgagggaagagatgcgctcaaccaccgaacccgtacagagtgcggccctggcgcttgagggcgtacacaacatccatggcggtgacggtcttgcggcgagcgtgctcggtgtaggtgaccgcgtcgcggatgacattctcgaggaagatcttgagcacgccgcgggtttcctcgtagataagcccggagatacgcttcacgccgcccctcctcgccagcctccggattgccggcttcgtgataccctggatgttgtcgcggagaaccttacggtggcgtttcgcgccgcccttgcccagccccttgccgcccttgccgcgcccatacatcgccgccgagttggacgaagacagtggtgtgctacaagaagattgtgggatttgaactcgccgcgcctggggtgcctaatgagtgagctaactcacattaattgcgttgcgctcactgcccgctttccagtcgggaaacct

SEQ ID NO: 2192 - DNA, 624 bp, Zea mays
  Clone ID: PAT_MRT4577_50884C.1
cattgggtacctcgaggccggccgggacagagtaccgcggcgggttcaatctcacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttccctcgtctgcagcggctgccggtggcgtttcctcagttccctctgccttgcttggcttgatgtagagagttatcagattaaaatatctctgatgtgcttcgttattgggtggaatcatatcgagatcaagatgtatctttctttgcagtaatgaaatgttaaaatcgagatcaaaagaaaaaaaaaaaaaaaaaagcggcc

SEQ ID NO: 2193 - DNA, 594 bp, Zea mays
  Clone ID: PAT_MRT4577_50885C.1
accagagtcatcgcggcgagttcaatcccacaatcttcttgtagcacaccactgtcttcgtccaactcggcggcgatgtctgggcgcggcaagggcggcaagggcctgggcaagggcggcgcgaaacgccaccgtaaggttctccgcgacaacatccagggtatcacgaagccggcaatccggaggctggcgaggaggggcggcgtgaagcgtatctccgggcttatctacgaggagacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacggattcggtggttgagcgcatctcttccctcgtctgcagcggctgctggtggcgcttcctcagtttcctctgccgtgcttggcttgatgtagagagttatcagattaaaatatctctgatgtgcttcgttattgggtggaatcatgtgtcccagcagtgctgagagctcgagatcaagatgtatctttctttgcagtaatgaaatgttaacattgattggct

SEQ ID NO: 2194 - DNA, 661 bp, Zea mays
  Clone ID: PAT_MRT4577_50886C.1
ccggccgggaccagaggcatcgcggcgtgttcaaatcccacaatcttcttgtagcacaccactgtcttcgtccaactcggcggcgatgtctgggcgcggcaagggcggcaaggggctgggcaagggtggtgcgaaacgccaccgtaaggttctccgcgacaacatccagggtatcacgaagccggcaatccggaggctggcgaggaggggcggcgtgaagcgtatctccgggcttatctacgaggagacccgcggcgttctcaagatcttcctcgagaatgtcatccgcgacgcggtcacctacaccgagcacgctcgccgcaagaccgtcaccgccatggatgttgtgtacgccctcaagcgccagggccgcactctatacggattcggtggttgagcgcagctcttccctcgtttgcagcggctgctggtggcgcttcttccgtttcctctgccgtgcttggcttgatgtagagagttatcagattaaaatatctctagtgtgtttcgttattgggtggaatcatgtgtcccagcagtgctgagagctcgagatcaagctgtttctttctttgcagtaatgaaatgttaacattgattggctataagcgctttggaactgttgaaactttgctattgagcccgctgttatggggttatt

SEQ ID NO: 2195 - DNA, 1366 bp, Zea mays
  Clone ID: PAT_MRT4577_50888C.1
ggccgcttttttttttttttttttcggctgcaaaacgttgcccaggaatcatttcaattatcgaacgataagattggattacattcgaaacaacttcaagaatactactaacaatagtccaacacgtcacagacaaggaactaaacgaaataaccctaacaacaaacaggcatccacgacagcaaggagaagaggcatccagcctagcctccgaagccgtagagggttcggccctggcgcttgagcgcgtagacgacgtccatggcggtaacagtcttgcggcgtgcgtgctcggtgtaggtgacggcgtcgcggatgacgttctcgaggaagatcttgaggacgccgcgggtctcctcgtagataagccccgaaatgcgcttcacgccgcccctccgagccagcctacggatcgcgggcttggtgatgccctggatgttgtcacggagcaccttacggtggcgctttgctccgcccttgcccagacctttgccgcccttgccgcgccccgacatcgtcgctgccggtgccctgtctttcacgctctcctcgcctcgaagaaaatgggggatttttttgactagttctagatcgcgagcggccgctcgcgatctagaactagttcaaatctcacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttccctcgtctgcagcggctgccggtggcgtttcctcagttccctctgccttgcttggcttgatgtagagagttatcagattaaaatatctctgatgtgcttcgttattgggtggaatcatgtgtcccagcagtgctgggaaatcaagatcaagatgtatctttctttgcagtaatgaaatgttaaaatcgagatcaagatgtatctttctttgcagtaaagaaactttgctattgcgcccactgttaggctaatcacaatggaggtttcatgaggtgtttcatgtattaattagcctgctatattagctattttgatgatgtgtcatatcatttaaaaaaaaaaaaaactcgaggggggggccggt

SEQ ID NO: 2196 - DNA, 883 bp, Zea mays
  Clone ID: PAT_MRT4577_50890C.1
gattcattaatgcagctggcacgacaggtttcccgactggaaagcgggcagtgagcgcaacgcaattaatgtgagttagctcactcattaggcaccccaggctttacactttatgcttccggctcgtatgttgtgcgcggcgagttcaaatcccacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttccctcgtctgcagcggctgccggtggcgtttcctcagttccctctgccttgcttggcttgatgtagagagttatcagattaaaatatctctgatgtgcttcgttattgggtggaatcatgtgtcccagcagtgctgggaaatcaagatcaagatgtatctttctttgcagtaatgaaatgttaaaatcgagatcaagatgtatctttctttgcagtaaagaaactttgctattgcgcccaaaaaaaaaaaaaaaaaaaccattcccaaaccctccgtcgacccctctacaccggcgatcggcggcgaaccgatggggtgggcggacccggttccctggggggcggtgtgcttcttttgct

SEQ ID NO: 2197 - DNA, 321 bp, Zea mays
  Clone ID: PAT_MRT4577_51028C.1
gtccgaatcccggtcgaccacgctccgcactggcacctaaaaggcccattagttcccacaatgcagccaaaatatttgcctcttatgctcctggcctttctgaagggctgttacgggaccattttcccgaaatgctccaggctctatagcttccctcttccccgaacctttaccagcggggcttgggatgggaaaccccaattctcaaccctaaggatccacaggcaatcacagctggcatcttaccttatcacccttgttcctccaccaatcatagccctattacatcagttaccttggtgccattattggcacaaaaca

SEQ ID NO: 2198 - DNA, 322 bp, Zea mays
  Clone ID: PAT_MRT4577_51197C.1
attaactcaaaaaaaaagggggggcattcttttacagaatgggttcacagatatttctccatacagacatgctcatcgtggacgacccagctgaccacctacagctgcatacttacttattcagactgatccagcatgtagcaacatctgaagaaacatacttacagaccaccaaccttcataacaataacccagctttgctgcttcacagaataaccaatcgacaaccacgaaattgcgacaatttcacatacacaactcagaaccatagcgacaccacgagcccggattactcattaagcactcccgacttctcctccat

SEQ ID NO: 2199 - DNA, 325 bp, Zea mays
  Clone ID: PAT_MRT4577_51313C.1
gcgcccacacgtccgcctccccctccggttcgtgttcgggttcgtgaggttctcctgagttcgggttcgtgtgaaatcggatcgagatggcggcatccgatgttgagtaccgctgcttcgtctgcggcctcacctgggccacggacgaccactccctacacaactccttcagcacctactgcgaggtcctctagtccaagatcatcctttatctggagacgcaaaagtcccgcagcttctgcttcttcaccttcttcactgacgatgcgattcataacgccatctaaggcattaacggcaatgagctttacagacgtaacatcac

SEQ ID NO: 2200 - DNA, 609 bp, Zea mays
  Clone ID: PAT_MRT4577_51322C.1
tctccatcttgtgggatttatctcaccgcgtctatcactcaaacacgctccaatccactctacactctctcccaaccaacaacctcccccacacacatccatcaacatgactggtcgcggcaaaggtggcaagggtctcggaaagggtggtgccaagcgccaccgcaagattcttcgtgacaacatccagggtatcaccaagcccgctatccgtcgtctcgctcgtcgtggtggtgtcaagcgtatctcagccatgatctacgaggagactcgcggtgttctcaagaccttcctcgagggtgttatccgtgacgccgtcacctacactgagcacgccaagcgcaagaccgtcacttctctcgacgttgtctacgctctcaagcgacaaggccgcaccctgtacggtttcggtggttagagtgtttttcttcacggttttcatgttacgacttttgccgacttgttcagtccatggtcggcttcggtgctcggtgggatggtcatagccttgtacagtatactaaggctcggagttcacggttatatcagtcggtttctgctttgcatggaatgataccataatactccaaaaaaaaaaaaaggccccta

SEQ ID NO: 2201 - DNA, 317 bp, Zea mays
  Clone ID: PAT_MRT4577_51573C.1
cgttaagaggaacttacaataaagcctgacgggggtaacaacttccatcgatccgcagtccatgctgtttgatgcatgggtttggtcaaaccgaggatgaacacagtactaacaactggcacaaagcgaccttgcaatcaaaaacacagatggggaacaacaaacacgacgcgaacgaaaataaaccctctggactagggtaaacatcacggtcgcgaacaggataacttggccgagcgggccccaccgtttagttgctccagatcacgtcggagttgacgtagccgtcgtcactgttgaaaccgccgtaagccggc

SEQ ID NO: 2202 - DNA, 324 bp, Zea mays
  Clone ID: PAT_MRT4577_51599C.1
aaaatgcaacatttatgttttattgtttatagaggtcaacattattgtcatattaagagactgttaaaatttgccagacctgcaggacaacatgtttttttttacgtgcagttacagggagaagagtaaggctaacagtaacgcctttagggtgaggggccaaggggaaaatacgaacaatgaggccaaataaacagcagtgcagctaggcgggtagcgcacaatacacatgaactggcgatttgacaggagtttttctcgatgttcacggccggtcggtcgtatatttttgatgtgatgataggtgcgggcctcacaggtact

SEQ ID NO: 2203 - DNA, 3791 bp, Zea mays
  Clone ID: PAT_MRT4577_51643C.1
cattgggtacctcgaggccggccgggaattgtgggcctcggaccctctctttgttcttccgtttccaccctctctctcgtggttctcccgtgctctgtgtccctagcggcgacgactgggcgatcgccgccgccttaagccaggtgctcaggtctgccacttggcacttcgccggcgacgagcacctaacagagagatggctggtggttttcgagtactgcatcttgtgaggccatttctggctttcttgccagaagtacagagtgctgataggaaaataccattcagagagaaagtgatctacacggtcatttctctcttcatttttctggtctgcagccagctcccactctatggcattcattcaactactggcgctgaccctttctactggatgcgtgttattcttgcatcaaaccgtggtactgttatggaactgggtatcactccaattgtaacatctggaatggtgatgcaacttctagtgggatcaaagattattgaagttgacaacagtgtgagggaggatcgtgctctgctaaatggtgcgcagaagttgcttggtatccttattgccattggagaagccgtggcgtatgttctctctggaatgtatggcagtgtgagccaacttggaactgggaatgctatcctcattatacttcagcttttctttgctggtatcattgtcatctgtctagatgaactcctacagaaaggctatggtttgggatctggcatctctctgttcattgctacgaatatctgtgagaatatcatctggaaggcgtttagcccaacaaccatcaacagtgggcgtggtgctgaatttgaaggggcagtcattgcattgttccatctattgattactcgcacagataaagtccgtgctctacgcgaggctttctaccgtcagaatcttccaaatgtgaccaatttacttgctactgtattggtcttcctcatagttatctatttccaaggtttccgtgctgtgcttccagtgaggtcaaagaatgcccgtggtcaacaaggctcatacccaatcaagttgttctatacttccaacatgcccatcattctgcactctgcactgattaccaacctctatttcatatcccagcttctctacaggaaatacaggggaaacttccttggtaatcttcttgggaaatggaaggaatctgagtactctggccattctgttccggctggtggtcttgcttactatgtgactgcgccatcaagcttggctgatgttctggcaaatccagtccatgcattgttctatgtggtctttatgctgtcagcctgtgctctcttctcaaagacatggattgaagtttctggttcatcagcgaaggacgttgctaagcagctgaaggagcaacaaatggtgatgccaggccatcgtgagtcaaacctgcaaagggaactgaacagatacatcccaactgctgcagcatttggaggagtgtgcattggcgcgctaactgtcctagctgatttcatgggcgcaattggctcaggaactggcattctgctcgctgtcactatcatataccagtactttgagacattcgagaaggaaagggcaaccgagcttggtttctttggtttctaatcttcgtcgctggggtaaaagactgaatcttcctgcaagtgacagtaaatgcttggccggctgtttatgtttgtaattggagagcttatagtcagtttaggttgcgggctaatttacactgggaaatttgtagcaggttctgcatgcgtttttggggccaggatgggcattaagttgtgctcaattataaccacggtcatcatctcttgggattttccgttctcctgtattgactatagaattttggatcaattttgccgtcttgaactgaaaaaaaaaaaaaaaagtttccaccctctctctcgtggttctcccgtgctctctgtccctagcggcgacgactgggcgatcgccgccgccttaagccaggtgctcaggtctgcctcttggcacttcgccggcgacgagcacctaacagagagatggctggtggttttcgagtactgcatcttgtgaggccatttctggctttcttgccagaagtacagagtgctgataggaaaataccattcagagagaaagtgatctacacggtcatttctctcttcatttttctggtctgcagccagctcccactctatggcattcattcaactactggcgctgaccctttctactggatgcgtgttattcttgcatcaaaccgtggtactgttatggaactgggtatcactccaattgtaacatctggaatggtgatgcaacttctagtgggatcaaagattattgaagttgacaacagtgtgagggaggatcgtgctctgctaaatggtgcgcagaagttgcttggtatccttattgccattggagaagccgtggcgtatgttctctctggaatgtatggcagtgtgagccaacttggaactgggaatgctatcctcattatacttcagcttttctttgctggtatcattgtcatctgtctagatgaactcctacagaaaggctatggtttgggatctggcatttctctgttcattgctacgaatatctgtgagaatatcatctggaaggcgtttagcccaacaaccatcaacagtgggcgtggtgctgaatttgaaggggcagtcattgcattgttccatctattgattactcgcacagataaagtccgtgctctacacgaggctttctaccgtcagaatcttccaaatgtgaccaatttacttgctactgtattggtcttcctcatagttatctatttccaaggtttccgtgttgtacttccagtgaggtcaaagaatgcccgtggtcaacaaggctcatacccaatcaagctgttttatacatccaacatgcctatcattctgcactctgcactaattaccaacctctatttcatatcccagcttctctacaggaaatacagtggaaatttccttgttaatcttcttgggaaatggaaggaatctgagtactctggccattctgttccggttggtggtcttgcttactatgtgactgcgccatcaagcttggctgatgttctggcaaatccagtccatgcattgttctatgtggtctttatgctgtcagcctgtgctctcttctcaaagacatggattgaagtttctggttcatcagcgaaggacgttgctaagcagctgaaggagcaacaaatggtgatgccaggccatcgtgagtcaaacctgcaaagggaactgaacagatacatcccaaccgctgcagcatttggaggagtgtgcattggcgcgctaactgtcctagctgatttcatgggcgcaattggctcaggaactggcattctgctcgctgtcactatcatataccagtactttgagacattcgagaaggaaagggcaaccgagcttggtttctttggtttctaatcttcgtcgctggggtaaaagactgaatcttcctgcaagtgacagtaaatgcttggccggctgtttatgtttgtaattggagagcttatagtcagtttaggttgcgggctaatttacactgggaaatttgtagcaggttctgcatgcgtttttggggccagtatgggcattaagttgtgctcaattataaccactgtcatcatctcttgggattttccgttctcctgtattgactatagaattttggatcaattttgccgtcttgaactgaatacgtattcattactatccaaaaaaaaaaaaaaaaaaggccccta

SEQ ID NO: 2204 - DNA, 375 bp, Zea mays
  UNSURE (1)..(375): unsure at all n locations
  Clone ID: PAT_MRT4577_51656C.1
  unsure (1)..(375): unsure at all n locations
aagccagggatcgccatgggggactcngaggagcaccacttcgaatcgaangcccacccccgagcctccaaaacctacccgcagcaggctggcaccggccggaagaacggcttcatcntcatcaaaaaccgcccgaggagggtntngangtttctacctcaaaaactggtaancatggtcatgccaaatgccactttggtgccatagatatattcaacgggaaaaagctcgaagatattggtccttccgcacacaactgtgatattccggatgtgaaccggactgagtatcaggtggggggatatcanangatggatttggtagccttcttacttcaaatgggaacactaaggaggatcttaaactcccaactga

SEQ ID NO: 2205 - DNA, 483 bp, Zea mays
  Clone ID: PAT_MRT4577_51661C.1
tttttttttttttttttttttttttttttttttttttttttttttttttttttttttttttattcaaatggggagccggcctagagggaccaagataattagccccttaacaaacattatgggtctcatctatgccaaaggcaggcattttcatcatcaaaaattttttcttcctttaagcaaataaacatggagcatcagggcccaagggatgaacaaaacatatgggggggagccccatcacctgcaggaggaggcaggggggcccccaatggatccggggggggagcccccagctttgggggggggggggcacaaactaaagcccagtttatgccacaaaaaaagggggggggtttgatccccatagcgccctcataggaacctagcctatttggggggtctgggggaaacaaccggtatataaggtgccttgccgccaggctcacctggttgcccgcaggaaatctgatatccttgggc

SEQ ID NO: 2206 - DNA, 996 bp, Zea mays
  Clone ID: PAT_MRT4577_51897C.1
accggtaccggcacctcccggtgtcgacccacgccgtccgaaaggaagaaaaaaaagaaaaaccgacagcgagccccaagccccaaacggccaaacctccttggacacgactcgccgcacccatccccatccgccgccgctgccatggccgacgagattgacacgaggccggcctccgcgggctcccgcggccgtcctgcgcacgctaccgaggacgacgacagagaggagggcgagatcgccgccgacgccccctcgcccgccctccccgccgcgcacccgctcgagcactcgtggaccttctggttcgacaacccgcacggcaaaaacaagatggccgcctgggggagctccatccgacccattcacaccttatccaccgtagaagacttctggggcctctacaataatattcatcaccctagcaaattgatcgggggagctgatttccattgcttcaagaacaagatcgagccaaaatgggaagaccctatttgtgcgaatggtggtaaatggaccatcagctgtggaagaggaaaatctgatacgttttggctgcacactctgctggctatgattggtgaacaattcgactatggtgatgaaatttgtggcgcagttgtcagtgtgcgtgggaagcaggaaagaattgctatttggacaaaaaatgctgccaatgaagctgctcaggttagcatcgggaagcagtggaaggaacttctggactacaaggactccattggattcattgttcatgacgatgcaaagaagatggacaaaggcctgaagaaccgttacacggtttgatcctgatgctggaatcccagagagttgtagcagtagctggcccaaatgcatgctgggtggttttatctattgctgatgagttgtttaagcaagatccattcctgtattgtactccataagccacttgggtgttgctttgtattgttcaaaaaaaaaaaaaaaaaaaaagggcggcgctcgcgtcagaac

SEQ ID NO: 2207 - DNA, 1020 bp, Zea mays
  Clone ID: PAT_MRT4577_51899C.1
cattgggttggttacctcgaggcgggagccgggagacagccgccctaacggccaaacctccttggacacgactcgccgcacccatccccatccgccgccgctgccatggccgacgagattgacacgaggccggctcccgcgggctcccgcggccgtcctgcgcacgctaccgaggacgacgacagggaggagggcgagatcgccaccgacgccccctcgcccgccctccccgccgcgcacccgctcgagcactcgtggaccttctggttcgacaacccgcacggcaagaacaagatggccgcctgggggagctccatccgacccatccacaccttctccaccgtagaggacttctggggcctctacaataatatccatcaccctagcaagttgatcggcggagctgacttccattgcttcaagaacaagattgagccaaaatgggaagaccctatttgtgctaatggcggtaaatggaccatcagctgtggaagaggaaaatctgacacgctgtggctgcacaccctgttggctatgatcggcgaacaattcgactatggtgatgaaatttgtggagcagtggtcagcgtgcgtagcaagcaggaaagaatagctatctggacaaaaaatgctgctaatgaagctgctcagataagcatcgggaagcagtggaaggaatttctggattacaaggactccattggattcattgttcatgacgatgcaaagaagatggacaagggactgaagaaccgttacacggtttgatcccaaagagtagtagcatgtagggtggttctatccgattccgtagcaccttgcagagtgtgttgaaggttctctatttgctgaggagttgcttaagcataatctaacatgatgtcgaatgtattcctgtatgttccataggtcagtcacctaggtgttgtttttgtctcagctttgtgtgctatatatatatatatatatatatatatattgtatatatatatatatatatatatatatatatatatatat

SEQ ID NO: 2208 - DNA, 1158 bp, Zea mays
  UNSURE (1)..(1158): unsure at all n locations
  Clone ID: PAT_MRT4577_51900C.1
  unsure (1)..(1158): unsure at all n locations
ctcgtgccgaattcggcagagctaccatgggcctggcctggcccatttcttgagaagagaggaggtggactccgggggggaaagggaaaggaaacctagacaagcgaggcggcggccccgcgttctccgtctccgtctccgtctccgtccgcccggcgtaaagaaaagcctctctcaccacagccgccacgccatggccgaggagaccgacaccaggcctgcctccgcgggctcccgaggccgccccgcgcccgaggacgacgacagggaggagggcgagatcaccgacctcgcctgcgctccttccccgcccgccacgcacccgctcgagcactcctggaccttctggttcgacaacccgcagagcaagtccaagcaggccgcctgggggagctccatccgccccatacacaccttctccaccgtcgaggaattctgggggctttacaataacattaatcaccctagcaaattgatcgtgggagctgatttccattgcttcaagaacaagatcgagccaaaatgggaagaccctatttgtgcgaatggtggtaaatggaccatcagctgtggaagaggaaaatctgatacgttttggctgcacactctgctggctatgattggtgaacaattcgactatggtgatgaaatttgtggcgcagttgtcagtgtgcgtgggaagcaggaaagaattgctatttggacaaaaaatgctgccaatgaagctgctcaggtaagcatcgggaagcagtggaaggaacttctggactacaaggactccattggattcattgttcatgacgatgcaaagaagatggacaaaggcctgaagaaccgttacacggtttgatcctgatgctggaatcccagagagttgtagcagtagctggcccaaatgcatgctgggtggttttatctattgctgatgagttgtttaagcaagatccattcctgtattgtactccataagccacttgggtgttgctttgtattgttcactactgtgttttttctatgtgtgggaccgcatctacagtactagttgcttgtcgaaaaaaaaaaaaaaaaaaactcgagactagttcagttgcgcttgaatctgaactaacggagtctgagcaaaaaaaaaanaaaaaaaaaaaaaaaaaaagggcggcg

SEQ ID NO: 2209 - DNA, 249 bp, Zea mays
  Clone ID: PAT_MRT4577_51967C.1
tcgggcttatcctccccctcttaccgagtgcttttcgggttagggttacttacggtttcgtggaagggcgattgcggctgctgatgcggagtaccgtacctttgtcggcgggcttgcctgggccaccaacaactgattcgctggagaatgcctttgccttctacggcgagatcctctactccaaggtcatcaccgaccgggagacggggaggtttcgcggtttatgctttgttaccttctcctccgata

SEQ ID NO: 2210 - DNA, 563 bp, Zea mays
  Clone ID: PAT_MRT4577_52020C.1
attggtccctcgaggcggcgggagtctcttcctgccacactctagcgagactcgagacgacccgatgtttccttcccgtcttcctcccacacgtccccatcaccattgctgagacgatagagagcggaatagggtaggtgctcgatgagacagatatggggggggggtcgtggcagctgcaccggatcgacaacaagatcaaccgccaagggatgttctccaaacgacggaacgggctgatgaagaaggaccacgacatctccgtgctctgcaacgcataggtcctgctcgtcgtcttctccactaaggggaatctcaacgagtactctagccaatccagcatggaaggcattcttgagcgataccagcgtttcttcatttgaagacatggcagtacttaaccctaggatggaaaaccagaaaaattggggagatgaatatgtccgaataaaatacaaacttgatgcacttcataagagtcaaaggctgctgttatgacaacaagtgagttcactgaccatagaagaactccggcaactgtcagcacaactggacagatcttt

SEQ ID NO: 2211 - DNA, 424 bp, Zea mays
  UNSURE (1)..(424): unsure at all n locations
  Clone ID: PAT_MRT4577_52027C.1
  unsure (1)..(424): unsure at all n locations
aacnaaaacaatgtacaagctaaaacccatttcttcaaccctaccggatccaacaggcnntcgcagctggcatcttacctttntcacccttgttcctccnacantcatcagccctattacagcagctacctttggggcgtgtattggcncaaaacatcagggcacaacanctacaacancttgtgctngcaaaccttgctgcctactctcagcaccagccgtttcttccattcanccaactngctgcgttgnactctgcttcttatttgcancaccgnctaccattcagcccgctagctgctgcctgcncccagcggtttcttccttcgcaccnactggcggcgttcggctctcctgcttatttgcgggcggggcggctgctgccattcggccggctggctggtgtgggccctgctgccttgtt

SEQ ID NO: 2212 - DNA, 338 bp, Zea mays
  Clone ID: PAT_MRT4577_52063C.1
cagctacctacatataaagcacaatagtgtaccaacaatggcagcccaaatatctagggttcttatgctccttggtatatctgcaagtgctgctaccgcgaccattttcccgcaatgctcacaagctcctatagcttcccttattcctcagtacctcttaccagcggtgtcttagatatgtgaaaacccaattcttcaaccctacaggatccaacaggcaatcgcagctgccatcttacctttatgacccttgttagtgcaacactcatcagacctattacagcacttacctttggtgcatttattgtcacaatacataagggcacaacaactacaac

SEQ ID NO: 2213 - DNA, 413 bp, Zea mays
  UNSURE (1)..(413): unsure at all n locations
  Clone ID: PAT_MRT4577_5207C.1
  unsure (1)..(413): unsure at all n locations
agctggactgccgcaacatcaccttcaactaggcccagtcccgcggaggtcgtggaagcgtgtgcagcggcagatgctgtggtggccgtggatgcagaggatacagcggtggctgacgccgtgatggcggatgcggctacagcggtggccgcggctactgtggttgctgcggcggctacggtggtggtggcggcggatacgtgcatggtaaccgtggcggatgctacggcaactccgacggtaactggatgaactgagcagtggtgcccgcgcggccaagttatcctgttcgctaccgtgttgtttaccctagtacaaagtgtttatcttagttcgactcgtgtttgatgntacccatctgtgttactgattgaaggtcactctgagtcagttgatagtgctatgttcaatat

SEQ ID NO: 2214 - DNA, 415 bp, Zea mays
  Clone ID: PAT_MRT4577_52121C.1
accatacgcacctctctccatctttctgctacttcttcttcttgttgatccagccaatcgagggatcttcatgttggactggggggagcaccatttcgaatcgaatgccgacgccgtagctttcaagacctaccctcagcaggctggcaccgtacgtactaaccgctttatcctcattaagaaccgtccatgtaaggctgagcaagtttctacctcacagactggtaagcatggtcatgcctaatgccactttgtctccatatatatattcaacggtaaaaagctccaagatattgttccttcgacacaaaaatgtgatattccggatgtgaactacactgagtatcagctgattgatatatcacaggatggattcgtgagcctttttactctagatggcaacactaaagatgat

SEQ ID NO: 2215 - DNA, 701 bp, Zea mays
  Clone ID: PAT_MRT4577_5234C.1
cgtatcgggttgtgcgcgggggacagggcgccacctgcgccgatgcgtgcgtttgtgttcgttgtttgtgtccgtttctgtgcctgtggcttcggttgttcctctgagcgacggcgatcgagccttaatcttagctcctgctgggctgcgcctgcgcaggctgagggggaccacagaagcattagctgggtgagcccactcaaagggggcagggaattgtgtgctagtttgaatggctgctacaaagcttcaggccctttggaaccacccggctggccccaaaaccattcatttctgggcgccaacattcaaatggggcatcagcattgccaacatagccgactttgctaaaccacctgaaaagatatcttaccctcagcaagttgctgttgcatgcactggactcatttggtcaaggtacagcttggttatcacaccgagaaactggaaccttttcagtgttaacgttgcaatggcgggtacaggcctgtatcagctttcacggaagatcaggcaagattacttatccgatgagaaagatgctgcttcacaactggaagcatagataatgacaacaggcaaagaataacggattggaaagcctgcatcctaggagtctactcttgattttttttttctgggcaagcaaagaataacggatgggtcatgtttgttttcctgttattctgaaatcgtgagca

SEQ ID NO: 2216 - DNA, 823 bp, Zea mays
  UNSURE (1)..(823): unsure at all n locations
  Clone ID: PAT_MRT4577_5235C.1
  unsure (1)..(823): unsure at all n locations
ccgggccgggtctctgacttggctcctccgtcgtcgccggaggcgcggcaagtgtaaaccagcccaccctcctccccgtctcctctccctccccatgcgctgttttgttctgtattgggttgtgcgcgggggacaggacgcctcctgcgccgaccgttccgttcgtgtttgtgcctgcctgtgccttcggttgttcctctgagcgacggcgagtcggcgaccgagggggaccacagacgcattagctgggtgaactctttcaaaaggggcaggtgcgctagtttgaatggctgctacaaagcttcaggccttttggaaccaccctgctggccccaaaaccattcatttctgggcgccaacattcaaatggggtatcagcattgccaacatagccgactttgcaaagccgcctgaaaagatatcttaccctcagcaagttgctgttgcatgcactggaatcatttggtcaaggtacagcttggttatcacaccgaaaaactggaaccttttcagtgttaacgttgcaatggcgggtacaggcctgtatcagctttcacggaagattaggcaagattacttgtctggtgagaaggatgctgctccacaactgcaagaatagataatgacaacacacaaagaataactgattgagaagtctgcggcctagggatcttactcttgatttttctgggcaggcaaggatatgtctcgatccaggacggggncatggtttgttttcttgttcttctgaaatcatgagcaggttaatgtgaaatctcctgccaaaaaaagaagcccatgaaagtatattttgtgcattttt

SEQ ID NO: 2217 - DNA, 1603 bp, Zea mays
  UNSURE (1)..(1603): unsure at all n locations
  Clone ID: PAT_MRT4577_52373C.1
  unsure (1)..(1603): unsure at all n locations
ggccgggagtcctaaatcacgctcacacttnggcgaagcaaacagatcgagattcgagagaaatggcgatggcgacgccagctgccaaacaatcacttctcaccgtccaaccgtgcacaatgaattgaagcgccacgcggttccaatattctattgccacgggcaggtgcgtcgcgtcgattcctggtcttcgagaggagcggaggaggagggcggcgagtgtggaggagaggcgagttcagctgtagcgtttcgcttcttgcccgtggcggcggcggtgccacctcgaacgctgctccctgttctggggcttactgcggatcctgatctgagcatcattcagagaggaagaaatatgtttaggagaaagcatggctctgatgtcaactcagatgatgctgagcaaagagaagcaaagattagtgaactgaaagctgctcttgggactttgtctgcccgtggcgagaagtactgcagtgaagcatgcttgagaagatatctggaagcccgtaactggaatgttgctaagtcgagaaaaatgttggaagaaagtctcaagtggagggcagcttacaagccagaggatattcgttggcctgatgtttctgttgaagcggaaacaggtaaaatgtacagggcaagtttccgagacagggagggcagaactgttgttgtcatgaaacctacaaaacaaaatacttcatcccatgaagggcagatacggttcctagtatatactttggagaatgcaatcttcagcctgcctgaaggccaagaaaaaatggtatggctgattgatttcacaggatggacagtgtcccatgcttcgccgataaagacttgtagagaaactgcaaatatactgcaaaatcattttcctgaaaggctggccattggatttctatttaatccccccaaagtatttgaagctttttataaggtcatcaagattttcctcgatccaaaatcagtcgagaaggtgaacttcgtgtacgagaaggatgaggagagcatgaaggtcatgtacaaatacatcgatccggaagtccttcctgtagagtttggggggaagagcaatgtggtgtacaaccacgaggagtactccgagttaatgagacaagatgacatcaaaacagcaagcttttgggcggttgatgcgaaaactaaccatgctaaccctgccatcaatgggaccttggttcctgaggttgcgccacagtcgtcgctggctgctaaagctagttgaagagtatctgcattctctgagaaaattgagaagccgaggactaatggaaccttgagagaaacatatgaaataagaaacatggtatactcgttcatcctcaagagttgtttaagtactggaagtttattcagcacacaataagctactagagaatgtcaccatgtgtgatttgatgcccaaaagagatggtttacaaggtacagccaagtttttgtacttgaattaattactatatgtcagtgattatcacatggataagtaactagcacaagcttaaccgtttacttttctcttatttcttttacgatatactttgtcttctcgctaatcaatcgagtgtttctttcgatgatttaa

SEQ ID NO: 2218 - DNA, 708 bp, Zea mays
  Clone ID: PAT_MRT4577_5237C.1
cgattctcgagggagacgagcgccgccgcacccgaccgagtcagagcagagccagaggccccctccccgctgactcagctcctccgccgtcgccggaggcgaagcaagtgaggaccacggaagcattagctgggtgaactcactcaaaagaggcagggaatagtgcgctagtttgaatggctgctacaaagctgcaggcactttggaaccaccctgctggtcccaaaaccattcatttctgggcgccaacattcaaatggggtattagcattgccaacatagccgactttgctaagccgcctgaaaagatatcttaccctcagcaagttgctgttacatgcactggactcatttggtcaaggtacagcttggttattacaccgagaaacttgaaccttctcagtgttaatgttgcaatggcgggtacaggcctgtatcagctttcacggaagataaggcaagattacttctctgatgagaaggatgctgctccacaactggaagcatagatgtcagcagacaaagaataacggattgggaagtctgctgcctaggagtctactcttgattttttttctgggcaggcaaagaataacggatgggtcatgtttgttttcctgttattctgaaatcatgaccaggtcaatgtggaaatattctgccaaaaaagaaaacccataaagtaatcttttgtgcactttttgtggg

SEQ ID NO: 2219 - DNA, 1322 bp, Zea mays
  UNSURE (1)..(1322): unsure at all n locations
  Clone ID: PAT_MRT4577_5238C.1
  unsure (1)..(1322): unsure at all n locations
ccggccggatgcgctgttttgttccgtatcgggttgtgcgcgggggacagggcgccacctgcgccgatcgttccgtttgtgttcgttgtttgtgtccgtttctgtgcctgtggcttcggttgttcctctgagcgacggcgatcgagccttaatcttagctcctgctgggctgcgcctgcgcaggctgaggtggggttccgtgcgccccggttcgtggtggaattgattttgcccggttgttgcttgccgtagcagcatgttttcctccccacaacatttctggtccgagtgcggcagcacagcacctgatccttagctatgccgatccgaactgtggcctgaccggctgaccgtgggcgaagcactcgaccctcagtatctgctgccgccatttcttgcccggagctgttgcgctttggcttgtagtaaactcgacacgttgtcgccccttgctcgcccgggcagttctgctcgagtgcttgtactccgtcgtcgtcactggcgacaagtagtttgatcggcgttacggnggaccacagaagcattagctgggtgaacccactcaaagggggcagggaattgtgtgctagtttgaatggctgctacaaagcttcaggccctttggaaccacccggctggccccaaaaccattcatttctgggcgccaacattcaaatggggcatcagcattgccaacatagccgactttgctaaaccacctgaaaagatatcttaccctcagcaagttgctgttgcatgcactggactcatttggtcaaggtacagcttggttatcacaccgagaaactggaaccttttcagtgttaacgttgcaatggcgggtacaggcctgtatcagctttcacggaagatcaggcaagattacttatccgatgagaaagatgctgcttcacaactggaagcatagataatgacaacaggcaaagaataacggattggaaagcctgcatcctaggagtctactcttgattttttttttctgggcaagcaaagaataacggatgggtcatgtttgttttcctgttattctgaaatcgtgagcaggctaatgtgaaaatcttccgccaaaaaagaaaaccaatgaagtgatgttttgagcattttttttgtgggaacaagtcatgaaagtacatggtttatctgttgaaaatctaaacccaaaaaaatgggaaaaaagtcatgccaggacatgattcgtatattgtccttttgtcactcttctcgttttgtgattgttttcgcgttattttgaaaaaaaaaaaaaaaaaaagcccctagggccgcggccgctctaatatatt

SEQ ID NO: 2220 - DNA, 346 bp, Zea mays
  Clone ID: PAT_MRT4577_52399C.1
tgaacatgaagcagcctctcgtgctgcccgcgcaccggtcgccccaggaccaggaaggaccccgaggcggaggtgcgccatgggcacaactacgtgccccgcgacgagcagttctcggaggtcaagcagctcacgttcggggccacgacgctgcgctcgggcctgcacgcgctgctcccggccatcaggccgatgctcatcaagagggagctgcgcttcccgcacttcccggccatcgacgacctctacagcgacggcatcccgctgccggcgcagaccgggttgggcgccatccgcagcatcgtcccgcgcgtggtcaagctggtggaggacaccaccgagcacg

SEQ ID NO: 2221 - DNA, 1232 bp, Zea mays
  UNSURE (1)..(1232): unsure at all n locations
  Clone ID: PAT_MRT4577_5241C.1
  unsure (1)..(1232): unsure at all n locations
gggatcgattcccgagacacgagcgccagcggatcgatcattcgatccccaccactgcccgaggccccctcctcgctgacttggctcctccgccgtggccggaggcgaagcaagtgtaaaccagcccaccctcctccccgtctcctctccctccccatgcgctgttttgttctgtattgggttgtgcgcgggggacaggacgcctcctgcgccgaccgttccgttcgtgtttgtgcctgcctgtgccttcggttgttcctctgagcgacggcgagtcggcgaccgaggtggggttccgagcgccccagcccgtggtggaattcgtttggtctggttgttgcgggggaccacagaagcattagctgggtgaactctttcaaaaggggcaggtgcgctagtttgaatggctgctacaaagcttcaggccttttggaaccaccctgctggccccaaaaccattcatttctgggcgccaacattcaaatggggtatcagcattgccaacatagccgactttgcaaagccgcctgaaaagatatcttaccctcagcaagttgctgttgcatgcactggaatcatttggtcaaggtacagcttggttatcacaccgaaaaactggaaccttttcagtgttaacgttgcaatggcgggtacaggcctgtatcagctttcacggaagattaggcaagattacttgtctggtgagaaggatgctgctccacaactgcaagaatagataatgacaacacacaaagaataactgattgagaagtctgcggcctagggatcttactcttgatttttctgggcaggcaaggatatgtctcgatccaggacgggtcatgtttgttttcttgttcttctgaaatcatgagcaggtcaatgtgaaaatctcctgccaaaaaaagaagcccatgaagtaatattttgtgcatttttgtgggaaaaaagtcatgccaggacatgattcgtatattgtccttttgttcactctatctcgtatttgtgaactctaaattgtttgccaatttgattgatcatagcccagtgttcagagatgtcagtgcccttcaccgtcctcattttgttatgatcgtggtgaagctgaattgttatccctggagaatgagggcattcaataagaagtgtttggtttaagaaaatcactccctccaagatagagtggtgtatgtctatcccttcacggagtgtttggtttgagnaatcatatc

SEQ ID NO: 2222 - DNA, 232 bp, Zea mays
  Clone ID: PAT_MRT4577_52442C.1
gaaaacagagagccattaaagcattcactacgacattgaggtgctgctctgctagcgggcgtgctacagcatgtcacgtaaggtacacgacgacgacgacgacattgaacggagggacactagaccaagcagatcactagtgcatgcatgatccactacttgattatgggccagtccgatgcatgacacacacctagctaggacatctatggtactacgacaactgcatgct

SEQ ID NO: 2223 - DNA, 285 bp, Zea mays
  UNSURE (1)..(285): unsure at all n locations
  Clone ID: PAT_MRT4577_5249C.1
  unsure (1)..(285): unsure at all n locations
cctatagtgagtcgtattaantgtgctccttagggcgtctcgcggaccgggccggtggcgtgcgcgggcacgagattcaccgttcgcgcttttaagctatccctcggtcctgcagcggtagcataggactttgggggtggggaagccgatcagtgatctatttagcactagcaggtatggctgaatgtttgctgccatctacacatttgcatggaacacgaacaggtactagaaggcttggctacacagatcctggcagggttgcaggcctagctggagcagggt

SEQ ID NO: 2224 - DNA, 285 bp, Zea mays
  Clone ID: PAT_MRT4577_5251C.1
ggcttctcctccccctcttaccaagtcctcctcgggttagggttccttagggttttttggaggggcgagggccgcggctgatgtggagtaccgttgcttcctcggcggacttgcctgggccaccagcaacgagtggctgaagaatgccttcgccttctacggcgagagcctccactccaaggtcatgaccgaccgggatacaaccaggtcccgctgactcatgcttgggtaccttatcctacgagaactacatgctcgacgctttatagaacatgaaccgcttgg

SEQ ID NO: 2225 - DNA, 210 bp, Zea mays
  Clone ID: PAT_MRT4577_52526C.1
ccctattatcaagtcctgctcgggttagggttccttagggttttgtggaggggcgatggcggcggctgatgtggagtaccgttgctttgtcggaggacttgcctgggccaccaacaacgagtcgatggagaatgccttaggttattacggggagatccttgacatttaaggttatcaccgaccggtagacggggaggtcctaaggttttt

SEQ ID NO: 2226 - DNA, 2036 bp, Zea mays
  Clone ID: PAT_MRT4577_52559C.1
gccccggacaggcaggcgcacgcaacgcaactagtctccttcaccgtccgtccattcctccgatccgcaggaggattaggaacttaggatcggggaccggcggagcccgacgaccttctcggtccacccgcccggcgatcgaaccatggcgctcggcgagggcggggatcacggcgccgccctgcccctcatcgcggaccaggcgaaacatgccgccgccggtggcatcgtccgaagcgggagcatgtggacggcagcggcacacgtgatcacggcggtgatcgggtccggcgtgctgtcgctggcgtggagcatcgcgcagctggggtgggtggccgggccggccgccatgctcgtcttcgcggccgtgacggcgctccagtccacgctcttcgccgactgctaccggtcgccggaccccgagcacggccctcaccgcaaccgcacctacgccaaagccgtggaccgcaacctaggtagcaacagctcgtgggtgtgcatgcttctgcagcacacggccctgttcggctatggcatcgcctacaccatcacggcctccatcagctgcaggcaagaagcatacctgggcttgcggctcgctgcagtacgtgagcctgtacggctgcggcgtcgcctaccatcaccaccgccactagcataaggtagccgccgttggccgggcgatcctgaaggcgaactgctaccacgagcatgggcatgacgcgcactgcgactacgatggcaactactacatgctcatcttcggcggcgtccagctcctcctctccttcatacctgacttccacgacatggcgtggctctccgtcgtcgccgcggccatgtcgttctcgtacgccttcatcggcctcggcctcggcctcgcaagaaccattgctaacgggacgatcaaaggaagcataacaggtgttcggatgaggacgcctatgcagaaggtttggcgcgtctcgcaggccatcggcgacattgccttcgcgtacccctactctttgatcctcctggaaatacaggtacagtaacgtgtagccgcacgccattctttcagaaaacactgctggctaccaagcacccattagcagtatcagtttgaaggcttgaagcacagtaacgagttataccttttcactctccggcaatttaggacaccctgaagtcaccgccggccgagaacaagacgatgaagagggcgtcgatgatctcgatcctcgtcacgacattcttctacctctgctgcggctgcttgggctacgccgccttcggcagcgacgcgccgggcaacctccttaccggcttcggcttgtacggtccgtactggctcatcgacttcgccaacgcgtgcatcatcctccacctgctgggcgggtaccaggtgtacagccagccgatattccagttcgcggagcggctcttggcggagcggttcccggacagcgggttcgtgaacggcggctcctacaccgtccggttcgcgtgcctgcgggcgtgccgggtgaacccgctgcgcgtgtgcctccggacgctgtacgtggcgtccacgacggcggtggccgtggcgttaccctacttcaacgaggtgctggcgctgcttggcgcgctcagcttctggccgctggccatctacttccccgtggagatgtacttcatccagcggaacgtgcgccggtggtccgcccgctgggtcgtcctgcagaccttcagcgtcgtctgcctgctcgtcagcgccttcgcgctcgtcggctccatcgaggggctaatcagcaagaagctaggctaggctaggctagtccgatccagtggaacaccctatctgcaggtctgtcagagagtggcagcgggctcggttattttcacagtgttgccttcctcctgcatcgggttgtaagttgtaacatatatgtcgtactagtatagtgcccgtgcgttgctacggcatgtcaattatttgataaaatgttagttcacaacgattacaatgttttgtgacaatatgttagggtgaaaacagacaatttaccccc

SEQ ID NO: 2227 - DNA, 2024 bp, Zea mays
  Clone ID: PAT_MRT4577_52690C.1
ccaggcgggttaatttccttcgtttgggacaaggcgccgccttccgcaaatccgaattggaatctgggcctttgtttccgtaccacaaattcggtaaatatactcgggcaataaaaatccatctcgaggcaggaccgggatgatagatagctgcttgcctgctccggagtttcttccgctgttctctctcgcgcaaatttttatgctgggcaaagacggtgttcttcagcttcgaccccccaaaagggcgaagctttcgcgtccttccccacacacacaaaatacctgggagccgtagcttctgtttggtgcggccacggggtggaagaaatggtatgcgggatgctcgccaattggcatgctgcgctttccgtccctgcagccgcaagaggccttctcttttagatctgtgccgcgtgccgcgccttcctcttcctggtaccctgtgattggagccagtattgttagcgtttaatgaagctgcttttttctagccggcttttggatggtgcttactactacatcgtatcagttgccaccactctcgcgtgcttttgccttctttaggtttgctcgcagggcacacaaagccatttttactgctggaagactgccgcttttagtatctctgggctctggctcttgagtgatctccaagggaagggaagggaagtgatgggggagtgcgaggacggcaaggagtacaggtgctgggaggagctgctgccggacgcgctggggctcatcttccgcaacctgccgctccaggaggtgctcaccgtcctgccgcgggtgtgcaagtcctgggggcgggtggtcgccggcccctactgctggcaggagatcgacatcgaggagtggagccagcagcagagcaagcccgagcagatcggccgcatggtggagctgctcgtcggccgcagcggcggctcgtgccgccggatcagcgtctccgggctgccctgcgatccgctcttctcgttcatcgcagacaatgcgcgagctcttgggaccttggagatccccaggagtgagatcagcgactccgtagtggaagccgtggcgccgcggctatcgaacgtgacgttcctagacatcagcagctgcacgaagatcggagcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggggcagtgccgcgagctcaagttcctggacctgcgcggctgctgggccgtggacgaccggttcctgcgggagcgccacccggggctgcgcgtcctgggcccgcgcgtcgtcgacgactgctacgagaacagctactgggaggagtgctccgactactactcggacgaggacgaggactacgacgacgacgtcgtctcgtgggggttgttcgtggacgacgacgacgactactactacgccgtcggcagcgacgacgacgaggctatctgggacgacgcgcagggcctggagaacctcgaggtgaggttctacggcggcggtggcttcggcgagagcttcgccggcttcgactggccgccgtcgccgtgacgcgtggcccgcgagagccgccgctgcgcttgcgttgcgcggaccgtttgcggctcttgcttatataccgcgtgcgtgcctgagtcgttgtttgttgttcgtccccaagctttgcttgcagatgtgtgctttcaatctttaagctctagcttgcagatatgtgaagtggactgctagtagtagtacactctagctgtaaaactccggtgtttacctgaagcaaaccagcatgcaccggtgagatttcaccggcgccatccccatcctactatctattgtcggctactcctagaaagaaaaaaaaagagagaataccccctgatctttgcgtcgtgtctcct

SEQ ID NO: 2228 - DNA, 395 bp, Zea mays
  Clone ID: PAT_MRT4577_52894C.1
cggacgcgtgggcagctagctgcggtctaccctcagcaatttcttccattcaaccaacgggcaggattgaactctgctgcttatttacaacagcaacagctaccaccattcatccagctagctgatgtgagccctgttgccttattgacacatcaacagttgttgtcgttctacctgcacgctgcgcctaacgcttgcacccttttacaactggaacaattgctggcattcaacccaattggtttgacaaacccaacaacgttctacccacaacccatcattggtggtgccctcctttagattgcttatgaattatacttcaataatgaagttttttggatgaaggttgcggctttccagaaattagaaagttcatttctagaaaaaaacacaga

SEQ ID NO: 2229 - DNA, 1236 bp, Zea mays
  Clone ID: PAT_MRT4577_52917C.1
cgtcctcctccggtcacgcacgcagctagcttacccgccccgccactataaaaatccacctccaccccaccgggcgcggacagttccacacacgcgtgcacgggcgggcaagcaccagaaaggaaaggcggaggccgcgcggcgggcgccagctgcagccaagagcccactagtagtagtagtagctagttcaccaccgcctgcttgcctcctttactttgccatatttgctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccaagacaacaaagagttgcgggataagcagcgcaacctccagtctccaccggaggcgccaccggacctgaaccgctgtgtccctccttggccgcgtagcctgccggcaccgagcaatgacatggacgtggagacggagctgtacataggattacccggcagggagcgctcctccaaccgggactctgattgaaccacggattttcagttcgatcggctaaaaggaataagctccctgaaattaaagcatcgaagggcacacgtcaatggttttatttgcaacttttgtatgcaaacttgtacttgaaaagtaaaaaaaataaaaataaatctgtagtatgtggatgcaagaaacggctggttagctagctgcaagccttctggggcctgaaaatgaaatccacccatggatacacccaaccaagcttgatgcgctacttttctttgaaactggggggggg

SEQ ID NO: 2230 - DNA, 1718 bp, Zea mays
  UNSURE (1)..(1718): unsure at all n locations
  Clone ID: PAT_MRT4577_52946C.1
  unsure (1)..(1718): unsure at all n locations
gaacagatgcagtgtttatcaagtcagatgtaattttccaatgacggtgtcagaaaaggacattgctttgcactaacaaatatcgttacggcaataatgaaatgggagccttgcagcttgcgccaccagagagctactaaacacaattcgatcgagagcgcgcgcgagagagagagagagagagagcagggctgaagaagttggaggaatcgctgccagtggaaagcggcagcagcagaagcaagaaccagcaagaaagaggggagagaaagccgaaggacttttcctcggattgcatccttcgcttttgagggaaggagaaggaccctctctgtcctcgcggggggcggcaggaggagcagatgttcccgcctggcctgatccaccaccgccctgacgccaccgctcccggcgatgggccaccgcgctccggccccggtgggccgagccttgtactgacggcggaccccaagcccaggctacggtggacggccgacctccacgagcgtttcgtcgacgccgtggcccagctcggcggacccgagaaagcaacaccaaaaactatcttaaggacgatgggtgtcaagggtcttactcttttccacttgaagagtcatcttcagaaatataggttaggtaaacaatctggtaaagaggggtcagagcaatctaaagatgcttcctatcttctagatgctcaaagtggaatgagtgtgtcccctagagttgctgcccaggatatgaaagaaagccaagaagttaaagaagctctgagagcgcagatggaagtgcaacgaaggctgcatgaacaagtggagcaggtccaaaagcgcgtgcagatcagaatggaagcacttgagaagtacatcgacagtatcctagagagcgcatgcaagatggttactgaacaatttgcttcgagtggcttcagtatctccaaccctgatctcccggagatatcccctggaggggtcatgtgtggctccacggacacgttgggctcgtcggtgttgaaccagctttctgtgagctccatcgactcgcacagtccaggaggcaaaccttctccatcaggcatggaaggtccgacactgctccagaaatcgcctgagctcaagcggaggtcctcttgaactgtgacatcgaattctgaggttggtgatgatggctgtctctgtggagtgtctgaatatggtggtgacaagggaaatggtggcccagtcttgtggtagctgactctctctccaggtagcaggacgtgctgtgtttgttgatcaatccaagtatcaaacggacctactatgttcatgtgaacttcctcaagtgctagttaaaaagttttcatgcttctgtcatgagattatgatcctagtagcatccttagcacacttgaaacgttgactcgtgtcctagtgtcgtttgtgttagtccatatgtgaacaatgattcatgttggaacatgctagctaacaccagatgattcaagcccaaaaaaaaaaaaaaaaaagcggtatttttgtctcaattgtccatgcaggcttcccagcacttgctgcaatttattcccagcacttcctgcaatttattcgacttaaaggctactgtatttagctatgaaaggtccatgctgactttgtaatacacaaatggctagttgcaacttanaaaaaaaaaacaaaaaaaaaaaaccataaaatactaaattagcgttacaagat

SEQ ID NO: 2231 - DNA, 1159 bp, Zea mays
  Clone ID: PAT_MRT4577_52981C.1
catcaagtcccaactcccaactcgcactcgcccaacctcgaatgccaagctagcaagagaggcctcgatcgcagaacgaacccagcggcaaagcgagcacgcccgtctacaacgacgcacagatagctctgtccatggcgcccaagaggagcagcgaggagcgcgcggcggcggagcaggagcagccgaggctccgcggcgtgcggaagcggccgtggggcaggtacgcggcggagatccgggaccccgtgcggaaggcgcgcgtgtggctcggcaccttcgacacgcccgagcaggccgcgcgggcctacgacgccgccgcgcgcaggctccgcgggccgcgcgccaccaccaactaccccggcgacgtcgtccgagaagcgccgtgcacggcccctgctctggctgcgagcgcgagcggcagcaccgagtcgtcgtcgtcgtcgtcgtcaagggacgacggccacccgccaccgccgatgcctccggcgccgtcgtcgctcggcctgggcctcgggctcttcccggcgacggtggccacccagccgtgcctgttcctggacccggcgccggtggagagggaggaaggggagcgggagcggagctgctgctcccggtcgccgccgtcggtgctggcgggcctcgggttcgacttcgacctcaacctgcctccgcccgccgagatggtcatgtagcgttggagatagtaattctagcaaaaagggattgtgtagtaaataggaagggcaatcggtttgtgtagtagtagtgtagtactagctagccagtttgcctgtgcactagccactagccaatttgcgacttcgcaatgcaaatcaagaaatcgacgggcaaatatttttctcctgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaggggggcccgttttaagaacccaatgttaccatccttggcatgctacttcataacctttatatagggccacctaaatataatttacttgcccctttttaaaaaacgtgaaactggaaaaaccctggctttacccaatttaatcccctttaaagaaaatcccttt

SEQ ID NO: 2232 - DNA, 1442 bp, Zea mays
  Clone ID: PAT_MRT4577_53153C.1
accgcaccacagtacttctctccagtgtccacagaaacagaattccgctccctccccgtgtcctcctcccgcgcccgcgcatcgtgaggtggagttcccaccccgaggccgcaatggcgacggtggaggtggtggtggccaacggcttgggtggcgccgacaccaagaccgtgtttaaggaaacatacagcaagctcaaggaggagatgctagacgaccccgccttcgagttcaccgacgagtcgctacagtggatcgaccgcatgttggactacaatgtgctcggaggaaagtgcaatcgcgggctctctgtcattgatagctacaggatattgaagggtgttgatgttctgagcaaggaggagacatttcttgcttgcacccttggctggtgcattgaatggcttcaagcttattttcttgtgcttgatgatattatggacaactcccagacacggcgtggccaaccttgctggtttagagtgccacaggttggcctcattgctgtaaatgatgggattatccttcgcaatcatatttcacgaatccttcaacgccacttcaaggggaagccatattatgttgatgtaattgacctattcaatgaggttgagttcaagacagcttcagggcaaatgttggatcttatcactacccacgagggtgaaaaggatctaactaaatataacttgacagttcgccgccacatcgttcagtacaagacagcttattattcattttaccttcctgttgcatgtgccattgctgctggctggtgagaacttggataactttggcgatgtaaagaacattcttgtcgaaatgggaacatactttcaagttcaggatgattatttagattgtttcggtgatcctgaattcattggcaagatcggaactgacattgaagactacaagtgttcctggctagtcgtgcaagctcttgaacacgctgatgagaagcaaaagaacattctgtttgaaagttatggaaagtctgatccagcgtgtgttgcaaaggtgaaggacttgtacaaagagcttaaactggaggaggttttccaggcgtacgagagggagagttacaacaagctgattgccgacatcgaggcccagcccagcaaggcagtccagagtgttttgaagtccttccttcacaagatctacaagagggacaagtaaaaacccagatcgtgaagaagctgctccgtcgacgcttgcatcaaattagtagacttgattgatgcagatgagtaatttgtactatgttgtttcatgttttcattctcctgttgcgtgtactcctgaattataataaaacagagtgctattagggttacgtaaccagcttgtgcgaatgctctacaaacgacagtgctgactgctgagtgttgttagagcaacttcagcgctatatcataaaggattttaagggttttctc

SEQ ID NO: 2233 - DNA, 2693 bp, Zea mays
  UNSURE (1)..(2693): unsure at all n locations
  Clone ID: PAT_MRT4577_53154C.1
  unsure (1)..(2693): unsure at all n locations
ctagagttaaaaaaacacttacagcacgcagttgtcgtcgtcattgtcttcgactcttcgtggcacctcccgtccataaaaataaacgtgtgcccaccaagccgggggctcgcattggcaactgaaccgcaccaggcaccacagtcccgtgcggcagtggcagacgcacagcagatcagcagcgcctccctctgcggctctgcctcttgccaaagccccccacagaattcttctccctccccgtctcctctcgcgctcgcgcgtggtgaggtgaggtggagttccgaccccgaggccgcaatggcgacagcggaggtggtggtggccaacggctcgggcggcgccgacaccaagaccgcgtttaaggagatatacagcaagctcaagcaggagatgctcgaggaccccgccttcgaattcactgacgagtcgctccagtggatcgaccgcatgttggattacaatgtgcttggaggaaagtgcaatcgtgggctatctgttgtcgatagctacaagattttgaagggtgttgacgttctgagcaaggaggagacatttctggcctgcacccttggctggtgtattgaatggcttcaagcttattttcttgtgcttgatgatattatggacaactcccagacacggcgtggccagccttgctggtttagagtgccacaggttggtctcattgcagtaaatgatgggattatccttcgcaatcatatctcacgaatccttcaacgccacttcaaaggaaagccatattatgttgatatcattgacttgttcaacgaggttgagttcaagacagcttcagggcaaatgttggatcttatcactacccacgagggtgaaaaggatctaactaaatataacttgacagttcaccgccgcatcgttcagtacaagacagcttattattcattctaccttcctgttgcatgtgcattgctgctggctggtgagaacttggaaaactttgttgatgtaaagaacattctcgttgaaatgggaacatactttcaagttcaggatgactatctagattgttttggtgatcctgaattcattggcaagatcggaactgacattgaagactacaaatgttcctggctagttgtgcaagctcttgagcgtgctgctgagaaccaaaagagcattctgtttgaaaattacggaaagtctgatccagcgtgtgttgcaaaggtgaaggacttgtacaaagagcttaaactggaggaggttttccatgagtacgagagggagagttacaacaagctgattgccgacatcgaggcccagccgagcaaggcagtccaaactgttttgaagtccttccttcacaagatctacaagagggacaagtagacccagatcgtcgacaagctgctccatcgacgcttgcatcaatcaaattactatacttgattgatgcggacgagtaattgtactatgttgttttgtgttttcattctcctgttgtacggtacaccttaatacggagtataataaagcacagtggtactagggatgcaaagccatcttgtgtcaccattccccnntgccgaattcggcacgagggtaaccaggcactcatctccttgggatatttccagccgccgcccagtcttcgtcttcttccccacgcgcgtcctccctggtgccgagtctctctctgccaatcgcccatggcgcccagccgcttggcctctctggtactcgctctccctcagtgccctggctcctgcttccctcgccggcgcgctccaatcccctgcacgcggagcttctcctctaccggtgctcctccgtgtgcgcgcgctccatctctctcgcgtcgctcggtctgcgcgtccctgcgtccggatcctctccctccagctcggcgcccatccctgccgcgttgccctctctctcatctccaagccgagaccccagccatgaagctccctggagcctcctcaccgggtgcccagccgtagagttcccctgcgcgcggagcttttccctccctgctcggaccgtgttcttggctccagctcagctctgtcttgtgccggcnnnnnnnnnnnnnnnnnnnnnnnnngcgcgcgctggtattcgctcgctgctgcgcgcgctctcccctgcctgcttgtcgtggacacgggtcgctgcccatgccgagctccctgtgcgcacaaccatgtcctttgtatgttgtggccggttcccaactcgcgccgcggttctctcctagccccatgtgcacgcctctgttcatggtcgtggtgaggttgtggcgtggcgacgtcgtgtgcgttgtggcagccgtcctggccacggggcagtccgcgccatagagttcgcccgaccacgacctcactctactcctcgcgtcaatgttcgccgagtcttttcccagtccgcgatctctccctgcccgttgttgcgtccttcgtcatcgtgtcgtgtgtgcagcaacgtgattcctccatagtgcctgtcgacgaacttcgctacatcggtttctcgccttcggttcaggtcatgtatgcacgccgaacgcgttcgccgcttaaccctgtgtcgctagagctcgtgacctcgctgtcatcggagtcctcactgaattcgtgtcctcgccagagctcgcgctaacctgctcgaccatacctcgccagctcgctccagaattatctcgttgtcgtttt

SEQ ID NO: 2234 - DNA, 1271 bp, Zea mays
  Clone ID: PAT_MRT4577_531C.1
cccctcgggtcgacccacgcgtccgcgaaacacaaacgcacaaaagcgaaggccacgcgacgcgagggtgacgactgacgagagggggagagagagaggcgaggaaggagggagagagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcggcacgtactgctggcgatccgcaacgacgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctagctgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcattaggtgctgtttgtaataagattgcaaagatgtgtaaaatttgttttgtgcttccaaaaaaaaaaaaaaaaaaaggaggccagcaccgccgccgacccggtcgatgtcatcgatcttcgaacaagcccccgtctctcaccctccttcctggcctctctctgagtttaaagtttaggcaaacaatgtggtgcatgttttgcaaaatgcctgagttgggttgttcgctgctgctggattaaagccgttcggactactgctgtctgtagaaaaaacagaagccggtggattaaagccgcaacgaacatgcttgtcatttctgttagttgatcactagtactatatagtccatttgggatgattacacaacattatgttggtgttaatgccaactgg

SEQ ID NO: 2235 - DNA, 320 bp, Zea mays
  Clone ID: PAT_MRT4577_53252C.1
cattgggtacctcgaggccggccggggtaccacctccatcaaccaccactaccatcaccgtaaaacgaatcccagaacagtaccgcagcgatagccatggtgctctcgcacgcgagctccggccggaacgacgacgcggtggcctccaccttcgcgtctcgctacgtgcgcaagcggctgccgcgctaccggatgccggagcggttcatccctgcgcaggcgtcgcagcagatcatcagcgtacgagctcatgctggacggctacccgtgcctgaacctgacgtccttcgtcaccacgtggatggagaccgagtgcgaca

SEQ ID NO: 2236 - DNA, 1337 bp, Zea mays
  Clone ID: PAT_MRT4577_53460C.1
aagctattaagaaaaaatttctacctgatctacttcaaaatagcacgactggccgggatttccggccggattgaacgtgcggcccactttcattgagagacgaacacgcgagtagagaatttctcctgcctgctcacgaccgccctctcgccggtcgccggtcgccgctcgcaacgcaagtcggaagaggaatctctccaagctccaatcctccgatcctgccccaacccaagtcccctccaccaggccgcacacctccgccgcccggcgcgaccttgcatccaccagcctgccctctccttcgcgtgaggcggccccggcgaccgcgtcggcagtgcaagaccagaccgaggcttctcccgttggaaggttccagccatggcgagcgccgatctgctgcggaaggaggaggagttctactcctccctctttgattccgcaaaaggcgacggcgtcaagtcgcgctcgcaggtgattgagaggaagattgaatccctcgaggacatggccaccaaggtcagcaaccggagatcaagaagatggttgaacgaccgcttgctgattgagcttgtcccacgccttcatgttgaagaaatcaaaggcctctttgctcctccaccatggggtgaggagctgcccttgtcagcattctgcaggacaagtgttagtgactgggaggccttcaggagcatcgacatggatgctgaggcaagattgatgcaacacatgaaacgatcatccgaaaaacaaaggactcatgtcgacgaagatgaattgattgctctgaatgcttggcgtcgtataggtcgccaaacaagagaagctattaagaaaaaatttctacctgatctacttcaaatatatgaagaacaggttagggccttcattgaaggtactggtgacagcgacgtgcttgtgctgaatgtccaggacccgttccagaggctgcttctgcacggtgtttgtgagttctataacgtaacctcaatgaccacaagcagtgtaagggacgggaagccatggaagagcaccaccatcaagaagaggcatgtcaccggtcttcctccgagaatcacattagttagcttcctgaggatgaggaagaattagtcgtcccagtaacatgtggatgtgagggtcctacactaattcgcctggatgtgtactaaaaagacaaatttgttgctttaggtcgcatctagcatgtaatcaaatgtaaaatatccatgtcaaatgtaaaatacattgcaagaccttgttccagatgaagaaactcaaaagtgtaagcccctacttctatcactgagtctatgaaagaggcttaagccaaattattt

SEQ ID NO: 2237 - DNA, 280 bp, Zea mays
  Clone ID: PAT_MRT4577_5370C.1
acaatacggcaactgaagcacggagtacatacaggatcttacagcactgcttgtgactactgacgaatcctggttcagtgtagttacacatacgagacagcgatacagatgtggcagctaagaccaccggatcctaccaacatacaatattaagaccattgttggcacctatatataaagatggaactgagtcatggtaagatcatcagtgatgatggggagcgcgggagagttgcaagggtgggcaacagatagttaggaagcaaccgggttgggatca

SEQ ID NO: 2238 - DNA, 1576 bp, Zea mays
  Clone ID: PAT_MRT4577_53779C.1
gagggacccctcgagccggccgggaattacacgccaccaccgctcgacctaccagccctccttcctcatccgcctgccctgcccgtcccgtccgtccacccccttcccttctttccccctttgcttgctgctgcctgcttctcgccgtcgccgcctcaattccctcctcgttgtccgtcgcctcgtccacgcgcacctcgtcctcctctccgttccctccacctcctcgaccgcaccgtcgtcgtctagctagcggagcgagctgcgaccagatcggagagccaagcacccaggaagagggggccggggaacaagaagaagccgccggaagccgggcgtggacgtgtggtggttttctgccggcggctgacaagtggtgtaggctacccgctctggccatggatccgtcgggcggcgcgttcctgccgccgctgcagcaagggagctcctccttcccgcggtcctccagcaacgcgtcgctcgccaggagcggcagcggcggcggcggcgttggcgccgggcgcgggaccaggggcaggaagatgatgcgcagggtctgccgcggcgtcatcaccttcatcttcgccatcgctgggctgttcctgggagcggtgaccggcggtctgatcgggctggcgacggagagcgggctgttccgcggcaccgggatcggcgccatcaccggcgcgctcgtctccatcgaggtcgtcgactcctccatccgcctctggcaggcgcgccgatccgggatctggagcatcctctacgtgctgaacgtgatctacagcctcctgacgggcaggctggtgcgcgagaaggtcgacccggcggtgcagcgggtggtccgcagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggctgctccgtctgcctccaggatttccaggtcggggagaaggtgcggagcctgccggactgctggcacgtgttccacgtgccgtgcatcgacggctggctcatcaagcacggctcctgcccgctctgcaggaggaagctgtaggcggatcgaccggacgacgccatggacgatgttcttctctgcgatcgagccgatgatgtgtgtgtgtgtgtgcccgccgccgccaccaccgatagctgctgctaggatcggaggagggaggaggaagaagagactgacatctatagaacccttaatttatagagagggcttttgctttgctacttgtacgtgctctactacgtacctattgcatcttttttttttttgattcaccatgatcgacctccttcctcagatccatccatgcatgtaatataccctggaccggcttgtgcttcgttcgatccattccatgcatctccggactgtgatctcgatctggtgtaatatatataaaaaaactactagtatgtaccatcgcactttggacatctatacatgcatgctggttggtcatattttttttg

SEQ ID NO: 2239 - DNA, 376 bp, Zea mays
  Clone ID: PAT_MRT4577_53816C.1
gggggaaacgtaaacaactaaacatgtaagtaaatcagggttgcatacattttttggggccttggaccacgatcatacacaagcacatgcatacacacacgttttcatacgatagattacgttgccccgcttttttgggcattacacgagggcatacatacgtacgcgcgcacaacacggggggggcttgatatcacttttacacccacgcgttgcacacggggggggaccaccatacgggaggatcaatcagccgaagaagggggggttttttttgccgccggcctcctcgggctccttgggggccttcttcttctcggggggctcgtggaaggggaaacccccggagcccacgggcgcccccgccgggaccctc

SEQ ID NO: 2240 - DNA, 286 bp, Zea mays
  Clone ID: PAT_MRT4577_53953C.1
cttctgctccccctccggttcgggttcgagttcgtgaggttctccggggttcggtttcgtgggtgagctgatcgagatggcgtgcctctgatgttgagtaccgctgcttcgtcggctgcctcaactggaccacggacgaccactccttgcacaactccttcatcacctactgctaggtaacttagtccaagatcatcctatatcgagtgacacagatgtccctcatcttctgcttcgtcaccttatccacagatgatgcgttgcggtacgccttctacgtcatgaa

SEQ ID NO: 2241 - DNA, 276 bp, Zea mays
  UNSURE (1)..(276): unsure at all n locations
  Clone ID: PAT_MRT4577_54029C.1
  unsure (1)..(276): unsure at all n locations
ctagtttcccttggcgngcgtgaccggacgacaggggnaggnaggaaggnaggggtagctatttcggcgagcgagggagcaatccggacaacagcacacgcgtcgatcgccatgccgagaagcggcggcggcggaaatggcggaggtattagcagcagaagtagggtgatgaccaacctcccggacgggatacgcttccaccccacggacgaggatctgatggagcactacctcatgaggcaggccgcctccatgacgagaaacgcccccatcatc

SEQ ID NO: 2242 - DNA, 240 bp, Zea mays
  Clone ID: PAT_MRT4577_54131C.1
cgcgtacgtgggactatattgaaggctcatcacacggcacttctatatcatgggaagaatatagaccctgtgagatcgcaacaggagaaggagaggctggaaaagaggcagcacgaagagaaagcaaggatcgacgcccatgtgaaggctgctgaatcacctgcacaacaaaatgttgaggaagacatgaggatgaacagaacgcacgacaaggatgcacgccgcctggctctacgcatg

SEQ ID NO: 2243 - DNA, 470 bp, Zea mays
  Clone ID: PAT_MRT4577_54283C.1
cccacgcgttcggaccgtcggcgagtacttttactccgagacctatgtggtcaccgcctcgagcgtattcgactacgagaggtacaacatggaggataacgagtacaagcacaagcagcatctcagcgaggccgtcgccatcagacgcggctccttctcactctaccagaaacactaggcgaagaaggacccttagcacgcgcacagtcacaagatcaccgacgacgtcgctgcctctgcggccgtctgcgcctgcggctacgtattccacgagcaccactagatgaagaatgaccacaatgactccgatgaggctagctgcgagaataatcaccaccacctcttcggctgaccgtagtaccggacgtcgcgcgaccgagctagctagctttctcgcacacaaccacacacctgtttaattctgtactgcatgcgtgtgtaatttgatggttcacattaatgagtcccta

SEQ ID NO: 2244 - DNA, 1620 bp, Zea mays
  Clone ID: PAT_MRT4577_54302C.1
ctcgcgattactactgtaatccccaccacaccacctcccggatctcagggtgggtggagtgcttcttggcgacctttctttgcatgtcaacgcagacaaaaagaacagcgccgccgcctccacgaccacgaccacgccggtcgccgagcctccgtctcctcccgagagatctcgcagccagctagccgccgtacgtggccacatggaggcgccgcggccaaacaacggcaggaagcgcaagcccacgcctcccgccggcctgggggccctccacgacgacttgctcgagcgggtcctcgcgcgcctcccgccggccacctacttccgcctgcgcgccgtctgcagccgctggcgcgccgccgcggcgtccccgaccttcctccacgcctgcgctcgcgtcccctcccgggacccgtggttcctcatgctctccgactccgactccgggccccgcccgcccgtcgccttcgacgccgccggccgcagctggaaccgctgccacgccgcgccgggggctgccgtgcccgtggccgcgtcggccggcctcgtcctctaccgcgcgccggccacgggcgcgctcaccgtcgccaacccgctgacaggcgcgtcccgcgcgctcccctcgccgccgcagcaggccgcgcgccagctgcaggccatcgccatgtacggcgccggcggtccctaccgcgtggccctcttcgcgggcgacctccccgacgacctctccatggcggtctacgactcctccagcaactcgtgggaggggcccctgccgctcgcccgcaagcccggggacgactcctgccccgacgcgccggcgcccgacgacacggtctacttcctcagcaagtccggggacgtcgtggccaccaacatgcagcgcagcgcgtctaagcagtactcctcctcagtggtcgtgcgccgcgacggcgacggcgacgccgcctttgcctacttcctcagctactcgggcacagtcgtcgcctgcgacacggcgcgccgcaccttcgcggagctgccccgcatcctccccgtctacttcgagtactccatcgacgtcgtcgcgtgcggcgcagcggcctacgccgtcgtgctttcggaatacctcggcacggccagcctgcgcgtctgggagttcgccgggggcgcgtggcggcaggtggccgccatgccgcccgccatgtcgcacggattccacggcacgcggcccgatatcaactgcgtcggccacggcgaccgcctcatggtttgcgtcacctccgccgaggccaacgcctgcttcatgtgcgacgtggccagcaaccagtgggaggagctgcccaagtacgtcaatgccgacggcgaggccagcgagttcctggccgccttctccttcgagcccagagtggaggtcaccgtataagcgcttatggttatagtgttactacaattaattgctttcttcattaaggcgccttagttttggttcggctcctactccgtgtgattgatttcttcgtgtgtgtgtgtgtgtgcatgtacttacggtaccgaattgtaatgtcatttttcattgacattatttgtcttcaataaaattacagatttcgtgtgcagtccaaaataaaaaaagggcgg

SEQ ID NO: 2245 - DNA, 444 bp, Zea mays
  Clone ID: PAT_MRT4577_54510C.1
ggagggtctggcttctcctccccctcgggtacggattccggttcgcgaggcgatgccgggctcgtgttcgagcgtgagcggatcccgacggcggcgtcggacgttgagtaccgctgcttcgtcggccggcttgcctgggcacggacaccactccgtgcacacgccttcagcacctaccgagaggtcctggagtccaagatcatgctcgatcggtagacgcagacgtcccgcagcttcggcttaggcaccttatgcacggaggaggcgatgcggaacgccatcagagggcatgaacggcaaggaactggacggccgacacatcaccgtcatcgagggccagactgctgctgtcgcggaggcggcggcggtgagtacagaggtggccgtggaggcggcgcctactgctgttgcaggcgcccagatgcctgcagccgatacgggggg

SEQ ID NO: 2246 - DNA, 533 bp, Zea mays
  Clone ID: PAT_MRT4577_54533C.1
attgggtacctcgaggccggccgggttctcatccgtaaactctcaagcctagccgcctcctgcaagttgcagaggtcaggaatctgcgtcatgtcgagtgaaacggagaccttcgcatttcacgctgagatcaaccagctgctctcactcatcatcaacagcttctactccaacaaggagatcttcctccgcgagcttatctccaactcttccgatgtgctggacgagatcaggctcgtgagtctcactgcacaagagcaagctcgatgcgcagtctgagcttatcatccaccttgtcccagacaaggccacgaacacgctctccatcatcgacagcggcgtcggcgtgaccaagtccgaccttgtcaacaacctcggcaccatcgccaggtccgggaccaaggagttcatggaagcccttgctgctggcgctgatgtgtctatgattgggcagttcggtgtcggtttctactctgcctacctcgtcgccgagagggtcgtcgtgaccaccaagcataacgatgacgagcagt

SEQ ID NO: 2247 - DNA, 459 bp, Zea mays
  Clone ID: PAT_MRT4577_54762C.1
aacgccttcagcacctacggcgaggtcctcgagtccaagatcatcctggatcgggagacgcacaggtcccgcggcttcggcttacccaccttctccacagaggaggcgatgcggaacgccatcgagggcatgaacgtgcaaggagctggacggccgcaacatcaccgtcaacgaggcccacccccgccgcagccgtggaggcggcggcagtaggcacagtggtggccgcggaggcggacgatacggcggtggcaggcgccgggatggcggcagatgatactgcggtggcagcagctacggtggcggccgcggctactgcggtggcggcggtggataccgcagtggcaaccgtggctgctgctacgacaactcctgcaggaactggcagaactgagcggacgggcccgctcggccaatttatcctgttcgctaccgagatgttgaccctagtcctgaggg

SEQ ID NO: 2248 - DNA, 1999 bp, Zea mays
  Clone ID: PAT_MRT4577_54782C.1
ctctctatatctaatttctcgtggaggcgagcagatagacaggagagagaacgcacgcaagaacgcgctctcctcgcgattggacagggcgcgaacaccccgaggacgcgcgcgatccccgaggacacgggggtgacagcctcgccgtcgccggggcggccgtttcgagctccgtcccgcctcggcccggctcagatttggtgggatccggccaagaaatcccgcagttggtgaggaggagaggaggggagaggaagggagggcggaggggatgggcgtcggtgcggagcccaaggatcaggcggcgacggccgctggggtgccggcagagcaggacgaggcgggcgggaaggaggacaaggccgccgcggtgtcctgctcgatctgcctcgacgcggtgctcgctgcgtccggggagaggtccaccgccaggctgcactgcggccacgagttccacctagattgcattggatcagcatttaatgccaaaggggttatgcaatgccccaactgccgcaaaatcgagaaagggaattggctttatgcaaatggttctcgatctgcccatgatgttagcatggatgaatgggcccatgatgaagacctttatgatgttagctactcagatatgccatttcgcttccattggtgtccgtttgggcgcttaacccaacttccatctttatttgaggaaggagaatcatcacctccagttacatttcatgacttcatgggacaacatgtgtttacggagcaagtagctgtatctgctgcagcagggacaactaatccttgcccctatgtggcatacttgcatcctcttacaccattgacgtcattgtcaagctcccatgtccctgacagaactacggatcgtcctgcataccatgatcattggaaccccatggctgggccatcagatgttaggtccatgcaaacaatgcaacctgctgattttcatcatagccattgggcacatgtgccccattcttatggtcaacccaacagcaataacgagcagccaggaatcccttttggagcaagggctgtacgggtcgatggtgatagccaacgccgagcatctgttgtctctccatcttacttcagtaatggatctggttccagatctagacctcccaatgttcctcctctgatgcctcagttcatgagggctcatggcagcatcagcgaacagtaccaacagaattcatcatctagcttatttgctggggcccataggtcaggaggcatgcgacctgccccaacacctctaccagagaaccccacctttaccttgttcccgccaggttcatctggccatagctcgatggagactgatgatgctgggggaagccggttctacgcctgggagggtgaccggtttgccccatacccgttgatgccggtagactgcgagacaagctggcggacctcacagcagcagtcccaccagagcacatcagagcctacatctgctccaaggaggctgtttgggcaatggctcgctgtcggcaggccatccccatcacccgaggggtcttcgtatcgtcaattgcactcaccgcggatgtagaccctcgccgctgaaagaaacgatgggaagcccattgtattaagttaagccgggctgtgccgtgaaactttgggacgatgctcgaggggacagaaactggaaacgatccggctgaggatatttcgatttggtttatgtgaattccatctcgtacatatttgaaatcaagttgggatgctgggagcttcgaatgtaacgtgatttcttatgctgcaattctgttgattgacggattttcaaacgcgattgaatttccgttgcaatggtaaaaaaaaaaaaataggcgttacatgttggtgttgtagcatgtgaaggcctacgttccatgcagtttccaacaaagtagaatagaaatttggtgaaacactcgattgcagtggtttggcattcgtaatgttagtaaggcaaaatgttccaatcccgatt

SEQ ID NO: 2249 - DNA, 401 bp, Zea mays
  Clone ID: PAT_MRT4577_55015C.1
tttaccacaaggacgaggatgtcttgcatctgcggatcaagctgcggttgcggctcaagctgcaagtgcgggtaatatataataatatataagtgccccgggcatgattaatttctccagccttcttcttgtctagttaatttggatcgagtagttcaatccatttgcgcgctgtccttttttcagcaagaagtaccctgacctggaggagacgagcaccgccgtgcaggccaccgtcgtcctcggcgtggccccggagaagaaggccgcgcccgagttctttaaggccgcggcggattcctgcaaggccgcccacgcctgcggctgcggtagcgggttgaagtgcgacccctgcaactgttgttacatagaccgacgaccatggttatggatattatcta

SEQ ID NO: 2250 - DNA, 530 bp, Zea mays
  Clone ID: PAT_MRT4577_55137C.1
ggctcactcatttctgggaagccacaaacatcagacaaaaaatttattattgaactataactcataaaaaactaaaaaaggcaccaccaatgatgggttgttggtagaacgctgctgggtttgaaaaagtaagctggttgaatggcagcaattgttgcaggtgtaagagggagccatcgttaggcgcacagtgctggcataacggcaacaactgcggttgtctcaagaaggtagcaaggctcacaccagctagctggctaaatggcagtagttgttgctgctgttaataagcatgagaggacaatgctgccagttggttgaatggaagaaattgatgggggtaggcagcaggtagctggctgaatggcagatggtgccgttgcaaataacaagcagaggtcaatgcagcatagcaggtgtgaatggaagaaactgctgttgctgatagtaggcaacaagggttgctagcacaagatggtgtagttgctgtgccctgatgttttgcgctcataaatgcaccaaaggtaact

SEQ ID NO: 2251 - DNA, 1018 bp, Zea mays
  Clone ID: PAT_MRT4577_55297C.1
gctgttcgaagctttcagccgagcaccatcgtcacagtcagtagccaagcatatttctttctccgagtgatttgcgctgagcgatcagttccagagcgagcggagctgagctgagcgagcttgcgttgcttgagagaccctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcgggcaagggccaggacgccaaggaggccaccaagcagaaggcgtccgacaccggcagctacctgggcaagaagaccgacgaggccaagcacaaggccggcgagacgacggaggccgccaagcacaaggccggcgagacgacggaggccgccaagcagaaggccggcgagacgacggaggccgccaagcagaaggccggcgagacgacggaggccgccaagcagaaggcagccgacgccatggaggccgccaagcagaaggccgccgaggccgggcagtacgccaaggacaccgccgtctccggcaaggacaagtccggcggcgtcatccagcaggccactgagcaggtgaagagcgcggcggcgggcgccaaggacgcggtgatgagcacgctggggatgggcggggacaacaagcagggcgacgccaacaccaacactaacaccaacaccaacaaggactcctctaccatcaccagggatcactagacgctaagacgcgtgtatgcacacgcacttggtccgatcctgtccgtgaccctgtttgcttgttcgcgagtccagtatgggtttgtgcatgttttcagtgtcatggtttccttttctacgaatttggcgttgtaagtttgattcgcaggtacgttgctgtgttttttttgcgtcatcaggtgtctgtaaacgagtcgggcgggtttgagtgtcctttgttgtgataataaagttggtaaatcctaattaatat

SEQ ID NO: 2252 - DNA, 1169 bp, Zea mays
  Clone ID: PAT_MRT4577_55302C.1
aattcgaattcgcacggctgttcgaagctttcagccgcgagcaccatcgtcacagtcagtagccaagcatatttctttctccgagtgatttgcgctgagcgatcagttcatccagagcgagcggagctgagctgagctgagcgagcttgcgttgcttgagagaccctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggccaccaagcagaaggccggcgagacgacggaggcgaccaagcagaaggccggcgagacgacggaggccgccaggcagaaggcagccgacgccatggaggcagccaagcagaaggccgccgaggccgggcagtacgccaaggacaccgccgtctccggcaaggacaagtccggcggcgtcatccagcaggccactgagcaggtgaagagcgcggcggcgggcgccaaggacgcggtgatgagcacgctggggatgggcggggacgacaagcagggcgacgccaacaccaacaccaacaaggactcctctaccatcaccagggatcactagacgcgtgtatgcacacgcacttggtccgatcctgtcgtccgtgaccctgtttgcttgttcgcgagtccagtatgggtttgtgcatgttttcagtgtcatggtttccttttctacgaatttggcgttgtaagtttgattcgcaggtacgttgctgtgttttttctgcgtcatcaagtgtctgtaaacgagtcgggcgggtttgagtgtcctttgttgtgataataaagttggtaaatcgtaattaatatatagcatgcgactgtcttgctatggcctaaaaaaaaaaaaaagcgcaccatccagttcgtggactggtgcccgactggcttcaagtgcggaatcaactaccagcctcccagcgtcgtgcccggcggtgacctgggcaaggtgcagcgtgccgtgtgcatgatc

SEQ ID NO: 2253 - DNA, 1274 bp, Zea mays
  Clone ID: PAT_MRT4577_55304C.1
ccggtattcttgggttttcccacaattcgcacgctgttcgaagctttcagccgagcaccatcgtcacagtcagtagtagccaagcatatttctttctccgagtgatttgcgctgagcgatcagttcatccagagcgagcggagctgagctgagctgagcgagcttgcgttgcttgagagaccctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggccaccaagcagaaggccggcgagacgacggaggccgccaagcagaaggcagccgacgccatggaggccgccaagcagaaggccgccgaggccgggcagtacgccaaggacaccgctgtctccggcaaggacaagtccggcggcgtcatccagcaggccactgagcaggtgaagagcgcggcggcgggcgccaaggacgcggtgatgagcacgctggggatgggcggggacgacaagcagggcgacgccaacaccaacaaggactcctctaccatcaccagggatcactagacgcgtgtatgcacacgcacttggtccgatcctgtcgtccgtgaccctgtttgcttgttcgcgagtccagtatgggtttgtgcatgttttcagtgtcatggtttccttctctacgaaatttggtgttgtaagtttgattcgcaggtacgttgctgtgttttttctgcgtcatcatgtctgtaaacgagtcgggcgggtttgagtgtcctttgttgtgataataaagttggtaaatcgtaattaatatatagcatgcgactgtcttgctataaaaaaaaaaaaaaaaaaaaaaaaaaaaaaaaaaaaaaaaaaaaaaaaaaaaggcaagatttttaccaaccgtcttctaaggctaaaatcatagccaactgaaaaaaccttggggactggaaagcgtttccctttccacgaatttggcgttgtaagtttttttcccaggtgcgtttttttgttttttttgggcccccaaggggctgtaaacaagtcgggcgggtttaagtgccctttgttttgaaaaaaaagttggtaaaccccaatt

SEQ ID NO: 2254 - DNA, 355 bp, Zea mays
  Clone ID: PAT_MRT4577_55326C.1
agacaacttgttcaattgattctggaagagatcgatctacttttgcaccacagggtctaggatgtgttgcaactgcggatcaagctgcgattgctgctcaagctgcaagtgcgggaagaagtaccctaacctggaggagactagcaccgccgagcaggccaccgccgtcctcgtcctggcccgggagaagaaggccgagcccgaattcgtcaaggccgtggctgtttccggcaagggcccccacgcctgcttctgcggtagcagttgcaagtgctacccctgcaactgttgatcacattgatcgacggccatggatatggtttttatctatctagcttggggtggtgggtgaaca

SEQ ID NO: 2255 - DNA, 418 bp, Zea mays
  Clone ID: PAT_MRT4577_55853C.1
tctttttttttttgctgcccctattaccaagtcctactcgggttagggttccttagggatttgtggaggggcaatggcagaggatgatgtcgagtaccgatgctaaaggtgggggcttgactgggacaccagcagcgagtcgctggagaatgcctctgtctactacggagagatcctggactccaaggtcatgaccgaccgcaagacggcgaggagccgcggctatccgcttcggtaccttctactacgagaactccatgctcgacagctatcgagaacatgaacggcagggagctcgacggccgtaacatcagccgtaaccaggcccagtccagaggcggcggcagtggcggcggcggctacggcggcggccgcgggagcggcggctatggaggcgggcgcacgtgacggcggatat

SEQ ID NO: 2256 - DNA, 470 bp, Zea mays
  Clone ID: PAT_MRT4577_55898C.1
ccggccgggagcgcccgtcgcctccctttccccttgcctccctccctctgcccgagtgccggcagacgcactttggccctcaattcgatccctattcgtcctcccgcgaccgagattccctccgacaaacgcggatctgaacgctgcgctccgagtagccgctcgaatgcgacatgaagggggacaaattcaagggcgccgccaaggctgatgccaagctggcggcgaagagtaagagggcggaaaagcccgacaaggacacgaaagggaaggccggcatggaccccaacaagcctaagagggctcccagtgctttctatcggtctatggctgaattgcacaaggagcataaggataagaaccctaagaacaagctgtgatgctgcggaggaaaaagctgctggcgacaggtggaaatacctgagcgagtcgaacaatgatcgctatgtagccaaagctaacaagctcaa

SEQ ID NO: 2257 - DNA, 166 bp, Zea mays
  Clone ID: PAT_MRT4577_55906C.1
gggcacaacaactacaacaacttgagctagctaaccttgctgcctactgtcagacacagcacgttacttccatgtaaccaactagctgcattgagctctgagtgttatgtggaacaagaacaactaccatacatccagctacctgcttgctacaggcaggattgac

SEQ ID NO: 2258 - DNA, 4577 bp, Zea mays
  Clone ID: PAT_MRT4577_55970C.1
ccggccgggacgtccgcccctgccagtttgcgttcgccacccgtccaaaaccccccaaccaaagcccgctccggcagcccccaccccaccatcgcgtcaatggcggcgccgcctgtccagcctgtgccaaccgcggcggcggcggcggcggctgtgaacggggacgcgttccgtctgggcttcgtcggcgcgggcaacctggccgagagcatcgcccgcggcgtggcggcgtcgggcgtcctcccggcctccgccatccgcaccgcgccccaccgccgccccgagcgcggcgaggccttcgcgtccttcggcgcgtgcttgctccaaaccaatgcccatgttgtggacgacagcgatgtgatcgtcatctccgtgaagcctcagatcgtgaagcaagttctacttcagctgaggccacggctgtcagaaaaaaagcttctcgtgtccattgctgccggcatcaagatgcaagatttgcaggattggtctggtcaacgacgtattattagagtaatgcccaacaccccttcagctgttggacaagctgcatcagtcatgtgtttgggagagatggctactcaggatgatgaaaaccgtgtaagaaaactgttcagtgccattggaaaagtctggacagctgaagagaaatattttgatgctgtaactggtctgagtggtagtggcccggcctatatcttcctagcaatagaggccatggctgatggtggagttgctgctgggcttcctcgggaccttgcccttggtcttgcatctcaaacagttcttggtgctgcaactatggtgagccagacaggcaaacatccagggcaactgaaagatcaggttacttctccagcaggtactaccattgccgggattcaggagctcgagaagggcgcattccgtggaacgctgattagtgctgttgttgctgccgcaaaccgctgccgcgaactgtcatttcgaaaactcgagggccgggaggatcgatcaatcagcaccgaccactcgcgacccgattcgaatcgagccagagtcccaggcagcggcggcggcggcgcccgcctccaagaccacctccacccggaccccagccccaaccccaagttaacagatgggggacgttgcgaaggacttgacggctgggaccgtgggaggggctgccaacctcatcgtcgggcacccgttcgacaccatcaaggtcaagctccagagccagcccacccctgctcccggacagctccccaagtacgccggcgccatcgatgctgtgaagcagacggtcgcggctgaaggcccgaggggcctatacaaggggatgggggcacctctggccaccgtagcggccttcaacgctgtcttgttcagtgtcagggggcagatggaggcgtttctcaggtcagagcctggtgtgccgctgacagtgaagcagcaggttgttgcgggcgccggtgctggaatcgcagtctccttcttggcttgtccaacagaactgatcaagtgcaggttgcaagcccagagttccttagccgaggcagccaccgcttctggtgtggctcttcccaaaggtccgatcgacgtggcgaagcatgttgtccgggacgccggcgccaaaggtctcttcaagggcctggtcccgacgatgggacgcgaggtccctggcaacgcactgatgttcggcgtgtacgaagccacgaagcagtacctggccggcggcccggacacgtcgggcctcggcaggggctcccaggtcctggcgggcggcctcgccggcgccgccttctggctgtccgtgtacccgacggacgtggtgaagagcgtgatccaggtggacgattacaagaagcccaagtactccgggtccctcgacgcgctgaggaagatcgtggcggctgatggggtgaagggcctgtacaaggggttcggaccccacccccccgctccaggcgctgtcctgtgcccacggggacgccgggcttcgtcggcgcaacccttgtgacattttgccccctcttcccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccgccgccgccaacggcgacaagtcctcgccggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctacctgtttttttttctctctctctctttttttggcacaagatgcaaaggcaccctgctcctgatcaaagggccttttgcatcataagctgtttgattataattaccatggtgtgtcagtggaacaaataactgttgcaaggtgttaaaaaaaagttgtattgtaatatgatcacctctcttccttgttgttttcaaaaaaaaaaaaaaaaaaaaaaaaagctagcaccagggcaactgcaagatcaggttgatgcaccaagagcaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctacctgtttttttttctctctctctctttttttggcacaagatgcaaaggcaccctgctcctgatcaaagggccttttgcatcataagctgtttgattataattaccatggtgtgtcagtggaacaaataactgttgcaaggtgttaaaaaaaagttgtattgtaatatgatcacctctcttccttgttgttttcgacccgccatggcacgcacgttccagccaatgccgcgacatgcggggcctacgagatcacgagatcggtgctaggttgatttgattggtgctggcctttgctatggccctttgcagtttattcattctccttgcgcggctggagcaacgcgaacaatgccagacaatttttagggaggaaagagagagagaaacttttcacttcaatgatgagattctttaatgaagcaaagcttacttaaaagtttgttcatgtggagccacagagtgagtggttggtgacagataagtaatactggccttgtcgtaatggttggttggcctggcctagagtgggcatccgacggtgatccgatggcgcgcgagtccgactggtggtgcttgtgatggtgagctgtgtggcccatggttttgttggcgtttgggggtgggtggccctcgtcagttcgcattcgggattcccttttgcccccacaattccacgttcgccttggcttctttttcttgttggcctaaattatattctttttctctttcacacacacaaatatattcagtttcccgttcttcctttattagtgccag

SEQ ID NO: 2259 - DNA, 333 bp, Zea mays
  Clone ID: PAT_MRT4577_55983C.1
ttttctttaggatttaacttaaaataaagccggactgtggtaacatcacccatcgatccgcattccatgcttgttgatgcatgggtctgctggaccctatgatgaacacattacttacttctgtcacagagcgaccttcaatcaaaaacacatatgggcaacaacaaactcgagacgaactattataaacactttggactagggtaaacaacacggtagctaacaggataacttggccgtgcgggccccaccgttcatttcctccatttcccgtctgagttgccgtatccgtcgccactgttgccacctccttttccgtcgtcaccaccaccg

SEQ ID NO: 2260 - DNA, 2687 bp, Zea mays
  Clone ID: PAT_MRT4577_56004C.1
cctcggggccgggggggacgtgtctcgctcgttctgcctttttcgtctctcctctgctcttcgccgccggctctccgtctacacctcatcataatcacagagcgctagggaggagagagggggaagagagagggctagggtttcgtgctccctcacgcaacgaatccgagccggatcggggggtgcgcggagtcaccggcggcccggcgttgcctgggctgtgatacagttgcaatggcatctgtaactgatgagacagctaagattgagggtttgacatctgctgcagcctttgtggagggtggcattcaggacgcatgtgatgatgcatgcagcatttgccttgaggctttctgtgagagtgacccttctgcattgactggctgcaaacatgagttccatctccaatgcattcttgaatggtgccagagaagttcacagtgcccaatgtgttggcagcctattactatgaaggatcctaccagtcaggagctgcttgaggcagtagagcgtgagaggaatataagaactaatcaaactcggaacacaactatatttcatcatcctgctcttggggattttgagctgcagcatctgcctgttggtaatgatgctgagcttgaagagcgtatactgcagcatctagctgctgctgctgcaatgggaagggcacaccatcttggaagaagggaggggcacaggggacgatctggctctcatggtcgtccacatttcctagttttctctacacaaccaaattcaccttctgctggcacaatctcttcatcttctgctcatatggagggagaaaatgattcaaatcctgccacacctagagctagcgagtcatctccacgagctattcgcattggagaagtgggaaaccaaagtcctgggatgcttacctacgatgctgaacaggatgctgtcgtttcttccggaaatagcactcctgtatcgagtcctaggttttttaacaggagacactccactggacagtcaactccagacagggctgggccatcggatattcagtctttctcagactccctgaagtcccgcttaaatgccgtctctatgaagtacaaagaatctattacaaagagtactcgagggtggaaggagagattgttttcacgtaattcatccgtggcggatcttggttctgaagtgagaagagaagttaatgctggaattgcgtccgtatcacggatgatggagcgtctggaaactagaggaaatagcagaacaagtgatagcccggcagcatccacttctgaagttccccctgctacagaatcaagcaatgaaagggttacagagagcaactctgctgctgctgctgtgtggtggtggtactaccactacgggtaccagcgctagcaacgcctccgccccttgtgttgcgacatccggttcaaattaggacatgtttgtgagcctggcggcagagcagaagtgcagtaacatgatgccgtcatttttttctcaaccactgcataaacggctgcaaggggaaaaaaaccaaacggtgatttgatgtattggctcgataaaatggtggtgcgtgtggcctaggagaagtcggatttcatcttctgttttcgtctctttgtaaaaaaaatcgtctgagggcagatgtttaccggtataaataacggatatgtcatcttcatagtacgtggatcagttataaatatgattggaacagcaaagcttgctgctgttataaagttgtaccgtggcacgatttcctgttctgttctgtgtgggtgaattgatggattttgctgtacacaagatatgcatctttccaggtctcatgcctatgtatacatatacatattacccaaacctaccttgaatccctcacccctgaagtcccaatgccgactaaaaagaatctattacaaaaatggaaggagagaattcatccgggcgatctttctaatatgctggaacagatggagttaatactataattaatagcgtaacaaggatgatcccggcagcagaaactagaggaaatagcagaacaagtgatagaaacgcagcatccactactgaagtcccctctgctacagaatcaagcaatgaaagggttacagagagcaactctgctgctgctgctgctggtggtggtactaccactacgggtaccagcgctagcaacgcctccgccccttgtgttgcgacatccggttcaaattaggacatgtaagggtctcagaaagaaggcttacacctgcaattcttcatcttcaaaggtttgtgagcctggcggcagagcagaagtgcagtaacatgatgccgtcatttttttctcaaccactgcataaacggctgcaaggggaaaaaaaccaaacggtgatttgatgtattggctcgataaaatggtggtgcgtgtggcctaggagaagtcggatttcatcttctgttttcgtctctttgtaaaaaaaatcgtctgagggcagatgtttaccggtataaataacggatatgtcatcttcatagtacgtggatcagttataaatatgattggaacagcaaagcttgctgctgttataaagttgtaccgtggcacgatttcctgttctgttctgtgtgggtgaattgatggattttgctgtacacaagatatgcatctttccaggtctcatgcctatgtatacatatacatattacac

SEQ ID NO: 2261 - DNA, 2210 bp, Zea mays
  UNSURE (1)..(2210): unsure at all n locations
  Clone ID: PAT_MRT4577_56005C.1
  unsure (1)..(2210): unsure at all n locations
cctcgaggccggccgggctttttcgtctctcctctgcctttccccatcgtctctccgtctacacctcatcataatcacagattcacagagcgctagggaggagagagggctagggtttcgtgctccctcacgcaacgaatccgagccggatcggggggtgcgcggagtcaccggcggcccggcgttgcctgggctgtgatacagttgcaatggcatctgtaactgatgagacagctaagattgagggtttgacatctgctgcagcctttgtggagggtggcattcaggacgcatgtgatgatgcatgcagcatttgccttgaggctttctgtgagagtgacccttctgcattgactggctgcaaacatgagttccatctccaatgcattcttgaatggtgccagagaagttcacagtgcccaatgtgttggcagcctattactatgaaggatcctaccagtcaggagctgcttgaggcagtagagcgcgagaggaatataagaactaatcaaactcggaacacaactatatttcatcatcctgctcttggggattttgagctgcagcatctgcctgttggtaatgatgctgagcttgaagagcgtatactgcagcatctagctgctgctgctgcaatgggaagggcacaccatcttggaagaagggaggggcacaggggacgatctggctctcatggtcgtccacatttcctagttttctctacacaaccaaattcaccttctgctggcacaatctcttcatcttctgctcatatggagggagaaaatgattcaaatcctgccacacctagagctagcgagtcatctccacgagctattcgcattggagaagtgggaaaccaaagtcctgggatgcttacctacgatgctgaacaggatgctgtcgtttcttccggaaatagcactcctgtatcgagtcctaggttttttaacaggagacactccactggacagtcaactccagacagggctgggccatcggatattcagtctttctcagactccctgaagtcccgcttaaatgccgtctctatgaagtacaaagaatctattacaaagagtactcgagggtggaaggagagattgttttcacgtaattcatccgtggcggatcttggttctgaagtgagaagagaagttaatgctggaattgcgtccgtatcacggatgatggagcgtctggaaactagaggaaatagcagaacaagtgatagcccggcagcatccacttctgaagttccccctgctacagaatcaagcaatgaaagggttacagagagcaactctgctgctgctgctggtggtggtggtactaccactacgggtaccagcgctagcaacgcctccgccccttgtgttgcgacatccggttcaaattaggacatgtaagggtctcagaaagaaggcttacacctgcaattcttcatcttcaaaggtaccacatatatcttgtcctggagcttcggttggatgaaactaacaggtgccaaatgttgcaattccaggtttgtgagcctggcggcagagcagaagtgcagtaacatgatgccgtcatttttttctcaccactgcataaacgctgccgggggaaaaaaccaaacggtgatttgatgtattggctcgataaaatggtggtgcgtgtggcctaggagaagtcggatttcttcttctgttttcgtctctttgtaaaaaaaatcgtctgagggcagatgtttaccggtataaataacggatatgtcatcttcatagtacgtggatcagttataaatatgattggaacagcaaagcttgctgctgttataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaacaaacaaaaaaaaaaaaaaaaaaaaaaaaaaaaaaaaaaaaaaaaaaaaaaaaaaaannccccccccccggggggccccccgggaaggaacccaaggttttgagacccaacccaagttggcggctttttgggggggccaatcaaaaaaccccaccggggaaccttccccttttttcccaaaaaacggccccccttttgggagggttttgccccccaatttgcccgggaacaaaatccccaaagggggaaaaccctcccccaaaaaaggccccttt

SEQ ID NO: 2262 - DNA, 344 bp, Zea mays
  UNSURE (1)..(344): unsure at all n locations
  Clone ID: PAT_MRT4577_56006C.1
  unsure (1)..(344): unsure at all n locations
gaattanntcgagggcttctcctccccctccggttctggatcggtttcgacaggntctccggcgttcgggttggggtgttttcagatccagatggcggcccctgatgttgagtaccgctgcttcttcagcagcctcacctgagccacggacgaccactccctccacaacgccttcagcacctactgcgaggtcctcgagtccaagatcatcctcaatcgggagactcataggtcccacaacttccgcttcatcaccttctacaccgatgatgcgatgcggaacgccatcgaaggcatgaacggcaatgagctggacggtcgcatcatcaccgtcaacgaagccc

SEQ ID NO: 2263 - DNA, 741 bp, Zea mays
  Clone ID: PAT_MRT4577_56071C.1
gggtacctcgaggccggccggggtacaccgtcaacgctgagttctagatcgtgatcatctaatccgcgacggggtacaggatgactgccagaacgaccgcaagatgaatgagaggcttgtcggcgtctctgaggataccaccacgggtgttaagaggctctaccacgatgcacgagaccggcgccctcctcttctctgccattaacgtcaacgataccgtcaccaacgagctagtttgactacctgtatgggtgccgccactcgctccctgatggtctgataagcgtcacagacgttatgatcgccggtaaggattgcgtcgagctgcggatacgtcgatgtccacaaaggtagtgccgctgcactgaagtagggtggggcccgggtcattgagacctaaatccacccattatgagccctccaggctctgatggatgtacttcaggtgcttcccttgtgggaggttgtctctgaaactgacatcttcatgaccaccactgtctacaaggatatcctcatggctgagcacatgaggaatatgtcgaatcatgccattggctgcaacagtggtcactttgacaatgagattgatatgctcggacttgagacctagcctgcgcggaagcgcatcaccatcaagccccaaactgaccgctggatgttgcccctagaccaacactgacatcattgtccttgatgagggtcgcctgaagaaccttgggtgagatactggccagccta

SEQ ID NO: 2264 - DNA, 614 bp, Zea mays
  Clone ID: PAT_MRT4577_56090C.1
ttatcatctagcggctctatatttcttctctctctgctcctccgcctccgcctgatccatccaagacagggatcgccatgccggactcggaggagcaccgcttcaaatcgaaggccgacgctggcgcgaccaacacctacccgcaacaagttgggaccgcccggaagaacgggttcatcgtcatcaagaaccgtccctgcaaggatgcggaggtttctacctccaaccactgtcaaccatgaccacgccaaatgacactttgtcaccgtacacatattcaatgcgaaaaagctggaagatattggtccttcatcacacaactgtgacattccgcatgcgaaccgtactgagtatcagctgattgatatatctgaggatggatttgcgatccttcttacttcacatggtaacagtaaagaggatcttagactcccaactgatgagactcttgtggcccaaattaatgaagggatcgaaagctgtaaggatcttgatgtgactgtccagtctgccacgtatgaggagcagatctgcacgttgaaggatgttggcgccgagcaacttccttgcctttggacactataccctactgtatctccactcaaatcggggaa

SEQ ID NO: 2265 - DNA, 2726 bp, Zea mays
  Clone ID: PAT_MRT4577_5615C.1
gggtccctcgaggccggccgggacgaactggcgtgccagtgccagtgccgagcgcccgagcccttactcctcttcttccgaccccccgctggcttggaaaaaaggggaagaaaactcgcgcagtcggtcaccgaagggaggagcgcggtcgaggtgccgcccacacggagctgcgaggtgtttgtaggatctcctaggtgagcccctgctgcttggagacagccatggccaccggcgtggctccagctcctctcccacatgtcagagtgcatcatgggggcgtcgggttcaccaggagcgtcgattttgcgaaggtcttgtctgctcccggtgccggcacgatgagggcaagctcctctagaggcagggcgctcgtggcgaagagctctagtactggctcggagaccatggagctcgagccatcttcagaaggaagcccacttttagtacccaggcagaagtactgtgaatcaacacaccagacaaggaggaggaaaactcgaactgtgatggtggggaatgtgccacttggcagtgatcatcccataaggattcaaaccatgacgacttcagataccaaggatgttgcaaaaacagtagaggaggtgatgaggatagcagataaaggagctgatcttgttagaataacagtccagggtaggaaggaagctgatgcctgctttgagatcaagaacactctggttcagaagaattacaacattccactagtggccgatattcattttgctcctacggtagctctaagggtggcagaatgttttgacaaaattcgtgtgaacccaggaaattttgctgatcgtcgtgctcaatttgaaaagctggaatatactgacgacgactaccaaaaagagctagagcatattgagaaggtgttttctccattagtcgagaaatgcaagcagtatggaagagcaatgcgaataggaacaaatcatggtagtctttctgaccgcataatgagctactatggtgattctccacggggaatggttgagtctgctttggaatttgctagaatatgtcggaagttggacttccacaactttgtattttcgatgaaagctagtaaccctgttatcatggtccaagcatatcgcctgcttgtggcagaaatgtataacctaggatgggattatcccttgcacttgggtgttacagaagctggagagggtgaagatggaaggatgaaatctgctattggcattgggacactgctaatggatggtttgggtgatacaatccgtgtctccctcacagaaccaccagaagaagagattgatccttgccaaaggttggcaaatcttgggacgcaggctgcaaaccttcaaattggggtggccccatttgaagaaaagcacaggcgttattttgatttccagcgtaggagtggtcaattgcctttgcagaaggagggtgaggaagttgactacagaaatgtcctgcatcgtgatggttctgtactgatgtcagtttccctggatcagttgaaggctcctgatctcctttataggtctcttgcagcaaagcttgtggttggcatgcctttcaaggatctggctactgtagattccattcttttgagggagctcccccctgtagaagatgctgaagctaggcttgcactcaaaagattagttgacatcagcatgggcgtgctggcccccttatcggagcagttgacaaagccactcccacatgcaattgtacttgtcaacctcgacgaattgtcaagtggtgcacacaaacttttgccagaaggcactagactagctgtcactcttcgtggtgatgaatcatacgagcagctagatattcttaaggatgttgatgatataacaatgttgttacataatgttccatatggtgaggagaagacaggcagggtgcatgctgctaggaggttatttgagtacttacaggccaatggcttgaacttccctgtaattcatcacataaatttccctgaaaccattgacagagatggtcttgtcattggtgctggggccaacgttggtgctctcttagtcgatggtcttggtgatggtgtattccttgaagctgctgaccaggaatttgagtttctgagggacacatctttcaacttgctccaaggttgcaggatgcgcaacacaaaaactgaatatgtgtcttgtccttcctgcggccgaacactctttgaccttcaggaaatcagcgctgagattagagaaaagacctctcatctgccaggtgtttcgatcgctatcatgggctgtattgtcaatggaccaggagagatggctgatgccgattttgggtacgttggaggcgctcccggaaagatcgacctttacgtcggcaagaccgttgtgcagcgcgccatcgccatggaaggtgccactgacgccttgatccagctgatcaaggaccatggccgatgggtggatcctcctgccgaggagtagggctgtaggctgtagccaagtctgtagtttatatattctgtaaagcgaaacacgcaatgcagtaactgagcatacgatgtacatcatccctacacattttgtacatttattgagatctgagaaataaactagaaaccgtcggtgacggcatgtctgcagcaccccaaatgaagcacatacgatttacatattagtagtagcccatgtgagcaagacataaaaaaaaaaaaaaaaaaggggcggtcgccgactagtgagctc

SEQ ID NO: 2266 - DNA, 762 bp, Zea mays
  Clone ID: PAT_MRT4577_56175C.1
cgtctccaacaaacttcactctgcaaacagtgtggaacagtataaattacagtgccgcattctctattttacacgatccgaagacagtcttaacagtgatagacatgtgatgcggattgtcgtgtggaagatggcacgcggactctcaccaagtcaagagctaaccttatacagaaagcagtggccactgtatatttttttggcaaacaaattcacttgtcactgatggtgcatcaggtcttgtaaatataagcatcaggccaccagctagtacagaacaccaatcacttttccgcgatcgtgtaatcgtgtgccaaggcaagaagcaaccggcatggcaatgcgatcgctgtgcttgccgctgctgttgttctccgtgtccatctcaatcccccccgccgtatcagcaaacgaagagctggcctcgcttctggccttcaaggtggcggcgatcagcggcgggtacggcgacccgcttgcttcgtggaacgagagcagcgccggtggcggtgggtactgtagctgggagggggtgagatgctggggcaagcaccggcaagtggtgaagctgagcctgccctcacgtgggctcacaggcgtcctctcgccagccatcggtaatctgtcatccctatggactctcaacctgagcaacaacgggttccacaacagcatcccggcgagcctcggccgcctgcaacgcctccataacctggacctaagccacaatgccttctctggtaagctccccgccaacctgag

SEQ ID NO: 2267 - DNA, 879 bp, Zea mays
  UNSURE (1)..(879): unsure at all n locations
  Clone ID: PAT_MRT4577_56505C.1
  unsure (1)..(879): unsure at all n locations
cctcggagccggccgggcctgtcaagtgcttatcacttatcatccccatccgcacctctctccatctccctgctcctccgcctccttcttgattcatgcaagccagggatcgacatgtcatgctccgaggaggacgacttccaatgcgaggccgacgccggagcgatgaacacctacccggaggaggatggcaccgcccggaacaacggcttcctcgccatccagaaccgaccctgcaaggctgtggagggtgctacctcaaagactgcaaagtgtgggcgtgccacatgccgctttgctgacctagacatattcgacgggaaaaagcttgaagatattgtgccttcatcacacaactgtgatattccgcatgtgaaccggactgagtaccagctgattgatatataagaggatggatttgtgagccttcttacttcacatgggaacactaaggatgatcttagactcccaactgatgagactcttgtgtgccagatcaaggaagggattgaaagcggataggtatcttgctgtgactgtccatcctgctatggcttaggagcagatatgactgttgaaggatggtgagctcctagtgacttaactggcttgtaatattgtatttacaaacctaaatctaaaaaagaagtgtatcaaggattgctacagagacatccatctggcttgagctggcttttgctatgntaaacactagagtaggacctcgcatgcttgtcgaagcgagactgtattatatgtgtgtacattctggaccctgaattatctatgantttatgccccctactgtttagtattattatcaataatttggtttgggacggttgaatgcaaaaaaaatgaaacaaggccctaaggccc

SEQ ID NO: 2268 - DNA, 1725 bp, Zea mays
  Clone ID: PAT_MRT4577_5661C.1
gacgggctggggttcaggaccgcccagctccattgccaacgcaacagttccgatcctccacaccagcacccgccgccgccgcctcttcccttgcgcacctgctgctgtgcggatcggtgaggcggaggagtaggatggcgagcgcggccggaggcggagcggcgggggaaggggagtggcttaaggtatcccagctcaggcccatggtggaagcgcaggaccccaacgccaaggcagtggacaacctgacgctgcgtcggttcctgcgcgcgcgcgaccacgacgtggacaaggcctccgccatgttcctcaagttcctcaagtggcggagggaggcggcgcccggcggctccgtgccggaggagcaggtgaggagggagctgtcgcaggacaagctgtgcatgggcggcgtcgacagggccggccgccccatcctcgtcgccttcgcggccaggcacttctccgccggccgtgacatggcagagttcaagactgctcttaattgtgcaggttttgttgtctacttcttcgacaagatctgtgccagaatccccagagggcaggagaaattcctctgcatcgttgatctcaagggctgggggtactcaaactgtgacgtccgggcatacattgccgctatagagatcttgcagaactactacccggagcggctcggcaaggcgctgatgatccacgtgccctacatcttcatgaaggcgtggaagatgatctaccccttcatcgacaccaacaccagggacaagttcgtgttcgtggaggacaagagcctgcaggagacgctgcggcgggagatcgacgaggggcagctcccggagttcctcggcggcaagatggacgtgatcccactcaaggactatggcgtgcagcagcagcctcaggccgtgtaatagccatgccatgcgtagcatacacgagttgtggctaggagcatagcatggcaataactgtgtagctgctgtgaaagtgaaaatgaaacgttgcgctgtttagccgggtcaattgaccagcccaactgcagatctctgggctaccactatgaacagcaagaactgtttcccttatccttttcagccaaactaatcaaaccagaaaatgtttcttgtatgactgctaattaaaatgtactcaatgattacaaatgtcgaaaaaaaaaaaaaaaagggggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaagataaggtcgtggggttccaacaagaaaatgcagctccattcgtccctccacctcacccgccggccatctctcgatttctttttgtgtgctcagttttttctttgtgtgtcatgagtttcagaacttgattgggatggtttttgtgccatgagaattagggtttgatagggatgatttgggtatcagttcttacggtcactggaatttgcatattgtcatagtctaatgccattaaattttgagggtagcgatattgttttcaacctattgaatagggtatatgatgatgttggcaagcgctgcaccaggtaatattttgttaaagttttcctaaaaaaaaaacactgccatggcttgagctgggaggatccatacatgcatatggtttttgcttgaaagtatttttctttccttgct

SEQ ID NO: 2269 - DNA, 474 bp, Zea mays
  Clone ID: PAT_MRT4577_56632C.1
tttcggacgcttgggtattatttagaccgactagcatcttagaaagcacaatagtgttccaacaatggcagacaaactattttgcttacttatgctacttggtctttctgcaagtgctgctaccggaaccattttgaccacaatgctcacaagctcctatagcttgctgttttgcaccatacctatcaccagcgttgtcttgagtatgggataacccatttattcaaccctacaggatccatcaagcgataccagcaagcatcttacctttatgacccttgttgctgcaacaacggtcagccctattacaacagttacctttggtggatatgttggcacaaaacatgaaggcacatcaactacaacaactagtgctatgaaaccctgcttgctactctcaggaatcagcagtttctctcatttaaccaactgggtgcatcgaactctgctgcttatttgcaacaacaactacca

SEQ ID NO: 2270 - DNA, 981 bp, Zea mays
  Clone ID: PAT_MRT4577_56642C.1
caggcgcacggctcacgttgtccgcctcacgtaaaggtcggtgccttcgtctcctatctctcctcgcgcagttccacttcccatttcctccttcgtccgcatcagggacacactgccatccgcatgcggcaagatcctccctcattccccaaacatgagaggagcagaggaggagagatctggcgccgccactgatgcgggaggagaggaggagaaacgggagaggagcgtcggcctgatggccggcctcatggacaaggccaagggcttcgtggtggagaaggtgacgcaaatccccaagcccgaggctgcgctggatcacgtctccttccggagcatcagccgcgagggcgtcgagctgcatagccacgtcgacatcagcaacccctactcgcaccgcatccccatctgcgagatcacctacacgttcaagagcgccggcaaggtgatagcgtcgggcacgatgcccgaccccgggtggatcgcggcgagcggcagcaccaagctagacctgccggtgaaggtgccgtacgacttcatcgtgtcgctgatgaaggatctcggaggggactgggacatcgactacatgatggaggtggggctcactgtcgacctccccgccattggcgcctttactatcccgctcaccaccgagggcgagatcaagctccccaccttccgggacctattgttctaagcaattcagatatttggtgtatgaatcgatttgttttcacaccataatcaatgctgatgtggatttgcaaaaaaaaaaaaaaaaaacaggcggccagggactttaaagctaaaactatctccccccaatgtgaaatagaggagtttaagcctcccgtcacaaaaaaatctaacccgatgtagcaaaaaaaaaaaaaaaaaaggggcgggccccgcgctccacctttggtccccccccgcacgccaattcccccttgtcctcaactcgccccccccgcctccccc

SEQ ID NO: 2271 - DNA, 244 bp, Zea mays
  Clone ID: PAT_MRT4577_56806C.1
tttctcggtccgtccggccccgaccccatcgggcagattttccagggccccggggtgtgaatcaagatcacgtccaaccccaccacacgcgcctaccttaacgagcccgactttatgcaaatgctgcgcgaagtgcaaaggaacccctacagcatcagcatgtacctttccgatccccgcatgatgcaggtatctatccttatgcttaatgtcaagatccatataccttatgcctttttaccat

SEQ ID NO: 2272 - DNA, 3952 bp, Zea mays
  Clone ID: PAT_MRT4577_56807C.1
aaaaaaaaaatatccacgtttaatccaaaaagagcatgaagcagcagcaataactggggtttatttcggggccctaaagcagaaaatacagggttttactagaaaggaagaaacgggccccactgatgatcccgagggagatattatataactgcttctctgggtcttgagctaaacagcgcgcacgttggggtcattggcctccaccaaatccgaagccttttttttcgctcttgctctgctctcatgggcaggggatgcccatttacatacttgggtcccattcccattggtgggaattgggaagcgtacatacatccttcccggggttaatgcattgatgaggctgcaacttccggatgctaatttggtttgtctaaataaacatgaattttgtataatctaaaactaagtattactaggcatttgtaatagaaatttgtggtcatattcaggctgtcgctgcacacatatacatgatttcggcacgaggatcgatctcacttagctgctgctggtggtggttggtggcctgggcctggctgctgtgtctgtatcgatgtgtccgtattttctccatctcgtctgcatacgctgcaattggtaaggagctagctggcctttcatgtcttccatgctgccatagccatacggccggccggcaggcaggataccccatcgctcgctgcacatgcatgtatgcatggggatacatgttcatcatcagcagcacagtggctctgtatcccccatcccaatccgatcctatataggaggaggagaaggaggagcagcagcagcagccaggcgcggccggcggccggagtagtatccgaatccgctcaacacccaccggctggtctctagctttcctatcgatcaatggctttcaaaggactcccgcgtgattcccgagggtccctcgaagtcttcaatccagacgcccctgtttcagatcgagcaaccacctccccgtttctcctccctcctgcggtcgcgtcccatcccagcctcctcgccgccggagatggcggcgatgctgacgtgggtcgggcgacacagagggccgccgagtggggcctcgtcctccagaccgacgagcacaccggccgcccccagggtgtcgtcgcccgtccctccggttccaaccgcaccagcgagagtggcaactccatcgacgagagggccgccgccgccggtgctggtagagctctcccccgggtgtcggaggagcttcgcgccgcgctctcagcgttccagcagaccttcgtcgtgtccgatgccacccgccctgaccaccccatcctctacgccagcgctggattcttcaacatgacgggctactcctccaatgaggtcgtcggaaggaactgccgcttccttcaaggttctgggaccgaccccgtagagatttccaagatcagacaggctctcgcagctgggtcaaattactgtggccgtatcctcaactacaagaaggatggtacaccattctggaacctcctaaccgttgcccccataaaggatgaggatggcagggtcctcaagttcattgggatgcaagtggaagtaagtaagtacacggaaggtaacaaagatactgctcttcgtccaaatggattgccagagtcactcatcaaatatgatgcaaggcagaaggatcatgctcgtagctcagtctcggagctcctacttgccctgaaggatccacggtcactgtcagaatcaagaaacaataccttaaaaaggaaatcacaggaatcagcaggttcagctctagttcccggcaagagaagctccgaaactggatcccgtcgtaactcacatagtggaatcagaaactctctacaaaaaatcagtgaagtacctgaaggagggaataagaccaggaaatctggtttgcgttcttttatgggccttattggtatgggacatgggaatgtagagaagaacattctaaaaccaagggaagatcccctacttgatagcgatgatgagagaccagatagcttcgatgacgatttcaggaagaaagaaatgagaaagggcatagatttggctaccacacttgaacgtattgaaaagaattttgtcatcaccgacccgaggttaccagataatccaattatatttgcatcggatagctttttgcgtttgacagagtattgccgcgaagaaatattgggaagaaactgcaggtttcttcaaggacctgaaactgaccgtgggacagtaaagaagataagagatgccatagataaccaaacagaagttactgttcagctgataaattatacaaagagcggtaagaaattctggaacctctttcacttgcagcctatgcgtgatcagaagggtgatgttcaatacttcattggggttcaattggatggaactgagcgtgttcgagaggctgctgcaaaagatggtgccatactggttaagaaaactgcagacaatattgatgaggctgcaaaggagcttccggatgctaatttgagacctgaggatctatgggctaatcactcaaaaccagtcttgccaaagccacatatgaaggatactgcatcgtggagagccatccaaaaggttcttgagaacggtgaaagcattgatttgaaacatttcagaccagtaaggcctttaggatctggtgatactggcagtgtccacttggtggagttgcttggcacaggtgaatactttgccatgaaagctatggataaaagtgtcatgcttaaccgaaacaaggtccatagagctaccgctgaacgacaaatccttgatatgttggaccacccattccttccgacattgtatgcatcatttcagacaaagacacatatatgtcttattgttgactattgtgctggtggggaactctttatgctccttgataggcaacctatgaaggttctgaaggaggatgcggtcaggttctatgctgcagaagtggtcacagcacttgaatacctacattgccaaggtataatctacagagacttaaagccagagaacattttacttcatagagatgggcacatttcattgacagactttgatttgtcttgcttgacatcctgccgaccacaagtgtttcttccacacgatattgataagaagaaaaagaggaggaagagcaggagtaatcccatattttttgctgaaccaatgcgagcatcaaattcttttgttggtacagaggagtacattgcaccggagattattaccggagctggccatacgagtgctgtagattggtgggcgctaggaattcttctatatgagatgttatatggttatacacccttcagagggaaaacaagacaaaggacatttgctaatattctgcacaaggatatcagatttcctgcgagcatacaggtgagcctggcggcaaggcagctgatataccggttgctacaccgagaccctgcaaataggctaggttcctatgagggcgctatggagatcaaacaacaccccttctttcgtggcataaactgggctctagttcgtgccgccacgcccccagagctggaggctcccctccaggatacattggaggccacactgcctcctcctgcagctgatgcggctcacaccgatatgttctgatcatacattgatccatgatgctacatgttaatttgcttaaaggaagaaaaaatattagatgatgaagatgcatgactttggcatagatgagaacaataatgtatgttaaggactaattatcttgatccatctatgcatgctcacaattagaataagattggatgtgtatattgtttctgtggttgcaatatacgcacgagtctatgaagggatctatggaaaaaaaggcttgaggggaaaaaaaaaaaaaaaaaagcggccctaggcatgttgattagtaccccgtttcgttttacaagtcgtttccaacagcttcgtgctgattaaggaaccc

SEQ ID NO: 2273 - DNA, 800 bp, Zea mays
  UNSURE (1)..(800): unsure at all n locations
  Clone ID: PAT_MRT4577_56816C.1
  unsure (1)..(800): unsure at all n locations
accacaccaccactgcaacggacttctcgccagtcgccaacgcagacctcagatctcgctctcgcctccttgcgcagccgtcgtcgagaggagcaagaaaatggcggcgagcaacctcgagggtgtgctcctggggatgggcaacccccttctcgacatctccgccgtcgtcgacgaggccttcctcgctaagtatgatgtcaagccgaacaatgccattctcgccgaggacaagcacttgcccatgtacgatgagttgtccagcaaggaaaatgttgaatacattgctggaggagccacgcagaactctatcagggttgcccaatggatgcttcaaactcctggtgcaacaagttacatgggttgcattggaaaggacaagtatggtgaggagatgaagagcgccgctaaagctgcaggagttactgctcattactatgaggatgaggctgctcctacaggcacatgtgctgtatgtgttgttggtggcgaaaggtcattgattgcaaacttatctgctgcgaactgctacaaatctgagcatctaaagaagccagagaactgggcactagttgagaaagcaaaatacatctacattgctggctttttccttacggtgtcccctgaatctattcagcttgttgctgagcatgctgctgccaataacaaggttttcttgatgaacctctccgctccctttatctgcgagtttttccgtgatgcccaagagaaggttcttccgtatgcggactatatctttggaaatgaaactgangcaaggatcttctctaagtccgagg

SEQ ID NO: 2274 - DNA, 598 bp, Zea mays
  Clone ID: PAT_MRT4577_56889C.1
cggacgcgtgggcggacgcgtgggcggacgcgtgggttctcctcctctcactgctgctgtgaccatcaaggtatcacactgaacccgcagctgcacccactcacccacccaatccgcgaagcactaatacaaagcttacgccatgtccgacactgcaggaaagaccatcacttgcaaagccgccgtagcatgggaggccggcaaggacctcgtggtcgaggacatcgaggttctgcctccacgagctcatgaagtccgcatacaagtctactacactggtgtgtgccacacagatgcgtacatgctgagcggaaaggaccccgagggtgctttcccagtcattgcaggacatgagggcgctggtatcgtcgagagcgtcggcgagggtgtcaccaacgtgaaggttggcgacactgtcgttgccctatacacgccagaatgcaaagagtgcaaattctgcaagtctggcaagaccaacctctgcggcaagattcgcgcaactcaaggaaagggtgtcatgcctgacggcacttcacgcttcaagtgcaagggcaaggacctcctccacttcatgggctgctccaccttctcgcaatac

SEQ ID NO: 2275 - DNA, 236 bp, Zea mays
  UNSURE (1)..(236): unsure at all n locations
  Clone ID: PAT_MRT4577_56932C.1
  unsure (1)..(236): unsure at all n locations
cttcaagcgnannngnctcctcctcgtcgtccggtcgtgannaganatggcgggccgtgnacaaggctatcggcgctggagccgcgaagaaggcaanntcgaggagctccaaggccggactccagttccnagtcggcaggattgcnaggttcctcaaggcggacaagtacgctnagcncgtcggcgccggcgnccccgnntanntcgncgccgtcntcgagnacctcacggcngag

SEQ ID NO: 2276 - DNA, 2002 bp, Zea mays
  Clone ID: PAT_MRT4577_5697C.1
cccggggcacgcccacacagcagcatcaacctcgggtgctctgcggccactggactgccctgccagtgctcggtgcccgtgcccgcgcgcgctagcctagctgctcctgcctggttcgccgtagcccgtagcccgtagcacaacaacaacaaaaaaaatctccgcggcgcggggggaggtggtctgttcaccttggggagcagcggcgggccgtcggccgagaaatgcccggtggcgccttcctcctcaacggcagcggcggcggcatggcggactacggcggcggcctcaccgtccccgtcgtcgtgacctgcctcatggcggcctccggcggcctcatcttcggctacgacattggcatctcaggaggtgtgtcggagatggaggatttcctgaacaagttcttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgacccggcggctggggcggcaggccgtcatgctgatcggcggcggcctgttcttggccggcgccctcgtcaacgccgccgcggccaacatcgccatgctcatcgtcgggaggatgctgctcggcctggggctcggcttctccggccaggccacgccggtgtacctcgccgaggtgtcgcccccgcgctggcgcggcggcttcatctcggccttccccctcttcatcagcgtcgggtacctggtggccaacctcatcaactacggcacctcgcggatcccgggctggggctggcgcctctcgctcggcctcgcctccgtcccggccgccgtcatggtggtcggcgccgcgttcatcccggacacccccagcagcctcgtcctgcgcgggaagcacgacgacgcccgcgccgcgctccagcgggtgcgcggcaagggcgtggacatcggccccgagttcgcggacatcctcgccgcggcggagaacgaccgccggaacgaggagggcgcgttccgccggatcctgcgccgggagtaccggccctacctggtgatggccgtggcgttcccggtgttcctcaacctcacaggggtggccgtcaccgccttcttctcgccgatactgttccggaccgtcggcttcgagagcgacgccgcgctcatgggcgccgtcatcctgggcctcatgaacatcggcggcatcctcgcgtcgggcttcgccatggaccgctacggccggaagctgctcttcatgatcggtggcgcgctcatgttcacgtgccaggtggcgatggcgagcataatcggatcacacctcggcaacgggagcaagatgcccaaggggtacgcggtgacggtgctggtggtggcgctgatcttctcggcgagcttcagctggtcgtggggcgcgctgtactggaccatccccggcgagatataccccgtggaggtgcggtcggcggggcagggcgcggccgtggcgctcaacctggggctcaacttcttgcaggcgcagttcttcctggccatgctgtgctgcttcaagtacggcaccttcctcttctacgcgtcgtggctggttgtcatgaccgccttcgccgtggcgttcgtgccggagaccaagggcgtgccgctcgagtccatggctcacgtcttcgcgcgccactggtactggggcaggttcgtcaaggaccaccagaagttgggcgaagagtccacctagctaagctaataattcggaatcagcgaacgacgtaccctactaccagtagcagattattgataagggagtcaaacacatattgcgtgtgtgtgtcttttaaagtgttcgtttagaatggcttgagaagctcatccgtgtagtaaatttggagacttcgaaatataataaatatgttcgtagttggcaagctataaaaaaaaaaaaaaagcggccagtcgacttgaaattgacatttttaacatttt

SEQ ID NO: 2277 - DNA, 855 bp, Zea mays
  Clone ID: PAT_MRT4577_570C.1
ctctacaaatctacaccatcgaactgcaaagcagagacagcgacagagatccatcttctttctcttcgagttcttggagctagcgaccgacagggacagcgatggcgaccgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaaggggcaaactccggttttccctaggatcttgggccatgaagctggaggcattgttgaaagtgtcggagagggtgtgacggagctagtgccgggcgaccatgtcctcccggtgttcaccggcgagtgcaaagactgtgcccactgcaagtcagaggagagcaacctttgtgacctccttaggatcaacgtggatcgtggcgtgatgatcggggatgggcagtcacgcttcaccatcaacgggaaacccatcttccactttgtcgggacctccaccttcagtgagtacaccgtcattcatgtcggttgcctcgccaagatcaaccctgaggcgccccttgacaaagtttgtgttctcagctgtggtatctcaactggacttggtgctaccctcaatgtcgcgaaaccgaaaaagggttccacggtggccatattcggtcttggagctgtaggccttgctgccatggaaggggccaagatggctggggcagcagggatcatttggtggtggatttgaaccctgcaaaatacgaacaagctaagaaatttggatgcactgactttgtgaacccaagggaccaccaagc

SEQ ID NO: 2278 - DNA, 377 bp, Zea mays
  Clone ID: PAT_MRT4577_57211C.1
ctgacttttgtgcccttcttgctaatagaggctgcctaaacaacatgtatagggtttatggtggtaaacataagtgagtcatctgacctgcagatagagcctatgttcattcctacttcacaagttggcgcaggacgtttcatttacatgtcatttgcagctttgtacaaggacagctactttttatccttgaagctaagggacatcaaaagaatgacgcttcctataaagcttatgtggaactatggttcaagagaactgccgccaaaaactttgttcaagccaccaggtatttgagtggacaacctgtggtcctttttttgaggggggatcatgctttgaatcataccaacggctagaagcttatggccaaatgt

SEQ ID NO: 2279 - DNA, 842 bp, Zea mays
  Clone ID: PAT_MRT4577_572C.1
cgggctcgccaaaatctactagcaacgaaccgcaaagcagaaacagcgacagagatccatctttgtgtctcttcttcaactagcgacagggatggcgactgccgggaaggtgatcaagtgcaaagcggcggtggcatgggaggccgggaagccgctgtcgatcgaggaggtggaggtggcgccgccgcaggccatggaggtgcgcgtcaagatcctctacaccgccctctgccacaccgacgtctacttctgggaagccaagggtcaaactccggttttccctaggatcttgggccatgaagctggaggcatcgtggagagcgtcggagagggcgtgaccgagcttgtgccgggtgaccatgtcctcccagtgttcaccggcgagtgcaaggactgtgcccactgcaagtcagaggagagcaacctttgtgatctcctcaggatcaacgtggatcgtggcgtgatgatcggcgatgggcagtctcgcttcaccatcaacgggaagccgattttccacttcgtcgggacctccaccttcagcgagtacaccgtcatccatgttggttgcctcgcgaagatcaaccccgaggcgcccctcgacaaagtttgtgttctcagctgtggcatctctactggacttggcgccacgctcaatgtcgcaaaaccaaaaaagggttccacggtggcgattttcggtcttggagctgtaggacttgctgccatggaaggggccaggatggcttgggcatcaaggatcattggtgtggatttgaaccctgcaaatacgaacaagctaagaatttggatgcacagactttgtgaacccaaaggacacagtagcc

SEQ ID NO: 2280 - DNA, 282 bp, Zea mays
  Clone ID: PAT_MRT4577_57400C.1
acttcggaacgagggaggagccatgcctaagccaccacccaggccccagctcacctgtttcgtctcttgtcatgcccacgcgctcgcctagctgatagtccgtgcgcattccgcctctatagctggcctgtcgaggaccctggccatcctccccaggcgcaccaccaaacggtcctaacccccagtggcggccgctagagttggacgctcaggtgcgccgggaccgccaccgacaccaggggggatggcagggcaggagcggggggcattcgagccggggga

SEQ ID NO: 2281 - DNA, 415 bp, Zea mays
  Clone ID: PAT_MRT4577_57462C.1
aaacccaacatttacatccattatttgggggtcctggatcctgaacgttggcaccggggaccatgttgggggggggacacggtttcccctgctccttccttttgttctgccatttccttttgaacgccagacctgcaagcatgatcgcttccgaggatcccactgttcccaccccaatagctgtctcgtcctccttgatcggggcgttgaacaggggagcttttatgtttacccaggggttttggggctcaggggggacggggtactcggccatgtcgacctagtttttggtggtggagtccatgatgagcttgtcgcacttgggctccatccacctggggaccaaggaccccaggttcaggcgcgggttggcgtccagcatgagctcggtcctgatgatctgttggaccccctc

SEQ ID NO: 2282 - DNA, 344 bp, Zea mays
  Clone ID: PAT_MRT4577_5758C.1
ggtcaactcgaaaaacaacaaatcttattcataaacaaaatggggtcacagatatttcttcatacgtacatgctcattgggggagacgcagctgaccacctagagctgcatacttacttattcagactgatccagcatgtggcaacatcggaagttcacatgcttacagacgacaaattttcataacaatagcctggcttggctggttcacagaataaccaaacgacatccacgaaattgcgacgatctcaaattaacgactcctaaggagatcggcacccggagcccgttttactcatgaagcacttcggacttcttgtgcatggggttcgctttcttcttcc

SEQ ID NO: 2283 - DNA, 603 bp, Zea mays
  Clone ID: PAT_MRT4577_5760C.1
ccccctcggatttttttttttttttttttttttttttttttttttttttttttttttttttttttttttttttttttttttaaacccaaaaaaacaaattttattcataaacaaaaggggttcacagatttttctccatacgttcatgcccattgggggaaacccagctgaccacctaaagctgcatacttacttattcaaactgacccagcatggggcaacatcggaagttcacatgcttacagacaacaaattttcataacaatagcctggcttggctgcttcacaaaataaccaaacgacacccacgaaattgcgacgatttaaaataaacaactcaaaagcaaatcgaccccaaaagcccgttttactaataaagcactcccgccttttcctccatgggatccgtttcctcctcccagaaaaaaaaattacccagcttgtagcccttcttcataggaggaggagcactctccacgttctcgccgtcaaagcaggggaaaacaaatttgggcgaggtaacaacagcgttttcagcaacacaaaagctctggtacacgaggagcccgcctccaggcagctcctgctccaccatgttgttgc

SEQ ID NO: 2284 - DNA, 521 bp, Zea mays
  Clone ID: PAT_MRT4577_5761C.1
aaactcgaaaaaacaaattttattcataaacaaaaggggttcacagatatttctccatacgtacatgctcattggggtaaacgcagctgaccacctaaagctgcatacttacttattcaaactgacccagcatggggcaacgtcggaagttcacatgcttacagacgacaaattttcataacaatagcttggctgggctgcttcacagaataaccaaacgacaaccacgaaattgcgacgatttaaaataaacaactcaaaagcaaatcgaccccaaaagcccgttttactcataaagcactcccgccttctcctccatggcatccgtttcctcctcccagcataaaaaattagccagttggtagcccttcttcataggaggaggagcactctccacgttctcgcgcggaaagcaggggaaaacagatttgggcgaggtggcaacagggtgttgaggaagacaaaaactctgggacacgaggagcccgcctgcagaggagtgctgctcgcccggtgggggg

SEQ ID NO: 2285 - DNA, 386 bp, Zea mays
  Clone ID: PAT_MRT4577_5765C.1
aacctcgaaaaaaacaaatcttattcataaacaaaatgggttcacagatttttctccatacgttcatgctcattggggtagacccagctgaccacctagagctgcatacttacttattcagactgatccagcatgtggcaacatcggaagttcacatgcttacagaccacaaattttcataacaatagcctggcttggctgcttcacagaataaccaaacgacaaccacgaaattgcgacgatttaaaataaacaactcaaaagcaaatcgaccccaaaagcccgtcttactcataaagcactcccgccttttcctccatgggatccgcttcctcctcccagcaaaaaaaattagcccgcttggagtcctttttcataggaggagg

SEQ ID NO: 2286 - DNA, 396 bp, Zea mays
  Clone ID: PAT_MRT4577_5767C.1
tttttttttttttttttgaatgatttattttttgtgggtttttttttttggtttttttcgaaaaaaaacaaattttattcataaacaaaaggggttcacagatttttttccatacgtacatgcccattgggggagacccagttgaccacctagagctgcttacttacttattcaaactgatccagcttgtggcaacatcggaggttcacatgcttacagacgacaaattttaataacaatagcctggtttggctgtgttacagaataaccaaacgacacccccgaaattgcgacgatttaaaataaacaacttaaaagcaaatcgaccccagaagcccgttttactcataaagcactcccgccttctcctccatggaatccgcttcctcctcccag

SEQ ID NO: 2287 - DNA, 416 bp, Zea mays
  Clone ID: PAT_MRT4577_5768C.1
ggccgcttttttttttttttttttatttgtttttttttttttttttttttttttttttttttttttttttttaaactcgaaaaaaacaaatcttattcataaacaaaatgggttcacagatatttctccataccttcatgcccattgggggagacccagctgaccacctaaagcagcatacttacttgggggggctggtccaacctggggcaacatcggaaggtcacatgcttacaaaccacaaatttttataacaataagcccggcttggctggttcacagaataacccaacgaccaccaccaaattgggacgatttaaaataaacaactcaaaagcaaattgacccccaaagcccgtcttacttattaagcactcccgccttctcctccatgggatacgctttctcctcccaac

SEQ ID NO: 2288 - DNA, 840 bp, Zea mays
  Clone ID: PAT_MRT4577_57694C.1
ggggccgcccctgcccggagcccatcttcactccctcccgatgccctaacccatggttacgactccgacgacgcgaccccggcggcctgctgcccagctccctctgccttcgcgccgtgcctcctaccctcctgaatccgcgccgtgccacccgagtccaggcccccccagggtgcgagggcggcaccggcgcaggcgaaccgcagtccgcgcctccgcactccgccccatccgaagctccgagcacagcaggagcagcaaagcaagcgagcgtcagactggctgaatcgagaggtggaggcagcaaccaacaaggtagcactatgaaggtcaagattcttcagtggcatgcagtggcttcttggacgtgggatgcacaggatgagacatgtggcatatgcaggatggcttttgatggctgctgtcctgactgtaagttccctggtgatgattgcccactcatttggggtgtctgcaaccatgcttatcatcttcactgcatactgaagtgggtcaattctcaaacatccacacccctttgccccatgtgccgtagagagtggcagtttaagggctaaggtactatggacatctagaactgcaccaagcgactctcagttctcagagaagactgatgtttttctggtacttctgtgatgctttattttaactactacatattgttttccgtatctagtataaatcctgatgtcagcgcctgatcctgtgtatgcttccgagcttgtagtggaacaaatgaaattattgcttttcttagggctgatttcctaatcttatcccatattggtttgttcgaaaaaaaaaaaaaaaaaagcggcc

SEQ ID NO: 2289 - DNA, 760 bp, Zea mays
  Clone ID: PAT_MRT4577_57695C.1
caccggcgcaggcgaaccgcagtccgcgcctccgcactccgccccatccgaagctccgagcagagcaggagcagcaaagcaagcgagcgtcaggttagcactctgcagcccaccaggcacaaggccacggctaccgggcgggcactggcgaccgctacctggccgccagcagcgctgtcctccaaccgctattgcgtatctactgtcttccggcttctgcgtctgagcatctcttgtgacggactggctgaatcgagaggtggaggcagcaaccaacaaggtagcactatgaaggtcaagattcttcagtggcatgcagtggcttcttggacgtgggatgcacaggatgagacatgtggcatatgcaggatggcttttgatggctgctgtcctgactgtaagttccctggtgatgattgcccactcatttggggtgtctgcaaccatgcttatcatcttcactgcatactgaagtgggtcaattctcaaacatccacacccctttgccccatgtgccgtagagagtggcagtttaagggctaaggtactatggacatctagaactgcaccaagcgactctcagttctcagagaagactgatgtttttctggtacttctgtgatgctttattttaactactacatattgttttccgtacttagtataaatcctgatgtcagcgcctgatcctgtgtatgcttccaagcttgtagtggaacaaatgaaattattgcttttcttagggctgatttcctaaaaa

SEQ ID NO: 2290 - DNA, 366 bp, Zea mays
  Clone ID: PAT_MRT4577_5769C.1
aaacccgaaaaaacaaagggtggtcataaacaaaagggggtcacagatatttctccatacctacatgctcattggggtagacccagctgaccacctagagctgcatacttacttattcagactgatccagcatgtggcaacgtcggaagttcacatgcttacagacgacaaattttcataacaatagcttggcttggctgcttcacagaataaccaaacgacaaccacgaaattgcgacgatttaaaataaacaactcaaaagcaaatcgaccccagaagcccgttttactcattaagcactcccgccttctcctccatgggatccgcttcctcctcccagcataaaagattagccagtttgtagt

SEQ ID NO: 2291 - DNA, 324 bp, Zea mays
  Clone ID: PAT_MRT4577_5772C.1
aacccgaaaaaaacaaatcttattcataaacaaaatgggttcacagatttttctccataccttcatgcccattgggggagacccagctgaccccctaaagctgcatacttacttattcaaactgatccaccttggggcaacatcggaaggtcacatgcttaccgaccacaaattttcataacaatagcccggcttggctggttcacaaaataaccaaacccccccccccaaattgcgcccttttaaaataaacaactcaaaagcaaatcgcccccaaaagcccgttttactcataaagcactcccgccttttcctccatgggat

SEQ ID NO: 2292 - DNA, 571 bp, Zea mays
  Clone ID: PAT_MRT4577_5774C.1
ggccgcttttttttttttttttttcttttttttttttttttttttttttttttttttttttttttttttttttttttaacccgaaaaaaacaaatcttattcataaacaaaaggggttcacagatatttctccataccttcatgctcattgggggagacccagctgaccacctagagctgcatacttacttattcaaactgatccagcatggggcaacatcggaagttcacatgcttacagaccacaaattttcataacaatagcctggcttggctgcttcacagaatacccaaacgccacccccgaaattgcgacgatttaaaataaacaactcaaaagcaaatcgcccccagaagcccgttttactcataaagcactcccgccttctcctccatgggatccgcttcctcctcccagcagaaaaaattacccagcttgaagccctttttcataggggggggagcactctccacgttttcgccggcaaagcaggggaaaacagattggggcgaggtagcaacagcgtctttagcaccacagaagctttggtccacaaggagcccgcctcca

SEQ ID NO: 2293 - DNA, 446 bp, Zea mays
  Clone ID: PAT_MRT4577_57862C.1
cccacgcatgcagggcaatagaacactcacaaccttactttaaaaacaggcctacatatgctccgcgggctctcttcaaacgctgctacggcgaccatactcccgcaatgctcccaagctcctataactcccctacatcccccttacctctcaccaacatcgcattcgctatgtcaaaacccaattctacaaccctacatgatccatcaagcaatcacaactcacatctatacctttatcacccttgttcctccaacaatcatcaaccctattacatcactaacctttgatgcatctattgtcacaaaacatcaacacacaacaactacaacaactcgacctaacaaaccttgctgcctactctcagcatcagcagattctcacaatcaaccaactatctaccattaactttgattctaatttgcaacaacaacaactaccatcaa

SEQ ID NO: 2294 - DNA, 769 bp, Zea mays
  UNSURE (1)..(769): unsure at all n locations
  Clone ID: PAT_MRT4577_57865C.1
  unsure (1)..(769): unsure at all n locations
actccctcatccctcctggcctaggccgtcctctctctcgtctctcagcgtcacctcgctccagcagcttcgagctcgatctcaagcgaggaaagggcagcagcaatggcggacgcggtggatgcccgtcgggtctgcgggatgccggagaaggcgcagctccacgtggcgatgctggcgctgcagttcggctacgccggcttccacgtcgtgtcgcgcctcgcgctcaacatgggcatcagcaagctcgtcttccccgtctaccgcaacatcatcgcgctcttcctcctcgtccccttcgcctacttcctcgagaagaaggaccggccgaggctcaccctcagcttcgccgtccagttcttcttcctcgccctctgcggcatcaccgccaaccagggcttctacctgctcggcctcgacaacacctcccccaccttcgcctccgccatccagaactccgtgccggccatcaccttcggcatggccgccgcgctccgcatcgagaaggtgcgcctcgaccgccgcgacggcgtcgccaaggtgctgggcacgctcgcgtgcgtcgccggcgcgtccgtcatcacgctctaccagggcccaaccatcttcgcccctgccgacgacaagccgtcgttgcagcaggaggtgccgtttctggcggccgtggccgnggagggcaagaactggacgctggggtgcgtgtacctcatcggccactgcctctcgtggtccggctggctggtgctgcaggcgcccgtgctcaagaagt

SEQ ID NO: 2295 - DNA, 451 bp, Zea mays
  Clone ID: PAT_MRT4577_57880C.1
attccccgtccagccactcgtccatcacattaccaacatacccactttgctaaaccaccttaaaagatatcttaggctcatcaaagaacttttgcatgcactggactcatttgctcaaagtacaacttggttatcacacctataaacttgaaccttttcaatgttaaccttgcaatggcttttacaggcctgtatcatctttcactgaagatcatgcaacattacttatcccatgataaagatgctgcttcacaactgtaatcatatataatgacaacaatcaaagaataactgattgtaaatcctgcatcctatgagtctactcttgattttttttttctgtgcaagcaaacaataacttatctttcatgtttgttttcctgttattctgaaatcttgagcattctaattttaaaatctttccccaaaaataaaaaccaattaaatcatt

SEQ ID NO: 2296 - DNA, 260 bp, Zea mays
  UNSURE (1)..(260): unsure at all n locations
  Clone ID: PAT_MRT4577_57930C.1
  unsure (1)..(260): unsure at all n locations
gttccagccgctggaggagctgctcatccactcgttcccgctgcnctccttcntcanctngccgggctacnacgtnctctaccgcttcatcgagaagcacggcnccgaagccgtggcntacgccgaggcgcacacgacatcggcaagaaggacgccatcaacaacntgctgttcgtgctcggcttcaacgcctncggcggcttntccgtgttcntgcccttcctcgnggccaaggtcggnggcgcccggcgtgcgcgagg

SEQ ID NO: 2297 - DNA, 563 bp, Zea mays
  Clone ID: PAT_MRT4577_57991C.1
gcagcaccaataagcaccatttcttccttaggatcaactgacaacaaatcctgacaggagtcacagcctccatggatccacagtccatgctggttgatgcatgggtcatgctggagccgaggatgaacacagcactaacaactgacaaagagcgaccttgcaatcaaaacacacagatgggcaacaccaaacgatacaaacgaagataaaccctgtggactagggtaaacatcacggaatcaaacaggataacttggccgcccggtccccaccggtaaattcctccagttcccgtcggaattgccgtagccaacgccacggttgacaccgccgtagccttcaccaccaccaccgtatccacctgtcgccaccgtagacggcgacggcaccgtcgtattcgccgccggcatcacggagcccggcaccgacgtagccaccgtcttcacggccaccaccgtaaacgccggcgtcgtcttcactgacggcgcgggactggacctccttgacggtgatgttgcggacgcccaactccttgacgttcatgccctcgatggcgttcctca

SEQ ID NO: 2298 - DNA, 357 bp, Zea mays
  Clone ID: PAT_MRT4577_58107C.1
gcggcggaggctacggaggttgtcgttgcggcggaggttatggtggcgggcgccgtgactgcggttatggtggttgtggctgctacggtggtcggtgcgagggtggtggcggttgctaccgtggctgtggcggctactgtggctggtgcgagggtggtggtggcggctaccgctgtggtggtcgccgttggagggactgatgtgtgggcccattctggcttcggccgagttattttatctatctattgtatcgcgttacccgttcgctttttataccggggttagtgtccgttctaccttttggattacgtgttgggccccctcgttgctcccctttgtctgctcccttttttcaac

SEQ ID NO: 2299 - DNA, 283 bp, Zea mays
  Clone ID: PAT_MRT4577_58174C.1
aaaaaaaaaaacccttttttgttttttacgggggaagcaacaaaatccatttccggggaaaaaaaagcccagcataccttagtttccatcctcctaggactagatcccagtccaagcaaccccgaaatttattattgcactacactacacctccgttacagtacgtgggccctacagtttattacggtccacaagcggttggtggtaacagtaaccacatttggaccctttgccttttttacagtcacgcgggatgcaaagtaaccagccaccggggacagtc

SEQ ID NO: 2300 - DNA, 358 bp, Zea mays
  Clone ID: PAT_MRT4577_58203C.1
acggcgacatagaaagcacaagcctgcgcctacattgtcagccaaaagaagtggccggcttatgcttcttggtctttctgcaagagcagctacaggaaccattttgccgcaaagctcccaagctcctataggttcccttgtttccccgtacctctcaccagcggtgtctttgtgatgggataacccaactcttgaaccctacacgatccaacaagcaatgacagctggcatgttacctttatcaccctagctgctgcaacaatcatcagccctattacatgagttacctttggtgcatttattggctcaaaacatcaaggcacaacaactacaacaacttgtgctaggaaaccttgct

SEQ ID NO: 2301 - DNA, 261 bp, Zea mays
  Clone ID: PAT_MRT4577_58342C.1
acgcggggagccgaacgcttcttgtggccaaagaattacctcccctagccgccgccgtcggtcgtctccctgagaggagccgggaccgacgatgaggccgagttctacgtagagaatcggttttgcttgcctcattccggggtctgctgcgcctggtggtggcgaaggggagaaattcgagagatctgttccggatcaggcgtgcgagctcgggaatcaaggggttgacacatagctgccgcgatttgaatctgatgtacg

SEQ ID NO: 2302 - DNA, 244 bp, Zea mays
  Clone ID: PAT_MRT4577_58516C.1
gcacgagccttcaagcggaagtgcctcctcctcgtcgtccggtcgtgataagatatggctggccgtggaaacgctatcggcgctggacgccgcgaagaaggcaatatcgaggagctccaaggccggactccagttccccgtcggcaggattgctaggttcctcaaggcgggcaagtacgctgagcgcgtcggcgccggcgcccccgtgtacatcgtcgccgtcatcgagtatctcacggctgag

SEQ ID NO: 2303 - DNA, 1397 bp, Zea mays
  UNSURE (1)..(1397): unsure at all n locations
  Clone ID: PAT_MRT4577_58620C.1
  unsure (1)..(1397): unsure at all n locations
aggctcctcccacctctaggccaacaggtgaagccgccgccgctgcagtgtccatagccaccgcaggagactgagattgtgggttttgtcaagacccacaagagcaatgcgtacttcaagcgtttccaggtgaagttcaagagaaggcgcgctggcaagacagactacagggccaggataaggctgattaaccaagacnnnnncaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttccattgtcaagtcaaccaagcagccaccaaaggagcataagaggtacaaccccaagaagctgacatatgagcagaggaaggccagcctcattgaaaggctcaaccaactcaactcctcgggcggcgcagatgacgacgatgaggatgacgagtaaagttaagtcccatcgaagtagtgctatcttatgcggcgatcagcaattgtgcaatggcatatgcggggacctgtagtactgcaataggcagtttggtttaagttttgcgaggtgaacaaaactgtttctgttagtttcgagcttgagctctcaatgtttactctttacattgaaatgctgccgtttggacatggtttatctgagttctacacctgcttgtcttgcttatgtgacggtgcagtattgtgcctttaatatcaacctaaacattgactggttcgtcactgnnnnnnnnnnnnnnnnnnnnnnnnnnnaaatatctcgatggagttgtgtttagatagaagcgtttggaaagaagcgttgagatggtttgggaatgggatatctaataaaattgtgtttagataaag

SEQ ID NO: 2304 - DNA, 495 bp, Zea mays
  Clone ID: PAT_MRT4577_58622C.1
ggtttctatgctgcttacgagtccacagaatggggggtatggtgaagactcataagtccaatgcgtatttcaaacggtagcaagtgaaattcaagagaaggcgggctggcaagacagactacagggccaggataaggctgattaaccaagacagaaacaagtgcaacacacccaaatacagatttgttgagcgatttaccaacaaggacatcactgcccaaatcatatctgctagtatagcgggtgatatggttcttgcttctgcctactcacatgaggtgccacgatatggtcttgaagttggtctgaccaactatgctgctgcctactgcactggccttctgttggctcgccgtgagctcaagatccgcggtttggatcaggagtatgaaggacatgttgaggccactggcgaggacttttgtgttgagccaactgatgagaggagggcatttcgtgctctatcgggatgtggcttatcaggactacaacagg

SEQ ID NO: 2305 - DNA, 1253 bp, Zea mays
  Clone ID: PAT_MRT4577_58623C.1
atggccggatcaacccacgcgtttggtttgccgtcgctgctgcttccgcgtccacagaatggggggtcacgagaggactcataggtccaatgcgtatttcaaacgtttccaagtgaaattcaagagaaggcgggctgtcaggacacactacagggccaggataaggctgattaaccaagacagaaacaagtacaacacacccaaatacagatttgttgtgcgatctaccaacaaggacatcactgcccagatcatatctgctagtatagcgggtgacatggttcttgcttctgactactcgcatgagttgccacgatatggacttgaagttggtctgaccaactatgctgctgcctactgcactggccttctgttggctcgccgtgtgctcaagatccgtggtttggatcaggagtatgagggaaatgttgaggccactggtgaggacttctctgttgagccagctgatgagaggaggccattccgtgctctcttggatgttggccttatcaggactacaacagggaaccgtgtctttggtgccctcaagggagctttggatgggggcctggatattcctcacagcgagaagaggtttgctggatttaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgaggaaattgaagccctgtacaagaaggttcatgctgccatccgtgcagatccttccgttgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtgaagtttagtgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattgaaacgctgtcgtttggacatgttttttctgtgttctacacctgcttgtcttgcttatgtgacggtggagtattgtgcctttaatatcaacctaatcatggactggttcatc

SEQ ID NO: 2306 - DNA, 1330 bp, Zea mays
  Clone ID: PAT_MRT4577_58624C.1
catccgtccaccgggtagggtttctccagaattaaaagggccgaaggaggcgcccttaaaaacccttccattcacccgcagctcccatcctctcgctcgccaggagaagcagccgccgttgctgcttccgcgtccacagaatggggggtttcgtgaagactcataagtccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtatgagggaaatgttgaggccactggtgaggacttctctgttgagccagctgatgagaggaggcctttccgtgctctcttggatgttggccttatcaggactacaacagggaaccgtgtctttggtgccctcaagggagctttggatgggggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgagtacattaagaagggagttgaggctgaggaaattgaagccctgtacaagaaggtccatgctgccatccgtgccgatccttctgttgttaagtcaaccaagcagcccccaaaggagcataagaggtacaaccccaagaagctgacatatgagcagaggaaggccagcctcattgaaaggctcaaccaactcaactcctccggtggtgctgatgacgacgatgaggacgacgagtaaagtttagtgccatcgaagtagtgctttctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacatgttttttctgagttctacacctgcttgtcttgcttatgtgacggtgcagtattgtgcctttaatatcaacctaaacattgactggttt

SEQ ID NO: 2307 - DNA, 1718 bp, Zea mays
  Clone ID: PAT_MRT4577_58626C.1
cccaaaccatttcaacttgatgttaaataagcttttttcaattgacactattcctaaccgaccgcgtatgccatagtttctcgctagctctctaatcttgtgtgcccaaactaaaataaactttgttcaactcggtccaattttaatattataaaagtaaatattcagaactccagctccaaactaacagaaacaactttgttcgcatcgacaaacttaaacaaaaatgcatgttgcacgactacaggtagcgataaatgccatagcacaaatactgatcgccgcataagatagcactacttcgatgggaccaaactttactcgtcatcctcatcgtcgtcatctgcgccgcccgaggagttgagttggttgagcctttcaatgagactggccttcctctgctcgtacgtcagtttcttggggttgtacctcttgtgctcctttggtggctgcttggttgacttgaccacagaaggatcagcacggatggcagcatggaccttcttgtacagagcttccatgtcatcagcctcaattcccttcttaatgtactcactgaagtgagactggtacttctctggctcctcttcagcgaggttcctcatgtagtcagcaacatggccaccatagatgtacttgcgatggatatcagcatccagctgcttgtcatccttcttgaaaccagcaaacctcttctcgctgtgaggaatatccagtccaccatccaaagctcccttgagggcaccaaagacacggttcccagttgtagtcctaataaggccaacatccaagagagcacggaaaggcctcctctcatcagctggctcaacagagaagtcctcaccagtggcctcaacattgccctcatattccttatctaaaccacgggtcttgagcacacggcgagccaacagaaggccagtgcagtaggcagctgcatagttggtcagaccaacttcaagaccatatcgtggcaactcatgcgagtaagcagaagcaagaaccatatcacctgctatactagcagagatgatttgtgctgtgatgtccttgttggtctaaggaggtctagttaagaggtacaatattatgccactggagctcaagtaccatagtaataagcagaaaccagatgattaaagaacaaagaaaacaaatgatgaaggaatcaaaggatacaaatcgcacaacaaatctgtatttgggtgtattgtacttgtttttgtcttggttaatcagccttatcctggccctgtagtctgtcttgccagcgcgccttctcttgaacttcacctggaaacgcttgaagtacgcattggtcttgtgggtcttgacaaaaccccccctggggagataaccgaaaggtacacaaatagttaaacgcacaggtaaggttgagcatgaattctgtcaagtatgcatacaacagacttcactaagttgtcaaccaaaaactattcagtaagtgtcatactcaaacaaagctgcaaatgcatatttatcaagagtcacagctgtgtcaataatatagatgcagtacatatggcgagaacattctaccaatagtccaatacttgtcaaggaaccgtgacaccaaattaagatagctctcatgacacatcaacatcaatagaaagaatccgcaaaattttgcagaggcataaaaacagttatatccattatagtgtacagatctagtaaacataacagagtttttt

SEQ ID NO: 2308 - DNA, 1125 bp, Zea mays
  Clone ID: PAT_MRT4577_58629C.1
cggccgggaaaaacattacaacacacccaaatacagatttgttgtgcgatttgtatcctttgattatttgaccatctggtttctacctattgctatggtactttgagctccagaagcatatattgtatctcttaactagatattcttagaccaacaaggacatcactgcccaaatcatatctgctagtatagcgggtgatatggttcttgcttctgcctactcgcatgagttgccacgatatggtcttgaagttggtctgaccaactatgcagctgcctaccgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacaaaaaaaaaaaaaaaaaagtaaaaaaaaaaaaaaaaaagcggcc

SEQ ID NO: 2309 - DNA, 1365 bp, Zea mays
  Clone ID: PAT_MRT4577_58631C.1
catccgtccaccgggtagggtttctccagaattaaaagggccgaaggaggcgcccttaaaaacccttccattcatcacccgcagctcccatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattgaaatgctgtcgtttggacatgttttttctgagttctacacctgcttgtcttgcttatgtgacggtggagtattgtgcctttaatatcaacctaatcatggactggctaaaaaaaaaaaaaaaaaaggcccctagggcc

SEQ ID NO: 2310 - DNA, 401 bp, Zea mays
  Clone ID: PAT_MRT4577_58700C.1
gcacgcaggcttttccggcaacggttcgactttccaatagctggcgttcttcaggcgtacgtgtcaccatcggtgtcttcgctatgtgaaaacccaattcttcaaccctacacgatccaacaggcaatctcatctgtcattttacctttatcacccttgttcctccaacaatcatcagccctattacagcagcaacctttggtgcatttattgtcacataacataatagcacatcaactacaacatcttgagctagcatacctttatacctactctcagcaacatcaattttttacatttaaccaactatctgcatataactcttgttcttatttgcaacaactactactaccattcaatcagcttcctgttgcctacactcaacaattttttccattaac

SEQ ID NO: 2311 - DNA, 388 bp, Zea mays
  Clone ID: PAT_MRT4577_58744C.1
cggacgcgtgggcgaggaaggagggagtgtgcacggcggcttgatcgaacatggatgccggatcaatggtggtgaagaaggccgctgcggcgcttcgaggcgggggcggccccaagaagaagcctgtctctcgctccgtgaaggcctgcctccaattccccgtaggccgtataggacgctacctcaagcacggtcgctactgccagcgtgtctgcaccggctcacccgtctaccttgctgccgtgctctagtacctcgccgccgagctccttgagttgtcggggaacgcagcgcgggacaacatgaagaaccggatcatgccgcgacacttactgctgtcgatccgcatcgatgaggatctctggaagctactgtccggcttgaccat

SEQ ID NO: 2312 - DNA, 408 bp, Zea mays
  Clone ID: PAT_MRT4577_58840C.1
tttataatttttttttttttttttttttttttttggttttttttaaaattttgagcgggaaaaaaaaacaaattttattcataaacaaaatgggttcacagatatttttccatacgtacatgctcattggggtagacgcagttgaccacctagggctgcatacttacttattcagactgatccagcttggggcaacattggagggttacatgcttacagacgacaaatttttataacaatagcccggcttggctgttttacagaataaccatacgccaaccacgaaattgggacgatttaaaataaacaactcagaagcaaatcgaccccagaagcccgttttacttataaagcacttccgcctttttctacatggaatccgctttctcctcccagcaaagaagatta

SEQ ID NO: 2313 - DNA, 718 bp, Zea mays
  Clone ID: PAT_MRT4577_58945C.1
cttcggatctgtgctgtctctactggcatcgtcacaacctgtattgctcaaattatgaccaatacaattcaaaagaagttcaaagtatcttcaactcagctgctgtaccaatcatgcccataccaagcattgaccctgttcattgttggtccattcctcgatggatttctgactaacaaaaatgtctttgcttttgcatacacacctcaagttctgttcttcatcgtgctgtcgtgtctgatatcagtctcggtgaacttcagcactttccttgtgattgggaagacatctcccgtaacttaccaagtccttggccatctaaagacatgcttggttcttgccttcggctatgtcttgctgcacgatccgtttagctggagaaatatacttggaatcctgattgcagaggttgagatgggactatattcatacttctgcacccgtgaagctccaaagcccactgaagcctctccacaagtcactcaggtgaaggaaggcgaatcagaccctttgatcgcagactccttgaacgccgccgagaatggagctgctgcaaccaccgacgagcctctgaaggtccccatgtggagctccaagtacgcgcgagcatgaacgctgctgctccgacctctgaaggtgcccatgtggagctccaagcgctcgcgggcatgaacgccgcttcggaccttggttcatggtattatatacataattattc

SEQ ID NO: 2314 - DNA, 344 bp, Zea mays
  UNSURE (1)..(344): unsure at all n locations
  Clone ID: PAT_MRT4577_59057C.1
  unsure (1)..(344): unsure at all n locations
acgaagatgtgactgaacaaatcctgccaatctttgtctatagcaccannagcgaatcttaagggtgggcgcctatcatncgcaaagatgatnggccaagnttcaaatgggtcccacgtgatggttattgtcgcagtcgaggttttgtgagcagcaagcaaaggtttgtgtggaccagtgaacccaggtgttctctttcgtgcattctggtctgaggagtgtgtttacgcttgtgatgaaagaacatgagntgtgtagtgttgtgtcgtggtgcatcttggagcgtgcgatgagcatcgtgatgaaaaaacacgcacacggctctattgaagatgtcatgcaaa

SEQ ID NO: 2315 - DNA, 686 bp, Zea mays
  Clone ID: PAT_MRT4577_59249C.1
acttcgcaccgaccgatccgatggaccgcgccggcgtgctcgccgtggtggactcgaggaccgggaagcggtacgaggtcaaggtctcggaggacggcaccgtccgcgccactgacttcaagaagattaccgctggaaaagatgacaagggtcttaagacttatgatcctggttatctcaacactgcccctgtgcgttcttccatctgctacattgatggggatgagggaattcttcgctacaggggttatccaattgaggaggttgctgaaagcagttcgtttgttgaggtcgcctacctcttaatgtatgggaatttgccttctcagagtcaactggcagcctgggggtttgcaatttcacagcactctgctgttcctcaaggactcttggatatcatacaatcaatgcctcatgatgcccaccccatgggtgtccttgccagtgcaatgagcacactttctgtcttccacccagatgcaaaccctgcccttagagggcaagatctgtacaactcaaagcaggttagggataagcaaattgtgcgagttcttgggaaggcaccagcaatagcagctgcagcctacctgagactagcaggaaggcctgccgtccttccttcaaaaaatctttcttattcacagaactcctggatatgctagactctttgggtgaccaaaaatata

SEQ ID NO: 2316 - DNA, 436 bp, Zea mays
  UNSURE (1)..(436): unsure at all n locations
  Clone ID: PAT_MRT4577_59359C.1
  unsure (1)..(436): unsure at all n locations
ccggggttggcttctccttctcctccggttcgggttcnggttcgggaggggcgcggggttcggtttcgtgggtgagcgggtcgagatggcggcgtcggatgttgagtaccgctgcttcgtcggcggcctcgcctgggcgccggacgaccgctccctccgcacgccttcagcacctgcggcggggtcctcgtgtccaagatgcatcctcgctcgggagacgcggaggtcccgcggcttcggcttcgtgcccttctccgcgggggaggcgntgcggaccgccntcgagggcntgaacggcctggagctggacggccgctcatctccgtcttcgtggcccactcccgcggcggccgtggtggcggcggcggcggcgggtacggtggtggccgtggcggcggcggcttctgtggtggcgggcgccgtggtggcggcgggg

SEQ ID NO: 2317 - DNA, 1295 bp, Zea mays
  Clone ID: PAT_MRT4577_59489C.1
ctcgaggccggccgggagggtttccccagagttaaaaggcccggaggaggcgcccctataaacccttcccttctgtcgctgctcccacctctagcccgacaggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacacgcatttttgtttaagtttgtcgatgcgaacaaagttgtttctgttagtttggagctggagttctgaatatttacttttataatattaaaattggaccgagttgaacaaaaaaaaaaaaaaaaaataaaaaaaaaaaaaaaaaagcggcc

SEQ ID NO: 2318 - DNA, 1541 bp, Zea mays
  Clone ID: PAT_MRT4577_59492C.1
ctccaagggctaagtaccttaggtgcgcaacacagaatttgttgtagtgtgaaaagcggatgcctccctcccttttctccccctttgatgaatagtataagcacaggagataccttcacgtctagttcgcttttgactcgattaccctctttgcaaaagaaggcaaacagaatgatgccgtgtggatctccgaggccgccgccgctgcagtgtccatagccaccgcaggagactgagatggggggttttgtcaagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaacccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgacgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgatgacgaggatgacgagtaaagtttcgtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagtcgaacaaagttgtttattttagtttgggcacacaagattagagagctagcgagaaactatgacatacgctatcgggttaggaatagtgtcaattgaagaaaagcttattcaacatcaagttgagatggtttgggaatgaaatatctcgatggagttgtgtttagatagaagcgtttggaaagaagcgttgagatggtttgggaatg

SEQ ID NO: 2319 - DNA, 171 bp, Zea mays
  Clone ID: PAT_MRT4577_59534C.1
acccacgcgtccgggcaaaactgactctgtggcaagcattttctttgcggagaggagaaacaaaaggattggggggtcttttaggcggagtcggcacgtctattatggcactgctgcgttctactatctgctactgagggtgatccgagggctgccatgacggagtacttt

SEQ ID NO: 2320 - DNA, 396 bp, Zea mays
  Clone ID: PAT_MRT4577_59635C.1
cattcccaacccgcaaatccatccacgatcatcacaactttgggggtttcccatcttacaacaacactttcccatcaaccactactcctcttcatcaagatgactggacgcggaaagggcggcaagggcctcggcaagggcggtgccaagcgtcatcgcaagattcttcgcgacaacatccagggtatcaccaagcccgctatccgccgtctggcgcgtcgtggcggtgtcaagcgtatctctgctatgatctacgaggagacccgcggtgttctcaagtccttcctcgagggtgtcatccgtgacgccgtcacctacaccgagcacgccaagcgcaagaccgtcacgtcgctcgacgtcgtctacgccctcaagcgccagggccgcaccctctac

SEQ ID NO: 2321 - DNA, 705 bp, Zea mays
  Clone ID: PAT_MRT4577_59654C.1
gggaccctcgagggcgggcggggcctcactctctttcctttcccatgtacagattcattatggagttctccctcctctgccggcatggcgctctctgtggagaagacctcttctggaccggagtacaaggtacaaggatctctgctagggggacttcggacggctcaagattgagctggccgaggtcgaaatggctctggactcatggcgtgccgcggccagttccgcccgtcgaaggccttcgctggcgctaggatctcggggtctctccacatgaccatccagaccgccgtctctcatcgagaccctcagcgcgttctgcgccgaggtccgctggtgctcctgcaacatcttctccacgcaggaccacggcggcgccgccatcgcgcgagactctgacgacgtgctcgcctgggagggggagaccctcgaggagcactggcggcgcaccgagcgctgcctcgactggggtgaggcgggcggcccccatctcatcgacgacgacggtgtgcgcgccacgctgctcatccacgagggtgtcaaggccgaggaggattacgagaagtacggaaagatccccgatccggagtccaccgacaacgctgagttcaagatcgtgctcaccatcatccgcgacgggctcaaggctgacccccagaagtaccgcaagatgaaggagaggcttgtcggcgtctctgaggagac

SEQ ID NO: 2322 - DNA, 609 bp, Zea mays
  Clone ID: PAT_MRT4577_59729C.1
atacgacaagagtcgggacggtgggcgaggtggcgaagaatgaaaaggagtcgaaagaaaaggggaaggggtcatttgctcttgcatggaccatggatgagagcagtgaagaaagggaacggggtgtgacaatgactgtggctgtggcttatttggagaccaagaaattccgtgtggttttgcttgactcacctggtcacaaagattttgtgccaaatatgatatctggtgcaacacaagctgatgcagctattcttgtcgttgatgcttcaactggttcttttgaagctggcatggatggcgaaggaggaaaaagtgttggccagactaaagagcatgctcagcttgttagaagctttggtgttgaacagcttgttgtcgcagtcaacaagatggatgctgttgattatgcaaaagaaaggtttgatttcatcaagctacaacttggtagtttcctgcggtcatgcaacttcaaggactcagctattaactggattcctcctagtgctgtagaaaaccaaaatttgatccaagctccttcagatgctcgtttgaactcctggtatcaagggttttgcctcctggatgctatagattttctgcagcttc

SEQ ID NO: 2323 - DNA, 1584 bp, Zea mays
  Clone ID: PAT_MRT4577_59850C.1
gaaaaaaaaaagccgaaaaaaaaaaaaaggtagaggctctctggcgccgacggccgacccacacgcgcgtccagcgatttcgccggggggagatcttgccattccgtggagcaccatccgcggtagcctagccgcgactggggatcggggcttgcgggccgtggagccacccagaaggtagccgggaaaagcttgatccggccggggacggggccttcggaggttcgtccctcgatcgggtgtcgtctgcgaaagccgggtcgaacaaatcgtcgcgactggaggcggcgcggggtcatgggggcgtgggtctcggtcctgctcgggatggacggagccgcggcggccgggcctgctgctgtgggcctgggcgacctgccggagctctgcgccgcccaggtgctgctccggctcgacccgccggagatctgcaggctcgcgcaggtcaaccacgcgttccgcggcgccgcgggggctgacttcgtgtgggaagccaagctgccggagaactacaactatctgatggagttcgtggggagcggcgacgaggggaagcggaggcggcggcgggccgggaagaaggagatctacgcgaggctcgccaggcctgtgccttttggcgacggcaagaaggaattctggttggacaagaacaaaggcatgatctgtatggcactgtcgtccaaagcactggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcctgttcgcttccagctatcgacctctgacgggcagcaggcattgtctcagtgctacctggaggagcccgggagctgggtcctgtaccatgctggcgattttgtggcctcaaagcctgaccagctgatgaagctgaagttctccatggcacagatcgactgcacgcacacaaaaggcgggctgtgcatcgactcggttcttatctatccaaaagggaaggggtttcaccaggagagggtggtcaggtctcagaaatgagggttgtagatgttgtggaggtattcacattaggatgttagagcaaatgcagcttgcagcctgatcttatttttactttgggctctagttcgcagcagaggtgaagtgtatgtggttgtagaactcaggtattgtgtggtcaggtgaccaccagagtgctctgtcagtcctttggcaaggtcgttttcgccccccttcagctgaatttggacagcgagatagccatgaaactgtactgaaatgagttcgaaggtgtcattcccagtttctaatttgctttctactgcttagtttcggatgctccctttttcctatttgtcatgatccggtcttgacttggtcaaaaaaaaaaaaaacccccaaaaaaaaaaaaaaaaaaaaaaaaaaaaaaaaaaa

SEQ ID NO: 2324 - DNA, 2011 bp, Zea mays
  Clone ID: PAT_MRT4577_59C.1
ccggccgggaccagggaaggcggcacagccagactagcagatagagaggcggagccgcggaggccagcatatctccctcgttttggtttgcgcccaagcaagcgcctcacgcgagcaccgccgctgccgccgttcactttccccctgaacaccagccgccgccgccgccgccgccgtcgccgccgcatgcacgcacgctgcctctgcacgagcggcaagcggcgatccggcgatcctcgtcgatccccgccctaacgcgctgcggtggtccgtgcagcacaagatgaagttcggcgccacatatgaggagtatctccgggcagagcgggacaaattcctagggcaatgctcccatgtagaatacaaacgcctcaaaaaggtattgaagaaatgtagagttggtcgctcactgcaagcagatggcacaaatggtgatgagcagcaggaggggagagacgaatcttcaaacatttgtgaatgcaactcatgcacattgtgtgatgagatgttctttacagaactcaacaaggaagcatcagaaatagcaggttgtttcagatctagagtacaacgtctcctccatcttcatgttccttcaggactacaacgctgtatatggcgttttaggcagtgtttcatagatgatcagcaaataatggttcaagaaggcagaatgcttctcaattatgtgaccatgaatgctattgctattcgcaaaattctcaagaaatatgacaagatacatggttctgtgagtggcagagatttcaagagcaagatgcaaactgagcatattgaactgttgcagtcaccttggctgatagagcttgctgctttccatcttaactgcgatgattcagatgctgatgaacctagagctggagagttcttcaagaatggattcttcaagaatttttcctgtgacctgagtggagcacagccactactaacaatgaccatttctgaaactctgaagtatgagtacagcctaacttgtccaatttgcttggacactttgttcaacccttatgcgcttagctgtgggcatctgttctgcaaagcctgtgcatgtggtgctgcttctgtctacatcttccagggtgtcaagtcggcacctccggaggccaagtgccctgtctgccgagcggttggtgtgtttgatcgtgctgtgcgtatgactgaactagaattgctcctcaagagaagggacaaagattactttctgcagagactgcgcgaagagcgaagtgtgatggtgaagcaggccaaagaatactgggactcacaggcaatgctatcgatggggatttgaaagctacaatgttcttaccagttcaattgttgtggctaattacatctgaaggttctctggctaattacatattttagttcctggcaagcgtcaatcaattaagttaactgcgctcacataacagaaattgacatagcagaagctgagcccatcgaagaagcaaacaaaatcagttgcattctatcattctccgcctgattcagatttggaagaatcgaacggatttaactaatttctttgttccttccgttctactacaagcttgaaatgacgaaactcatattgtatttacatatctactgattattgggttatttaccctatttactgattgttggtgtgttatttgcctgtaaaagtgaagtcaaatgttgtccagctgccctgaacctcttaagaccatctccaaagttcaacccccacctcatattcagtgtactatggcgacaacggctccaacagttccctatagtgctccttgtctagggctaaaaaaaagctagaggctcgcgagccgactcggactccctcagactcagagaggctcatgagcctaaatgaatttgagccatccgagctgaaacagcgagctaagcctaaacaagtctgatccagtctaatgacacggtgctatattgttacattattacgttattatgttattatttatttttagtggacgaaaaaaaaaaaaaaaaa

SEQ ID NO: 2325 - DNA, 293 bp, Zea mays
  Clone ID: PAT_MRT4577_60029C.1
gccaaaacaaatgtattgataattaatactaaacagggggggcataaaagcttagaaattaccgggcccatattgtaaccacagatattgcagacccggtggatcacccagcgatccctgcacttgggtttgacataccaaatgccagctcaagccagatggatgtgtgtgtagcaatccttgatacacttacttttacgatttagggtgcgagatacagctttccaaggcacaggaagttacttggggccaacatccttcagggcgcaaatatgctcctcccccatagcaga

SEQ ID NO: 2326 - DNA, 273 bp, Zea mays
  Clone ID: PAT_MRT4577_60030C.1
aggacgcgtgggcaggctgcggccggcgggtacggtttgtccacctagtacacggacgccagggtgagggacgtcgcgtccacgggcgagaacgagtacgacgagtacaagaaggaggagatgcagcacatgcacaagcaggaccttggcgaggtcggcaccatcgcacgtgggcgccttcgcactatacgagaagcacgaagcgaagaaagactcggagcacgcgcaccgacacaagatcgaggaggaggtcctggaggaggttgtcgtcag

SEQ ID NO: 2327 - DNA, 291 bp, Zea mays
  Clone ID: PAT_MRT4577_60119C.1
gaaaaggtgatttccttgattgttagtatctacctgtattttccctccttttgggagtgcaggttataatactatttgcttccctctattgccaacctcactacaaaatttcctctttttgtttttttggtacaaagcactttttaattgattcatgtgccagaaaaatgttttttatctacaggactatggtgcctatgagaaaaagcaggccttgtcgaatattcatcagcaggaatccagtcttcagtcaagctttaccgaagtcatagataacacttgtgcatcaat

SEQ ID NO: 2328 - DNA, 150 bp, Zea mays
  UNSURE (1)..(150): unsure at all n locations
  Clone ID: PAT_MRT4577_60194C.1
  unsure (1)..(150): unsure at all n locations
ggctcccactcttccgctcaccggcaccaccaccaaccgagcttctccaggctcctnctcaggaangggagaatatgggagcgcggtgcttgggaantctcatgatgagagaatgggaacaaagatggggcgcggcaagatcgagatcaa

SEQ ID NO: 2329 - DNA, 308 bp, Zea mays
  Clone ID: PAT_MRT4577_60373C.1
gagactacaccacagccacttttgaaggatgactttgaattcaacggaaggaaactaacaaaggctggtgtgagacaaatgatataacgggatattttggagtatcatcgccagatgcttcaggactacatcgaatgtgcagatcacattcacttcctatacccaagtggggttgatcgcgtccaacgacagattgctcatctcgacgagaactacaggagacgagtatctagcagcccgtcgcgaacgcagcccacatcgctgccaagggagcgagtctgctcatcagatcatggtcacagtcacga

SEQ ID NO: 2330 - DNA, 611 bp, Zea mays
  Clone ID: PAT_MRT4577_60466C.1
tcgctcatcctcccagagcttgtctcgacgggggtcctaggagcggcgctggtgctgctgccggcagaggctcggtacggcgtcggaagcggcgagctgcggagaggtgacgttgtcggaggctgcgtacctcgagtacgcaatgcgcagcgcggcgtcgccctccacaagatgctgcagcgggttgagctcgctcaacagacgagcgtcggcgacggaggaccggaaggccacctgcaactgcctcaagagcatgacgggccggctcggaggcggacgcagcatgaccaacgccgccaacatccccggcaagtgcgctgcctccgccggtgtgcccatcagacccaccgacgactgcaccaagatcaactgatctacgctaccatataggaggcagctcgctcgttggatgtcagcgtacgcggccatctgcagcatgcagtgctcgtccaagcagagaggccctagctaccagtgtgtcatcaggctggcacataataaagaagtatatcatgcacctattagtgagcacttcgactgagtgtcactcgtgtcctcgtcgactataccgagtacctcgcacgtgacatggtgtagaacgtactactgta

SEQ ID NO: 2331 - DNA, 492 bp, Zea mays
  Clone ID: PAT_MRT4577_60473C.1
caaaagggaccccaaaattttgatttacatacaggcagcaataattagtaaacgtccaaggccaggcagcacaacggggggcggggcggggtcataaattaggggggtataattctacgtaggagtatcagcgattttgattttaaacgtatcgcccaaactaaccccctgttttgccggccaagccctgacaacaacaaggagccacccccccccccttgttggccaaatcctcctttgcctcccattgccatggaaagctgttaatgttgctgctgctgctgctggggcggctaaggctgcggcggttttttttgcggttgcaaccccccaaacatgggctgccccataataataataataatgcccccggaaccaggccccccgaacccggggtacccgggggaattggcggcccctttgggaaactccccctgctgttgttgctgttgaaaacccaaggccccggcggacccgggggccctttcgccc

SEQ ID NO: 2332 - DNA, 254 bp, Zea mays
  Clone ID: PAT_MRT4577_60532C.1
tccgcaccaccaagaggggccacttgaggctttggtgggacccaaaacaaaacccgacaggacgaacaacaaccatcggaccacaagccatgctggttgatgcacgggctcgcctgagccccggacgaacacaacactaacaactgtcacagaacgaccttgcaatcaaaaacacacaagggcaacaacaaacgggacacacgaagataaaccctctggactagggtaaacatcacagcagcgaacaggataac

SEQ ID NO: 2333 - DNA, 280 bp, Zea mays
  Clone ID: PAT_MRT4577_60548C.1
gatctggcaggaccacaaagcaccatttttttcctttgggtttaacttacaataaagcctggcgggggtaacagcacccatggatccgcacagcatgctggttgatgcctggttctggtgggaccacggatgaacacagcactaacaactgacacagagcgaccttccatcaaaaacacagatgggcaacaacgaacgcgagacgaacgaagataaacactctgggcttgggtaaacaacacgggagccaacatggttacatgggcgcccgggccccacc

SEQ ID NO: 2334 - DNA, 103 bp, Zea mays
  Clone ID: PAT_MRT4577_60573C.1
cccacgcgtccggtctcatgtggctggacctcaatagcaaccgactcagaggcgagatcccgcgacggctcggccggcagctcgggtcgaccccgctcagcgg

SEQ ID NO: 2335 - DNA, 846 bp, Zea mays
  Clone ID: PAT_MRT4577_60636C.1
aaagccctttcgctcgcccgcccgcccgcgccgccgccgccgcctccttccgcaggagctccctcctcgcaggcgcgatggtgtacatcaagaaccagaagacaagggcgtactccaagcgtttccaagtcaagttcaagagaaggcgccaggggaagaccgactacagggccaggctgaggctcacaaaccaggacaagaacaaatacaatacccccaagtaccgttttgttgtgcgatttaccaacaaggatgtcactgcacaaattgtgtatgctaccattgctggtgatattgtgatggccgctgcctactcccatgagttgcctcgctatggtcttgaagttggcctcaccaactatgctgcagcctactgcactggtctgcttttggctcgtcgtgtgctcaagaaccgtgatcttgatgaggagtatgaaggcaatgttgaggccactggtgaggacttctctgttgagccttctgatgagaggaggcctttccgtgcgcttttggatgttggtcttattaggaccaccactggaaaccgtgtgtttggtgcccttaagggagctttggatggtggccttgacattccccacagtgacaagagatttgctggtttcaaaaaggacgagaagtcgctggatgctgagattcaccgcaagtacatctttggagggcatgttgctgactacatgaggtcactagcagatgaggaaccagagaagttccaaactcatttcagtgagtacatcaagaggggaatctcagctgatgacatggaagcagtttacaagaaggttcatgctgccatccgtgctgatcccacatgggcaaatcaccaag

SEQ ID NO: 2336 - DNA, 303 bp, Zea mays
  Clone ID: PAT_MRT4577_60647C.1
cgaactctagacctcgcccgcccaaatacaaaagactcagatctcagtgaccagcgccgccgcgttcgttcgtgtcgaatagagaagagaggaaatggcggcgagcgagggcgtgctcctgaggatagggaaccccctcctcgaatctccgccggtgcacgaggacgccttcctggcaaaaaatgacgtcaagccagaacaatgacatgtctcgctgaagagaagcactcgactatgtatgatgagttggctatcatcagcaacgtcgaatatatagctgcgaggactcacccagaaccctat

SEQ ID NO: 2337 - DNA, 341 bp, Zea mays
  Clone ID: PAT_MRT4577_6075C.1
tcgaactaacaacatagaaagcgcactagtgctccaacaatggcagccaaaatattttgccggcttatgctcctcggtctttctgcaagtgctgctacctcgaccatctttccgcgatgctcacaagctcccatagattaccttcttgcgccgatcctctcaccatcggtgtcttcggtatgtgaaaacccaattcttcaaccctataagatccaacaggctatcgcatctggcatcttacccttatcaccctcggtactccaacaatcatgagacctattacagcacttacctttggtgcatttattggcacattacatcagggctcagcaactactaca

SEQ ID NO: 2338 - DNA, 316 bp, Zea mays
  Clone ID: PAT_MRT4577_60822C.1
ctcctgagaagtcctagacagtcaaacaacgcagcagcaatgctttagaagctccggtgaaacgacgagactacttatcgctagtctcccataccattggattacgggaagatcatatgaaggcaattagaatggacgaacagagcagcatatgtagcccatctacaatgcaagaagactggaaacgctccgatagtaacgggaactcatgtaccagatcattgtcctgatgcatcatctgtttgcctccatcaatatggagatgctgctcgattgctcctcatggagttgttttccttagaccatattgaaaatg

SEQ ID NO: 2339 - DNA, 1917 bp, Zea mays
  Clone ID: PAT_MRT4577_60917C.1
cattgggtacctcgaggccggccgggccgggagcgaatcacgtgacttcccctccccttctcccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaagaaaccagctgctgccattcgtgatgccaatgctgctctagagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcaggaggtgcatctcccagaggctttcctggagggatgcctggtggtggtttccctagagggatgcccggtggaggtttccccgggggtggcatgcctgggggtttccctgggggtggcatgcctggaggtttccctggtggtgttcccggtaatgttgatatgagtaaaatcctgaatgaccctgacctgatggcagcattcagtgacccagaggtcatggcggctttacaagatgtgatgaacaatcctgccaactttgctaagcaccaagcgaatcctaaggtgggccctatcatcgcaaagatgatggccaagttcaatgggtcccagtgatggttatgtcgcagtcaggttttgtgagcagcaagcaaaggtttgttggacagtgaacaggtgttcttttcgtgcatctggtctgggagtgtgtttagcttgtgatgaagaacatgagtgtgtgtgttggtcgtggtgcatctggaggtgcgatgagcatgtgatgaaaaaaaaaaccaaacggctctatggtgatgtatgcaaaaagttgctttcgaacttgatttctcaattcacagatggtttgacagtttcttgaattatagaatgcttgtgtgctgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccttttaaagaaccaaattttacttccccggccttgcaaggtaaaattttttttttagggcccccaaaataaaatcaatggcccgggttttaaaaacggcggacttggaaaacccttgggttacccaaattaaatccctttgaaaaaattccccttt

SEQ ID NO: 2340 - DNA, 469 bp, Zea mays
  UNSURE (1)..(469): unsure at all n locations
  Clone ID: PAT_MRT4577_60944C.1
  unsure (1)..(469): unsure at all n locations
gggaggagnaccacaacgaaacgaaggccgacgacggagcggccaagaccaacccgaaggaggctggcaccgagcggaagaacggcatcatcgtcatcaagaaccgcccctgcaagggtgtggagggtactacctcaaagactggaaagaatggccatgccaaaggccactgggcggccatagacatagtcaaggggaaaaagctcgaagagattgccccttcatcacacaacggagatattccgcatgtgaaccgtactgagtaccagctgagggacatatcagaggatggattcgagagccgtcttacttcagagggcaacactaaggatgagcgtagactcccaactgaagagactcttgaggcccagatcaaggaagggattgaaagaggcaaggatcttgatgtgactgaccagtctgctatgggggaggagcagatctgcgcgctgaaggatggtggccccaa

SEQ ID NO: 2341 - DNA, 2576 bp, Zea mays
  Clone ID: PAT_MRT4577_61009C.1
ccggccgggatttctcgtgtaagtttctattaattattattactacaggctccgtggcttttgcctgtcctgtggcagcgaatcggagagcggaggggaggggaaagcgcagcaacgccggcgagcgagcgggccgttcgaggatcgcaatgtgagcacgagcagggacacacaagatgcttcatcctagctgggtcggtgtctcggcacacgtctcggagtattggtctgtgataatcgccactgttgttttcgcatttgttggcgcggtgacaatttactatacagtcaatcagttgaacaagaacatcagcttgagcctgataagggctatcaaggccagggccaagaggtacaagaaatcgaaggacaaggtgcccgctgcatcccacatctggaggaaagaagttgtctcccgcagcaaaggcctgaaatgctgcgtgtgcttgaagtccgtttcacctcctcagtactctggggggaccatccatcagtgcgatatctgcggggccgctgcgcatccgagctgctcggggaatgcacacaaggattgcaagtgtgtatctatggctggtttgggccatgtgcttcaccagtgggctgtacaatggattgacagcgcggatcactctgaagaagactctttctgttgccactgtgatgaatcttgcaatggagctttccttgcaggctcaccagtttggtactgtatgtggtgtcagcgactggtgcatgttgattgtcacagcagcttggccaaggaaactggtgatatctgtgacttgggaccattgaaacgattgatattatcacctctttgtgttaaggagcttcattggacaggtgctgggattttgagttctatcacaaatggggctaatgaattggcttccagtgtccgagagacaattcggattcgtagtaaaaggtacaaaaggggtagcgcttctgctgattcagatagctctggggctattgagctaccatctgatgctgaaggagattcacaagaagtaaacagcaaagcaaaggtgagggatgatcatgccaattgcaaactcaatgaggtacaccaaagctctgaatcagagaaagataagcaacttgtaccagataacgcagcaacaaccaatatgtcagatgtacaacgtgaaaattctcatgtacagaacaatcagaagtacgaaattatcaatgtgccttctgattctaggccacttctagttttcattaacaagagaagtggggcacagagtggtgattcactgagacagcgtctgcaaattcttcttaatcctgtgcaggttttcgagttgagcaaacagcaaggtccagatgttggtttagctttatttcggaaggtaacccatttcagagttcttgtatgtggtggagatggcactgctggttgggttttggatgccattgagaaacagaagtttgaaaccccgcctcctgtagccatccttccagctggtactggtaatgatcttgcgagggttttatgttggggtggtggccttggtgttattgagaagcggggaggtctattctcagttttgcaagatgtagagcatgctgcagtcactgttcttgacagatggaagatcacaataaaggacaaccaagggaaacttatgagaccaccaaaatttatgaacaactactttggggttggctgtgatgcaaaggttgccttagatatacacaacctgagggaagagaaccctgaacggttttatagccagtttatgaacaaggtgctgtatgcaagagagggagcaaagaacataatggataacacatttgattgttttccttgggatgtcaagcttgagatagatggatccaaaattgatattcctcaggactccgaaggtatccttgttgccaatatcaggagttacatgggaggggttgacctttggaagaacgaggatgatgtctctgacacttacctccctcagtccatgcatgacaagaagctggaagttgttagcttcacaggaatgctgcatctcgggaaactgcaggttgggctttctcgtgcaaaaagattagcccaaggccatcatataaaggttgaagtcagtactacaatgccgatccaagttgatggagagccatggtcccaggagccgggaaccatagaggtttctcatcatagccaggccttcatgcttaagagagtctccgaagaaccgctgggtcatgccgcttcggtaatggccgacatcttggaaaacgctgagagcagtggcattatctcagccttgcagaagaggactttgctccaggagatagcgtctaggcttttgtaggacacagttctaacgccagtagttgtgtgtagctcaccctatagctctctcacgtcttcagcagccagaggcttgcttctgggctactagagaattgcgcctggtcgttgtacatacaccatcatggtattttaccctgattcggattgtgttgtgtatgattctgtaaaattttgtacaccctattgggtgagcacacactgacactgttgcggtcggaaattctggtaccagttgtctggattgctgaaactt

SEQ ID NO: 2342 - DNA, 538 bp, Zea mays
  Clone ID: PAT_MRT4577_61277C.1
tcccctcctcttttctcgtttagaacctctaaaatttcccctcctcgccagtcgcagcagcacctgtagcagccatggacgccagcggagccggtagcaaggcgaacaacggggcagccgggcgcaaggcacgccccccctgcaataagtccgtgaccccctccgtaaaggacgggatgcagttccccgttagccggatcgggagctacctcaataagggcggtacgcgccgcgcgtgggcactgccgcccccgtctacctcgccgccgttctggagtacctcttcgccgaggttctggagttggcacggaacccggcccaagacaaccagaagacgcgcatcatcccgcgccacgtgctcctggcgatccgcaacgacaatgacctcgccacgctgctggccggcgtcccatcgcgcacggtggcgtcctccccaaacattccactccgtcctcctgcccaataatgcgtcgcataatgcggccatcggtgttagcaaggagcctaagttccccaaagaagggcgccaagtccccca

SEQ ID NO: 2343 - DNA, 3162 bp, Zea mays
  Clone ID: PAT_MRT4577_61285C.1
gagacggaagccaagcctccaagggggccgtcgcagaactcgcgccaccgcccgccatggcttcgtcatctaaggcctccgactcctcctcccaacgatccaagcggtcggatcaagggacgggcagggaagccgctcccgcctctgttgtcccgatccacgggaacctgacgcagttgatacgccaaatcaaatcgaggcgcctcttgtacatcaaggagaaattggaggcgaacaggaagacgctgcagaggcactcctgcgcgctgttcgacgtggcagcggcggcggaggtggcgtcgaggggcagcgatggcggcaacgctttgtcgcagcgagcggcggagggacagttcaggctcgctgggtcagacctggcacacgggataggggagagggacgtggtgtacatgcaggaggagaacctggcgtccgggacgctcgtgctctccagctcgggcgctgccgcgcagcggacagtcgtgcggttcgtgaagctgccgttggttgagaggatccctccgtacaccacttggatcttcctggacaaaaatcaaagaatggctgatgatcagtcagttgttggtaggagaagaatttactatgatccagtcggaaacgaggctctgatctgcagtgacagcgatgaagaaattccagaaccagaggaagagaaacactttttcacagagggagaagatcaattgatatggagagctactcaagagcatgggttaaaccgagaggttgttaatgtcctctgccagtttattgattcaactccatcagaaattgaggaaagatctgaagtcctatttgagaaaaatgagaaaaactctggatcttcagataagatagagaggcaactttctcttgacaaaactatggatgccgttctggattcttttgataatctcttctgccgcagatgcttggtttttgattgtcgcctccatggttgctcacagaatttggtattcccaactgagaagcaaccctacagctttgagcctgatgaaaacaagaagccatgtggtcgtcagtgctaccttcgatggagaggaggatttcaagagattcatgatgttggtcttagtggctgtgcaacatataatatggaatcaggaactgtctcacacaaagttgatgttagtattatgtctgaatcagaagattcaaaccgtgagaaaggcaacattaggtccatgacactagttggaaccagtggatcaaaaataatttcttctgttagtgctgaagaaagcactactccgccttcagcagatacctctgaaacagagaatgcatcctctgatatgcctcccagtagtttaaggaaatacaagatttcaaaacgtggacctaggtacagggagcgttctcctggcaaaaggcagaaggtttttacttatgacatttcttttgcaagcaatatactgaataaactttcgattccggagattcgcgacacaagactagagtctagagaacctggaggtgataaactacaaattcttgacgagtccactaagaaaacttcaagcaaagatatctgtggagaaagcccaattactactactgaaaatgtgggaagagagagtaaaaaagtatcttcaacaaagaatttcttggagcacactctttcatgttggagtgccttagagcgagatctatacttgaagggcatagagatatttggaaagaacagctgtctcattgccagaaacttactatctggtatgaagacctgcatggaagtggccaactacatgtataacaatggtgcagcaatggcgaagagacctctcttgaataaatccatctcaggcgactttgcagaaactgaacaagactacatggagcaagacatggttgccagaacaagaatctatcgtcggaggggccgcaatcgaaagctgaaatatacttggaagtctgcagggcatccaactgttagaaaaagaattggtgatgggaagcaatggtacacacaatataacccatgcgtgtgccagcaaatgtgtggtaaagattgcccctgtgtggaaaatggaacttgctgcgaaaagtactgtgggtgttcgaagagctgcaaaaacaagtttagaggctgtcattgtgcaaaaagtcaatgcagaagcagacagtgcccctgttttgcagccagtcgtgaatgtgatccagatgtttgtaggaattgttgggtgagctgtggagatggttcactaggtgagccacctgccagaggtgatggttatcagtgtggaaatatgaagctccttttgaaacaacaacaaaggattttgttaggaagatctgatgttgcaggttggggtgcattcatcaagaatcctgtaaataaaaatgattatcttggagaatatactggtgaattgatctctcacaaggaagcagacaaacgtggcaaaatttatgaccgggcaaactcatcatttctgtttgatttaaatgaccagtatgtgttggatgcttatcgcaagggggacaaattaaagtttgcaaatcactcatctaaccccaactgctatgcaaaggtgatgctggtggctggcgaccatcgggttggtatctatgcgaaggagcatattgaggctagtgaggaactcttctatgattatcgttatgggcctgaccaggctccagcttgggctaggagacccgaagggtcaaagaaggacgaagcatccgtctctcaccatcgagcacacaaagttgctcgatagctgaagagcagctccggatgatacaatatgcagtaaattatatatttaatacatgatttagtcctagttcattatacgaggacttcgttggtagataagcatattgtatattcattagtgaataaactcccatacatcaagttggggaataagtgcatataaatattttttaccttaggtcggaaggtgacaaactgacaaccttgttaggttgagtaaagttagtgcttacaggttttcaaactggtgtggccattgctagagtatcaaatagctgagatggctacaactatagccttgtttgtatttttttttggcaagagggatggaatttatttgccaaatgtacacattgttgctggaagtatttaatgattcaggtggtcttcttcagtcaccctcctaaattttagaaatt

SEQ ID NO: 2344 - DNA, 3154 bp, Zea mays
  Clone ID: PAT_MRT4577_61287C.1
cattgggaccctcgaccagggccggcgggtgggggtctttcgcaacgcaagtagtgctggagattggagagtggagacagaaggcaagggggccgtcgcagaattcgcgccaccgcccgcgatggcttcgtcctcgaaggcctccgattcctcccaacgatccaagcggtcggatcaggggatgggcaaggacgccgctgccgcctctgttgtcccgatccacgcgaacctgacgcagctgatacggcaagtccaatcggggcgcctcgcgtacatcaaggagaaattggaggtgaacaggaaaacgctgcagaggcactcctgctcgctgttcgacgtggcagcggcggcggaggtggcgtcgaggggcaccgatggcggcaacgcgctgtcacagcgcgcggcggagagacagtgtgggtcagacctggcaaacgggataggggagagggacgtggtttccgttcaggaggagaacctggctaccggtacgctcgcgctctccagctcgggcgctaccgcgcagcggacaattgtgcggttcgtgaagctgccgctggttgagaagatccctccgtacaccacttggatcttcctggacaaaaaccaaagaatggctgacgatcagtcagttgttggtaggagaaggatatactatgatacagttggaaacgaggctctgatctgcagtgacagtgatgaagaaattccagaaccagaggaagagaaacactttttcacaaagggagaagatcatttgatatggagagctactcaagaccatgggttaaaccaagaggttgttaatgtcctttgcctttattggtgcaaccccatcagaaattgaggaaagatctgaagtcctatttgagaaaaatgagaagcactcaggatcttcagataagatagagagccgactttctcttgacaaaactatggatgccgttctggattcttttgataatctcttctgccgcagatgcttggtttttgattgccgccttcatggttgttcacagaatttggtatttccatgtgagaagcaaccctacagctttgaccctgatgaaaacaagaagccatgtggtcatttgtgctaccttcgatttccccagtggagagaaggatttaaagagatgcatgatgatggtcttgctggtggtgcaacatatactatggaatcgggaactgcctcacagagagttgatgttaatgttatgtatgaatcagaagattcaaaccgacagaaaggcaacattaggtccatgacactagttggaaccagtggatcaaaaataatttcttctgtcagtgcggaagaaagcactactactccttcagcagatatctctgaaacagagaatgtatcctctgatttgcctcccagtagtttaaggaaacacaagatttcaaaacatggacctaggtacagggagcattctcctggcaaaaggcagaaggttttcacttctgacatttcttttgaaggcaatataatgaataaactttccattccggagattcgtgacacaagactagagtccagagaatctggtggtgataaactacgaattcttgacgagtccactaagaagacttcaaggaaagatatgtgtggggaaagcccagctactaccatggaaaatgtgggaagacagagtaataaagtgtcttcaacaaagaatttcttggagtccactctttcttgttggagtgccttagagcgagatctatacttgaagggcatagagatatttggaaagaacagctgtctcatcgccagaaacttactatctggtcttaagacctgcatagaagtggcaaactacatgtataacaatggtgcagcgatggcgaagagacctctcttgaataaatccatctcaggcgactttgcagaaaatgaacaagactacatggagcaagacatggctgccagaacaagaatctatcgtcggaggggccgcaatcgaaagctgaaatatacttggaaatctgcagggcatccaactgttagaaaaagaactgatgacgggaagcaatgttacacacaatatagcccatgtgcgtgccagcaaatgtgtggtaaagattgcccctgtgcggacaagggaacttgctgtgagaagtactgtgggtgttcgaagagctgcaaaaacaagtttagaggctgtcattgtgcaaaaagccaatgcagaagcagacagtgcccctgttttgcagccagtcgtgaatgtgatccagatgtttgtaggaattgctgggtgagctgtggagatggttcactaggtgagccacttgcaagaggtgatggttatcagtgtggaaatatgaagctccttttgaaacaaaagcaacggattttgttaggaagatctgatgttgcaggttggggtgcattcattaagaatcctgtaaataaaaatgattatcttggagaatatactggtgaattgatctctcacaaggaagcagacaaacgcggcaaaatttatgaccgggcaaactcatcttttctgttcgatttaaatgaccagtatgtgttggatgcttatcgcaagggggacaaattgaagttcgcaaatcactcatctaaccccaactgctatgcaaaggtgatgctggtggctggcgaccatcgggttggtatatatgcgaaggagcatattgaggctagcgaggaactcttttatgattatcgttatggacctgaccaggctccagcttgggctaggagacccgaaggatcaaagaaggacgaggcatccgtctctcaccgtcgagcacacaaagtggctcgatagctgaagagtcgctccggatgatacaatatgcagtaaacttaatacttaatacatgattcagtcctagttcattggtagataaacatgctatatactatccattagtaaataaactctcattcatcgagttggagaataaatgcgtataaacatatgtggacctcaggtcgggaaggtggcaaccttgttagtttgagcaccaacaggttctcaaacttgagtggctattgctagagtatcaaataatggctgcgactatagccttgtttgtatattttcttggtgagatgaaataatttgtcaaacactcaaatgtacactttattcctgaaagtatttgatgattcatt

SEQ ID NO: 2345 - DNA, 602 bp, Zea mays
  Clone ID: PAT_MRT4577_61348C.1
acgcacatatacattcgagaaccaactagtcaacatcataaagtacaatacctgtaccaacaacggcagccaaaaatggtgcctacttatgctccttggtctttctgcaagagctagctacggcgaccatatgtcccgcaatgctcgcaagctcctatagctagccttcttccaccgtacctcttaccagcgtgagatgccgaatgtgaaaacccaattcttcaaccctacatgatccaacaagcaatcacaggtggcatactacctttatcacccttgttcctgcaacaatcatcacccctattacatcagttacctttggagcatcaatcgccacaaaatatcacggcacaacaaccacaacaacttgagctagcaaaccttgctggctactctacaaaacagcagtgtacttacattcaaccaactacatggattgaactatgcttgttattagcaacaccaacaactaccattcattcatgtacctgatgcctacccccagaaatatcttacattcaaccaactatgagcatcgaactctcctgctgattaacagcgagaacaactactaccattcaaccagctagctggagtgagcc

SEQ ID NO: 2346 - DNA, 257 bp, Zea mays
  Clone ID: PAT_MRT4577_61382C.1
ggcttctcctccccctcttaccaagtcctcctcgggttagggttccttagggttttgtcgatgtgcgatggcggcggctgatgtggagtaccgttgcttcgtcggctggcttgcctgggccaccagcatcgagtctctggagaatgccttcggctcctactgcgagattctcgactccaaggtcatctccgaccggtagacgtggatgtctcgcggcttcggcatcgctatcttctcctccttaaggtccatgctcg

SEQ ID NO: 2347 - DNA, 408 bp, Zea mays
  Clone ID: PAT_MRT4577_61462C.1
cccagatccaattcgcgagttctccctcctgtgaggccatggtgctatatgtggagaagacctcgactggacgggagtacaaggtcaaggatctctcgcaggcggacttctgacgcctcgagattgcactggccatggtcgaaatgcccggccttatggcgtgccgcgccgagataggcccgtacaagcccttctccggcgctaggatctcggggcctttccacatgaccattcagaccgtgcgtcttatagagaccctcaccgcgctcggagcccaggtccgctggtgctcctgcaacatattctccacgcaggaccacgcgcgctgcggcatcgtgcgcgactggtacgacgcgttcgcctggaaggtggagaccctcgtggagtactgcgggtgcaccgagcgct

SEQ ID NO: 2348 - DNA, 1891 bp, Zea mays
  Clone ID: PAT_MRT4577_61799C.1
cctgccggatctctctcttgtcattgggtacctcgaggccggccgggaacccagtgtgcgcacttcaccccccctctcggtctcaccctcctggcgacgactgggcggccgaccggccgtcgccgccgccccacgccaggtttcaaagtcttcgtcaggcccttctccggcgactcgagcaccacagggtgacaaggatagctttctcgggtcactgaaggaagacatcttctcgacgcgttagaccttctgacggttggctggttgtgctttaagtgttcaaggggtggattaggaccgggaaactctgtactgaagggaaggtcaaaagtgtcaagagagcttgttccaagatggatgaaggtcagggagttaggtattggtgccacatgtgtcaggaggtgatagatcccatgcccgagatgaagtgcccaggctgcgagggcgggtttgtggaggagatggactctgaagactttgagccagctgcgaacgcgaggtctgatcgctccgtctctctcttggctccactgctgcttggtatgatggggggttcgtcgcgcagatcaagactcaggagggaggccatggttgaagctgatgccgaccaggatgacgaagaggatgattcagaccatgagcttgaactttccaggaggaggcggaggaggaggcgctcatcagcgcttttcagtgtgcttgaggctatgcgtgaccgtgatgaagtaaggggctcggatgacaccgacagtgatacagagagagacctggagagagggagaagggagaggatggagaggcagagggagaggttaaggcagatcgagagggtgagtgctcgtggcagagagaggacggaaagcttaatactgatcaactccaacaacgaggctattattctgcagggaacattcggatctgatgacaaccaggaggactcaagcaacacaagttctggtgtatcacttggggattactttcttggtcctgccttagacactctcttgcagcgtttggcggagagtgacctcagtcgttctggcacaccgcctgccaagaaggaagcagtcgccgcgctaccaaccgtgaacatcgaggaagcgttgggctgttcagtctgtcttgaggatttcgagatgggaggagaagcgaagcagatgccctgtcagcataagttccactcgcactgcatactcccgtggctggagctccacagctcttgcccaatctgccggtttcagttgcctactgaggagacgaagaacaacccatgcgaatcagccagcaccgcagggaccgtgaacggcggtggagacaacgctgctgcaagcggcagcgatacagaaagtactaaccacaatgaagatgaccattccgatagccctatcttctctgctctgagcacactcttctctgatccgttctcatccgacgatgatgaaagtgttccacactcttacgagaactgaagatagcgtcggacgcaggcttgcaatatggtgaagacgttctgcttctgaggctggcatctttatattgtagcttctgtacatatctctctgaacggtcgccccccataagacaaactattacctctccgttttactgaaaactatgtggcttgtaatctgctagtgcttgctatgttcacttgcctcgaataaatgttatcctttagcgtgcttattaccatctccggacggccctaaacgtgcatgtggacgcagatttggttgacagtatggccaatgtaaggcatatatgtatgcagtggcgttgcgtcttactcctaaaatttaacagtcaaagagaaggtccttggaagtcgttttggagaaggagagaagagagaggagggggagaaaaaactcgagagagggcgccggtaccc

SEQ ID NO: 2349 - DNA, 563 bp, Zea mays
  Clone ID: PAT_MRT4577_61820C.1
cgtttagaacctctaaatttcccccatcgccatccagatccctgtgcacctgtcgccatcggccggtgcaggggaataaggggcggccgggcgcaaggcaggcggccccagaaatagtcggtgacgcggtccgtcaaggccgggctgcatttccccgtcggccggatcgtgcgctacctcaagaagggccggtacgcgcagcgcgtgggcactggcgcccctgtctacctctccgacgtcctggagtacctcgccgccgatgttctggatttggcatggaactcggccatagacaacaagaagactcgcatcatcccgcgccacgtgcttctggcgatccgtaacgtctaggagctcgttaagctgctgtccggcgtcaccatctctcacggaggcgtcctccccatcatccactccgtgctcctgcccaataaggcggaggataaggctgccatctgcctcagcaatgagcccaagtcccccaagaaggtcgccaattcccccaagaaggcttagaatgtagggtcttcatttgctctgtgtgctgtatcatgttcgtgtct

SEQ ID NO: 2350 - DNA, 348 bp, Zea mays
  Clone ID: PAT_MRT4577_61834C.1
ttagtacctgccaaaaacaaggagtcccctggggggctatattaaacagttggggggttgaccccgatcgatccgactaggcatgacaggactgacacaattcgcaaggctcttgtccttggcgttaacgataacatgatcaccgccgatcagctcgctattgttacggagactgcaaggaggctcggcatgagtaccaacatgtatccatcctatgcactgatagggcaaaacaaggatgcgactctagaaccgctttctgtagatgaactcattgacaaggcctatggattagccgcactctttcctgaacacaagtacgagatcgtgcagagactgcacgagaag

SEQ ID NO: 2351 - DNA, 409 bp, Zea mays
  Clone ID: PAT_MRT4577_61892C.1
caactagcatcatagaaagcacaatcttgtaccaacaatggcaggcaaaatatgttggttccctatgctccttggtctgtctgcaagtgctgctaccgtaaccatcttcccacaatgctcacaagctcctatagctttctttcttgccagatacctgtcaccagcgctgtcttcagtatgtgaaaacccaactcttcaaccctacaggatccatcaggcaatcgcaacaggcatcttacctttatcacccttgttcattcaacaaccgatagccctattacagcaattacctatgaagcatttcatggcacctaacatcaaggcacatcacctacaacaactagggctatgaaaccttgctgcctactctcagtaaccgccgtctctttctttcaaccaactggctgca

SEQ ID NO: 2352 - DNA, 401 bp, Zea mays
  UNSURE (1)..(401): unsure at all n locations
  Clone ID: PAT_MRT4577_61933C.1
  unsure (1)..(401): unsure at all n locations
ncgagcacagtgcccatcccctccgctcccccctcccccctccgcctccccgcgctcgaatcctctgcggttaacaatggacgcgcagtacaaccccaggacggtggaggaggtcttccgggactacaagggccgccgcaacggcctcgcccgcgcgctcaccaccgatgtggaggagttcttccggcaatgcgacccggaaaaagaaaatttgtgcctttatgggtttcccaatgagcattgggaagtaaacttacctgctgaagaagtgccacctgagctcccagagccagcattgggcatcaactttgcacgagatggaatgcaggaaaaagattggctatccatggttgcagcacacagcgacgcatggttactatctgttgcattctactttggtg

SEQ ID NO: 2353 - DNA, 776 bp, Zea mays
  Clone ID: PAT_MRT4577_62309C.1
atacgaagggcattgaaccttggtgttagtgtaaaaatgatcacaggtgatcagctagcaattgggaaggaaacaggacgtcgcttaggcatgggtactaacatgtacccttcctctgctttgctgggacagaataaggatgagtctattgctgctttacctgttgacgatttaattgagaaagcggatggttttgctggcgtattccctgagcacaaatatgagattgtaaaacgtttgcaagcacgaaaacacatttgtgggatgactggtgatggagtaaatgatgcccctgccctaaagaaagctgatattggtatagcagttgctgatgccactgatgcagccaggagtgcttctgacattgtcctgacagaacctggcttgagtgtgataattagtgccgttcttaccagccgggcaattttccagaggatgaagaactacacgatctatgctgtttccatcacaatacgtattgtgctaggatttatgctacttgccctcatatgggagttcgatttcccaccatttatggtacttattattgcaattctaaatgacggtaccataatgaccatatcgaaggatcgagtgaagccttcgcctctaccggacagctggaagctggccgagattttcacaactggaattgtgcttggtggatacctggcagtgatgactgtcatcttcttctgggctgcatataagacaaactttttccctaggatcttccacgttgaaagccttgagaagacagctcaagatgattacca

SEQ ID NO: 2354 - DNA, 1212 bp, Zea mays
  Clone ID: PAT_MRT4577_62540C.1
ctgtatgcttgtggaaatgggcagcagagcagctttcgtggtcgcgtttctcctgagggctatatatgcaggcacgcagatactcaccaaggctgccttcgatgaaggcatgaacacgtcggtctttgttttctacaggcatctgactggtatcctcttcttggtgcctattgcttttgtgcttgagaggaaaactgcccctccactgtcattcagagtctctctgaaattgtttttccatgcactatacgggatctctggagcaataaacatatacggcctcggtctcagctattcttcagcaacatcatcgtctgcgatatttaacctcctgccagctgtggctttctttctggctgttcttttggggatggagacactgaacttgaagcggttccacgggatcgcaaaggctgcaggcgtgttgttcagcactgctggcgtgactgtgctggcgttctaccaaggccccgcattcagatcgttcatccaccacaccgctttctcccatcacaacgtccacgctggggtcgttaccgccgctcatcctaaaagcgtctggatactggggattttcctgacgaccttgtcgactgcatcgtgggctctctggacggttcttcaggggccaatgctggaagcgtacccatccaagctgctcaacacgaccctccagatgatcttcgcgacggtccagtgcttcttcatcgccctagcggccgagagggacttgtcgaggtggaagctggcgctggacatacgcctttacgctgtgatctactctggaatacttgtctcgggagtcgcttactacatgcaagtatgggtgatcgagaagagcgggcctgtcttcttggccatgacgatgccgataaccttgcttgtcaccatcattctgtccctgtttctcggagagccggttaccctgggaagcatcttgggtggactgatcatggtcggtggtctgtacagtgtgctctgggccaagaggtctgagcaggtgcatgccagcaagcagcaaatggcagcgcctactcctcctccagcaggcgacacaagtgtaggccgagcttagcttgtttattttgcagtgactgagatcgagagaactgtgaagttctgtttttagataatggaaacctgaatgagcacatgcatcaggcccctaaggactctcctaacagctgctaaaaggaaaaaaaaaaaaaaaaa

SEQ ID NO: 2355 - DNA, 2202 bp, Zea mays
  Clone ID: PAT_MRT4577_62558C.1
acctcgagggaggccggccggggcatactggtcttcaccctttctcttgccacctcgggcatcctcagccgccctaaaaaggatacatgcttcatacctagatcatttggtgttcagttttgtttttaagccatggcgaattcccggactggacgttacaagatgtctaatctctcacacacctcaaaggaagatacttcacctgagggttcaggtactaccgagagaactggagcctggagtaacatgttgaacactcttatgcagcaagcctcaatctatggtgtggctgctgggtattgtttatcagcgtcgctgctctcgatcatcaacaaatgggcaatcatgaaatttccatatcctggagccctgacagctctgcagtatttcactagtgttgctggagttctcctatgcggacagctctggctcattgagcatgacgccctcacgagataagttaacagggctagctgctaggtggttgctgcatactggtcttccctctttctcttgccacctcgggcatcctctctggcttagaaaaaaaatatgcgcttcatagtccatacctagatcttttggtgttcagttttggtttcaagccatggcgaattctcggattggacgttacaagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggagagacgctgtatcttcatcagccatggccatcgctcaagacatggctttcactctccacaatacttggtggaagtgtgatctatgttttcacagacaaccaattcactgtgactgcttacacctgggcagtggcctacctagcaagcatgtccattgatttcgtgtacatcaagcacgtcgtaatgaccattgggctgaacacatggggccttgtgctatacaacaacctcgaggctttgatgctattcccccttgagctccttataatgggagaatttgatcagatgaaggtcgacagctccaaggtgtcaaactggctgtcattcgatgtggtcctccctgttgctctttcatgcctgtttggactatcgatatcattctttggattctcctgcagacgggctatttctgctaccgggttcacagtgcttggcatagtgaacaagctcctgactgttgttattaatttgcttatctgggacaagcatgcctcttttgtgggcaccattgggctcttgatatgcatgtcaggtggcgtgctctaccagcaatccaccatgaagccgaaggcgcccaaggttgagccgaaggaagagaacgacaacgacgaggagcagcagaaattgctgcagatgcagggtgttcaagagagcaatccaactcagaaataaagctcttcataaaccttacaacgaagtaatgctttgatggattaccttctttgcaacagcctcacctgaaacgtttttgtattggctaatacttggaaaaaagcatatggatgagtagtcatgaattaggagctacaaaatatcatgtttttgatattagaagtcgtgaggggacctaattatcactatgcaattctttattactgtattaccacttacatttgtaacgcaaaatcgttatgataggataccaggtactcggcaaatacctgcattgaatacttcctatacaaaagcatccgtctcatacagttcgggggtgacagtggtagtatgatctgtttttaggcatttctctgctggagttagcctatatgttctgtaacttattgttggtgatgaagacattggttcttgtgctaaatagagttttcttaccaaaaaaaaaaaaaaaagcggcc

SEQ ID NO: 2356 - DNA, 1966 bp, Zea mays
  UNSURE (1)..(1966): unsure at all n locations
  Clone ID: PAT_MRT4577_62559C.1
  unsure (1)..(1966): unsure at all n locations
ttgggtacctcgaggccggccggggcaatcggaatcgcaagcgtccggatccgggctcacacctccgaccgacagccaccgcgcagaaaacaaggcggagacccggcgataaatccccgcgccccatccttttccgttccccacaccaccaccgagttcaccggggctggactggaggaagcgtctacaagacaaggatcagcagcgcttcatgtgactgattggttggttgcgccggcttgcgaggatctagcaccgagttcagggagcacttcgtgagacttgttcattcgtcttgaggtgctggagccgtcacgttgtggtagttgagaggaacctgtccaatttccatagttgcgaggaaagattcctgagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagtttttacctctcgaggccggccgggatcttctcactctttctcttgcacctcggcgcgcccgagccgccctaaaaaggatacatgcttcatacctagatcatttggtgttcagttttgtttttaagccatggcgaattcccggactggacgttacaagatgtctaatctctcacacacctcaaaggaagatacttcacctgagggttcaggtactaccgagagaactggagcctggagtaacatgttgaacactcttatgcagcaagcctcaatctatggtgtggctgctgggtattgtttatcagcgtcgctgctctcgatcatcaacaaatgggcaatcatgaaatttccatatcctggagccctgacagctctgcagtatttcactagtgttgctggagttctcctatgcggacagctcaagctcattgagcatgacggccttaatttgaggacaatgtggaagttcttacctgctgctgtgatgttctatatctccatcttcacaaacagtgaactcctgcttcacgccaacgtggatactttcattgtgttccgctctgctgtgcctatatttgtcgcgataggagagacgttgtatctccatcagccatggccatcactcaagacatggctttcactctccacaatacttggtggaagtgtgatctatgttttcacagacaaccaattcactgtgactgcttacacctgggcagtggcctacctagcaagcatgtccattgatttcgtgtacatcaagcatgttgtaatgaccattgggctgaacacatggggccttgtgctatacaacaaccttgaggctttgatgctattcccactcgagcttctagtaatgggagaatttgatcagatgaaggtcgacagctccaaagtgtcaaactggctttcatttgatgtggtcctccctgttgctctctcatgcctgtttggactatcaatatccttcttcggattctcctgcagacgagctatttctgctactgggttcacagtgcttggcatagtgaacaagctcctaactgttgtgattaatttgcttatctgggacaagcatgcctcttttgtgggtaccattgggctcttgatatgcatgtcaggtggtgtgctctatcagcaatccaccacgaaaaccgaangcaccaaggttgagccgaaagaaaaaaacgacgaagaagcagcagaaattgctgccagatgccagggaagttccaagaaaagtccataaacccttacaaaagaaaantacaactaccaaag

SEQ ID NO: 2357 - DNA, 1409 bp, Zea mays
  Clone ID: PAT_MRT4577_62561C.1
ctcgaggccggccgggatactggtcttccctctttctcttgcacctcgggcatcctttctggcttagaaaaaaaatcgcttcatagttcatacctagatcgtttggtgttcagttttggtttcaagccatggcgaattctcggattgggcgttacaagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggtgagacgctgtatcttcatcagccatggccatcgctcaagacatggctttcactctccacaatacttggtggaagtgtgatctatgttttcacagacaaccaattcactgtgactgcttacacctaaaaagtggcctacctagcgagtatgtccattgatttcgtatacatcaagcacgttgtcatgaccattgggctgaatacatggggccttgtgctttacaacaatcttgaggccttgatgctgttccccattgagctccttgtaatgggagagttcagtcagatgaaggtcgacagctctaagatgacaaactggctgtcattcgacatgattcttccggttgctttgtcgtgcctttttgggttagcaatatccttctttgggttctcctgcagacgggctatctcagctactggatttacggtccttggtatagtaaacaagctcctcactgtcgtgattaatctgcttatctgggacaagcattcatcccttgtgggaacaattgggctgttgatctgcatgtctggtggtgttctgtaccagcaatccaccacaaagcccaaggcaccaaattttgagccgaaggaagagaatgatgaggaggaacagaagttgcttgagatgcagcaagggcgtgacatcagttcaactgtagagcattcctcataagcctcatcgctgaagtttgttattgatacttcacttctggcaacagcttgcgtggaccattggaaagaaaagtttatctacagggcatagttgagattagttaggaaatgcagaggaacctcagtatcattctacgattctttt

SEQ ID NO: 2358 - DNA, 2882 bp, Zea mays
  Clone ID: PAT_MRT4577_62565C.1
cattgggaccctcgagccggccgggaaatcggaaggtcacgcgtgcccgcgagcgtgccacgcaagggcgagggagcccgcgaggcggaatgcccctcgagatctcctctgcgcggctcgcgggccagaccatcagaagcagcaagtcgcattagtaaattcaatcatcgtccccgcctgcaaaagatctgccgtggcctcctcgtttacctattgctggttctcaaatcgcacgccctcactgctagtgctaggctccccttcgcgcgcgcgcgcagttattaccccgtccacggccgcgtgttcgcaagcatccagatccggcttcccacctccggcgaccaccgcgcagagaacaattccgtccaacgggaaaccccgcgataaatcgccgcgcccatcgtttggcgtccccccacaccaccgaattcaccagggctggaggaagcgtctgaaagactcagcaacgcttcatgtgactgattggttggctgcgccggctctctagcaccgagttcagggagcacttcgtgagcttacacgacttcttcgttcgtcttgaggcgctggagctctgtcacgttgtggtagttgagagggatctgtccaatttgcatagctgcgaaggaagattcctgagatgtctaatctctcacacacctcaaaggaagatacttcacctgagggttcaggtactaccgagagaactggagcctggagtaacatgttgaacactcttatgcagcaagcctcaatctatggtgtggctgctgggtattgtttatcagcgtcgctgctctcgatcatcaacaaatgggcaatcatgaaatttccatatcctggagccctgacagctctgcagtatttcactagtggttgctggagttctcctatgcggaccggggttcgcttattaggcggaagaacatgacaaatcggaaggttcacgcgtgaccgcgagcgtgccacgcaagggcgagggagcccgcgaggcggaatgcgcctcgagatctcctctgcgcggctcgcgggtcagaccatcagaagcagaaagtcgcattagtaaattcaatcatcgtccccgcctgcaaaagatctgccgtggcctcctcgtttacctattgctggttctcaaatcgcacgccctcactgctagtgctaggctccccttcgcgcgcgcgcgcagttattacccgtccacggccgcgtgttcgcaagtatccagatccggctccccacctccggcgaccaccgcgcagagaacaattccgtccaacgggaaaccccgcgataaatcgccgcgcccatcgtttggcgtcccccacagcaccgaattcaccagggctggaggaagtgtctgaaagatgtctaatctctcacacacctcaaaggaagatacttcacctgagggttcaggtactaccgagagaactggagcctggagtaacatgttgaacactcttatgcagcaagcctcaatctatggtgtggctgctgggtattgtttatcagcgtcgctgctctcgatcatcaacaaatgggcaatcatgaaatttccatatcctggagccctgacagctctgcagtatttcactagtgttgctggagttctcctatgcggacagctcaagctcattgagcatgacggccttaatttgaggacaatgtggaagttcttacctgctgctgtgatgttctatatctccatcttcacaaacagtgaactcctgcttcatgccaacgtggatactttcattgtgttccgctctgctgtgcctatatttgtcgcgataggagagacgctgtatctccatcagccatggccatcactcaagacatggctttcactctccacaatacttggtggaagtgtgatctatgttttcacagacaaccaattcactgtgactgcttacacctgggcagtggcctacctagcaagcatgtccattgatttcgtgtacatcaagcatgttgtaatgaccattgggctgaacacatggggccttgtgctatacaacaaccttgaggccttgatgctattcccactcgagcttctcgtaatgggagaatttgatcagatgaaggtcgacagctccaaagtgtcaaactggctttcatttgatgtggtcctccctgttgctctctcatgcctgtttggactatcaatatccttcttcggattctcctgcagacgagctatttctgctactgggttcacagtgcttggcatagtgaacaagctcctaactgttgtgattaatttgcttatctgggacaagcatgcctcttttgtgggtaccattgggctcttgatatgcatgtcaggtggtgtgctctaccagcaatccaccacgaaaccgaaggcacccaaggttgagccgaaggaagagaacgacgaggagcagcagaaattgctgcagatgcagggagttcaagagagttcataaaccttacaaagaaagtacaactacaaagaagcatatggctagtacttggaaagaggacagcctcacctgaacgtttttgtattggctagtacttgggaagaagcatatggatgaatgtagtcatgaactaggagctacaaaatcccatgttttagatattagaagtcatggaggggacctaattatcactgtgcaattctttattactatactaccacttccatttgtaacgcaaaattgttatgataggatggcaaatatacctgcatcgaatacttcctatacgaaagcacctatctcatacagttaggtgacggtgatactatgatctatgtttagtcatttctctgctggagtttgcctatttgttctgtaccttattgttggtgatgaagccattggttcttttgctgaaaagaaagttttgttatc

SEQ ID NO: 2359 - DNA, 840 bp, Zea mays
  Clone ID: PAT_MRT4577_62747C.1
ttgatgaatcgccatcacagcaagctacgcgcactgaaatcctccaatccacaaggacacagctctacttccgcagttcgcactcgcacgcaccgagcggctagcgatcaacggagaaatgtcgctggtgaggcgcagcagcgtgttcgacccattctccgtggacctcttcgaccccttcgacagcatgttccgctccatcgtgccgtcgtcgtcgtcggcggcggcggcggcctccgagaccgccgccttcgccagcgcccgcatcgactggaaggagacgcccgaggcgcacgtgttcaaggccgacctccccggcgtgaagaaggaggaggtcaaggtggaggtggaggacggcaacgtgctgctcatcagcgggcagcgcagcagggagaaggaggacaagggcgacaagtggcatcgcgtggagcgcagcagcggccagttcgtgcggcgcttccgcctccccgagaacgccaagacggaggaggtgagggccgcgcttgagaacggcgtgctcacggtcaccgtgcccaaggccgaggtcaagaagcccgaggtgaagagcatccagatctccggctgaagaagacatggacgcgaggtgaatggtcgcgtcgcggcgtcggatcttgggtttcagcgacgcgactcgtgtgtgtgtggtttctctgctttggtatgtttggtgtgtacgtgtgctgttcagtgtttcgtggtcatcgtctgtacaatgtgcgttgttcggtgagcttcccggctcagtatgttgtgatctgcgagtgaataaataagaataaaccagctgtcatctcgtgtagtaaaaaaaaaaaaaaaaaa

SEQ ID NO: 2360 - DNA, 878 bp, Zea mays
  Clone ID: PAT_MRT4577_62749C.1
cattgggtacctcgaggccggccgggaaaactcttcccaaccagagcgaagaagaatcgccatcacagcaagctacgcgcactgaaatcctccaatccacaggacacagctctacttccacagttcgcagactcgcacgcaccgagcggctagcgatcaacgagaaatgtcgctggtgaggcgcagcagcgtgttcgacccattctctgtggacctcttcgaccccttcgacagcatgttccgctccatcgtgccgccgtcgttgtcgtcgtcggcggcctccgagaccgccgccttcgccagcgcccgcatcgactggaaggagacgcccgaggcgcacgtgttcaaggccgacctccccggcgtgaagaaggaggaggtgaaggtggaggtggaggacggcaacgtgctgctcatcagcgggcagcgcagcagggagaaggaggacaagggcgacaagtggcatcgcgtggagcgcagcagcggccagttcgtgcggcgcttccgcctccccgagaacgccaagacggaggaggtgagggccgcgcttgagaacggcgtgctcacggtcaccgtgcccaaagccgaggtcaagaagcctgaggttaagagcatccagatctccggctgaagaagacatggacgcgaggtgaatggtcgcgtcgccttcgcgtcgcggcgtcgggtcttgggtttcagcgacgcgactcgtgtgtgtgtgtggtactgtggttgctctgctttggtatgtttggtgtgtacgtgtgctgttcagtgtttcgtggtcctcgtctgtactttgcgctgttcggtgagcttcccggctcagtatgctgtgttctgcgagtgaataactaaaaccaaaccagctgtcgtct

SEQ ID NO: 2361 - DNA, 823 bp, Zea mays
  Clone ID: PAT_MRT4577_62752C.1
aatcgccatcacagcaagctacgcgcactgaaatcctccaatccacaggacacagctctacttccgcagttcgcactcgcacgcaccaagccgctagcaacgaagcagaaatgtcgctggtgaggcgcagcagcgtgttcgacccattctccgtggacctcttcgaccccttcgacagcatgttccgctccatcgtgccgtcgtcgccgtcgtcggcggcggcctccgagactgccgccttcgccagcgcccgcatcgactggaaggagacgcccgaggcgcacgtgttcaaggccgacctccccggcgtgaagaaggaggaggtgaaggtggaggtggaggacggcaacgtgctgctcatcagcgggcagcgcagcagggagaaggaggacaagggcgacaagtggcaccgcgtggagcgcagcagcggccagttcgtgcggcgcttccgcctccccgagaacgccaagaccgaggaggtgagggccgcgctggagaacggcgtgctcacggtcaccgtgcccaaggccgaggtcaagaagcccgaggttaagagcatccagatctccggctgaagaagacatggacgcgaggtgaatggtcgcgtcgcgttcgcgtcgcggcgtcgggtcttgggtttcagcgacgcgactcgtgtgtgtggtactgtggttgctctgctttggtatgtctggtgtgtacgtgtgctgttcagtgtttcgtggtcatcgtctgtacattgtgctgttcggtgagctccccgactcagtgtgttgtgttctgcgagtgaataaataaaaacaaaccagctgtcgtctcgtgt

SEQ ID NO: 2362 - DNA, 894 bp, Zea mays
  Clone ID: PAT_MRT4577_62754C.1
tgggaccctcgaggccggccggggccggggagtcccaacccaatcccaatccagagcgaagatcgcgatcagagcaggagcaggcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggaggaggtgaaggtggaggtggaggacggcaacgtgctgctcatcagcgggcagcgcagcagggagaaggaggacaagggcgacaagtggcatcgcgtggagcgcagcagcggccagttcgtgcggcgcttccgcctccccgagaacgccaagacggaggaggtgagggccgcgcttgagaacggcgtgctcacggtcaccgtgcccaaggccgaggtcaagaagcccgaggtgaagagcatccagatctccggctgaagaagacatggacgcgaggtgaatggtcgcgtcgcggcgtcggatcttgggtttcagcgacgcgactcgtgtggtgtgtggtttctctgctttggtatgtttggtgtgtacgtgtgctgttcagtgtttcgtggtcatcgtctgtacaatgtgcgttgttcggtgagcttcccggctcagtatgttgtgatctgcgagtgaataaataagaataaaccagcaaaaaaaaaaaaaaaaaaaaaaaaaaaaaaaaaa

SEQ ID NO: 2363 - DNA, 883 bp, Zea mays
  Clone ID: PAT_MRT4577_62755C.1
aaaaaaaaaaaaaaaaaaaaaaaaaaaaaaaaaaaaatcccaaaccagagcgaagaatcgccatcacagcaagctacgcgcactgaaatcctccaatccacaggacacagctctacttccgcagttcgcactcgcacgcaccgagccgctagcaacgaagcagaaatgtcgctggtgaggcgcagcagcgtgttcgacccattctccatggacctcttcgaccccttcgacagcatgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggaggaggtcaaggtggaggtggaggacggcaacgtgctgctcatcagcgggcagcgcagcagggagaaggaggacaagggcgacaagtggcaccgcgtggagcgcagcagcggccagttcgtgcggcgcttccgcctgccggagaacgccaagacggaggaggtgagggccgcgctggagaacggcgtgctcacggtcaccgtgcccaaggccgaggtcaagaagcccgaggttaagagcatccagatctccggctgaagaagacatggacgcgaggtgaatggtcgcgtcgcgttcgcgtcgcggcgtcgggtcttgggtttcagcgacgcgactcgtgtgtgtggtactgtggttgctctgctttggtatgtctggtgtgtacgtgtgctgttcagtgtttcgtggtcatcgtctgtacattgtgctgttcggtgagctccccgactcagtgtgttgtgttctgcgagtgaataaataaaaacaaaaaaaaaaaaaaaaaaggccccta

SEQ ID NO: 2364 - DNA, 882 bp, Zea mays
  Clone ID: PAT_MRT4577_62757C.1
gccggccgggccgggaactcatcccaaaccagagcgaagaagaatcgccatcacagcaagctacgcgcactgaaatcctccaatccacaggacacagctctacttccacagttcgcagactcgcacgcaccgagcggctagcgatcaacgagaaatgtcgctggtgaggcgcagcagcgtgttcgacccattctctgtggacctcttcgaccccttcgacagcatgttccgctccatcgtgccgccgtcgttgtcgtcgtcggcggcctccgagaccgccgccttcgccagcgcccgcatcgactggaaggagacgcccgaggcgcacgtgttcaaggccgacctccccggcgtgaagaaggaggaggtcaaggtggaggtggaggacggcaacgtgctgctcatcagcgggcagcgcagcagggagaaggaggacaagggcgacaagtggcaccgcgtggagcgcagcagcggccagttcgtgcggcgcttccgcctgccggagaacgccaagacggaggaggtgagggccgcgctggagaacggcgtgctcacggtcaccgtgcccaaggccgaggtcaagaagcccgaggttaagagcatccagatctccggctgaagaagacatggacgcgaggtgaatggtcgcgtcgcgttcgcgtcgcggcgtcgggtcttgggtttcagcgacgcgactcgtgtgtgtggtactgtggttgctctgctttggtatgtctggtgtgtacgtgtgctgttcagtgtttcgtggtcatcgtctgtacattgtgctgttcggtgagctccccgactcagtgtgttgtgttctgcgagtgaataaataaaaacaaaccagctgtcgtctcgtgtagtatattggcctcg

SEQ ID NO: 2365 - DNA, 967 bp, Zea mays
  Clone ID: PAT_MRT4577_62758C.1
ccggccggggagagaatccagacgattcagcgaccgctcttgacgaagctataaaagcgtcaccccacaaggccacagctcatccgaaaccagagcgaagaatcgccatcacagcaagctacgcgcactgaaatcctccaatccacaggacacagctctacttccgcagttcgcactcgcacgcaccaagccgctagcaacgaagcagaaatgtcgctggtgaggcgcagcagcgtgttcgacccattctccgtggacctcttcgacccgttcgacagcatgttccgctccatcgtgccgtcgtcgtcgtcgtcgggctccgagaccgccgccttcgccagcgcccgcatcgactggaaggagacgcccgaggcgcacgtgtttaaggccgacctccccggcgtgaagaaagaggaggtcaaggtggaggtggaggacggcaacgtgctgctcatcagcgggcagcgcagcagggagaaggaggacaagggcgacaagtggcaccgcgtggagcgcagcagcggccagttcgtgcggcgcttccgcctgccggagaacgccaagacggaggaggtgagggccgcgctggagaacggcgtgctcacggtcaccgtgcccaaggccgaggtcaagaagcccgaggtgaagagcatccagatctccggctgaagaagacatggacgggaggtgaatggtcgcgtcgcgttcgcgtcgcggcgtcggatcttgggtttcagcgacgcgactcgtgtgtgtgtgctgtgtggttgctctgctttggtatgtttggtgtgtacgtgtgctgttcagtgtttcctggtcctcgtctgtactttgcgctgttcggtgagcttcctggctcagtatgttgtgttgtgcgagtgaataaataaaaacaaaccagctgtagtatattcacctaaaaaaaaaaaaaaaaaaaaaaagggcggcgctcgcgatctagaac

SEQ ID NO: 2366 - DNA, 1285 bp, Zea mays
  Clone ID: PAT_MRT4577_62761C.1
ctaaaacctagaccacgcgcgacgacggccgcctgaccgatcgaccaccattccgccgtcgccgccggccggatcatcgatcgtcgtcatgatgatatctatcaatctacgcgtgatgatcgatgactacttgtctactgctatgtactactaaataaaatctctccgtgtgtacacgtacgcttgcatgtgcatggtagcatgtacgtacgacgtcgtccatgtatgtgtgtgtgacgtgtgagacggacagagagagagagacaggatcgatcgagagacggtcatgtccttttggctgtttggtttattcatatcacaacttttgagtgtaaaaaaaaaaaaaagaaaccactatgccatagaagagatgcaaaaaagctaaagcaaaattgaaaagaaatccccaatcccaatccagagcgaagatcgcgatcagagcaggagcaggcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggaggaggtgaaggtggaggtggaggacggcaacgtgctgctcatcagcgggcagcgcagcagggagaaggaggacaagggcgacaagtggcaccgcgtggagcgcagcagcggccagttcgtgcggcgcttccgcctccccgagaacgccaagaccgaggaggtgagggccgcgctggagaacggcgtgctcacggtcaccgtgcccaaggccgaggtcaagaagcctgaggttaagagcatccagatctccggctgaagaagacatggacgcgaggtgaatggtcgcgtcgcgttcgcgtcgcggcgtcgggtcttgggtttcagcgacgcgactcgtgtgtgtggtactgtggttgctctgctttggtatgtctggtgtgtacgtgtgctgttcagtgtttcgtggtcatcgtctgtacattgtgctgttcggtgagctccccgactcagtgtgttgtgttctgcgagtgaataaataaaaacaaaccagctgtcgtctcgtgtagcaaaaaaaaaaaaaaaaaaatttgcggcc

SEQ ID NO: 2367 - DNA, 103 bp, Zea mays
  Clone ID: PAT_MRT4577_62928C.1
gagcttcagaccgggacggctccctgtactgtccgacgcgccgtcgcggatggccgtagccaccatgctggcatcaggacgtcctcgttaggctctgactgcc

SEQ ID NO: 2368 - DNA, 170 bp, Zea mays
  Clone ID: PAT_MRT4577_62955C.1
tgaaagagcaacatgaacattctactattagattgagacacaccaacaccaataacaagtggcgctaaatggcacaataatagcaaaatgactacccgaatcagagggccaaaaaaaaaggccactcggccatggaattaaggggggattagctaaaacaaccccccccc

SEQ ID NO: 2369 - DNA, 371 bp, Zea mays
  Clone ID: PAT_MRT4577_63094C.1
cgttcggtgagaacccaattgttcaaccctacatgatccaacaggcgatcgcaacatgcatattgccattatcacccgtgtgcgtgggacaaccgtcagccctattacagcagttacctttggtccatttggtggcacaaaacatcagggcacaacaactactacatcttgtgctagcaaaccttgctgcatactctcagcaacatcagtttcttccattcaaccaactggctgcattgaactctgctgcttatttgcaacaacaattaccattcagccaactagttgctgcctacccccagcgattggggtgctttcaaccaacttgcaacatttgactctgctggttatttacagggagcaacaacttc

SEQ ID NO: 2370 - DNA, 281 bp, Zea mays
  Clone ID: PAT_MRT4577_63141C.1
attgccacataattccttcccctagccgccgccgccgccgctagtatccctgagaggtagcccgatcgatgaactagccgagtactaggtagagaatcggttgatcttatctcagcccggggtctgctgcatctggtggtggtgaagtgggagaaattcgtgagatctgttccggatcatgcgtgacgagctctggaatcaggggtttcacacatagcttcgtcgatttgaatgtgatgtactaatggagtctaagagtcggcacaactctagcagtagtc

SEQ ID NO: 2371 - DNA, 570 bp, Zea mays
  UNSURE (1)..(570): unsure at all n locations
  Clone ID: PAT_MRT4577_63173C.1
  unsure (1)..(570): unsure at all n locations
acccctgtgctggcttctcctccccctcttaccacatcctcctcgggttaggggtgcggaggggtgtgataaagggcgatggcggcggctgatgtggagtaccgttgcttcgtcggcgggcttgcctgggccaccagcaacgagtcgctggagaatgccttcccctcctaggcgagacctcgatccaagtcatcagggaccgggggaggggnangtccctctgcttcngcttcnttaccttctcctccgagaactccatgctccacgctatcgagaacatgaacggcaaggagctccacggccgtaacatcaccgttaaccaggcccagtcccttggcggtggcggtggcggcggtggctacggggggggtctcggcggcggcggctgttatggtggcgggcgccctgactgcggttatggcggcggtggcggctactgcggtccgcgctaaggtggcggcggcggctactgaggcggtgacggatactgcggtccgcgcgagggtggcggtggcggctaccgcggcggtggcggcggcggcttgaaggactgatgtgtgggcccatcct

SEQ ID NO: 2372 - DNA, 739 bp, Zea mays
  Clone ID: PAT_MRT4577_63185C.1
aattcggcacgaggcccggcctccccccaccccacccgcacccgcccgcgcgcccctcattcattcgcctcgatctcgccggcgatgtacggcaacgacaactggatcaacagctacctcgacgccatcctcgatgccggcaagggcgccggccccgccaggggccggggaggcggcggcggggaccggccctcgctgctcctgcgcgagcgcggccacttctccccggcgcgctacttcgtcgaggaggtcatcaccggctacgacgagaccgacctctacaagacctggctccgggcgaacgcgatgcggagcccgcaggagaagaacacgcgcctggagaacatgacctggaggatctggaacctcgccaggaagaagaaggagtttgagaaagaggaagccaatcgcttgtccaaacgccgtctagaggctgagaagccacaaaatgatgctactgcagacatgtctgaagatctttttgaaggtgtgaagggagaagacgttggtgatccatctgttgcctacggtgacagcacagctgggaacacacctaggatcagttcatttgacaagctatacatagtggtattcagtcttcatggcctgatacgtggagagaatatggagcttggccgtgattcagatactggtggccaggtcaaatatgtcgtgggacttgctaagcattaaggtcatgtcctggagtttacgggttgatctattggcaggacaatca

SEQ ID NO: 2373 - DNA, 711 bp, Zea mays
  Clone ID: PAT_MRT4577_63188C.1
aattcggcacgaggcctcgtgccgttgctctcctctccatacccgtcgccgccctcgccctcgccaccacccgcacccgccgcgcggcccccattcgcctcgatttcgccggcggcgatgtacggcaacgacaactggatcaacagctatctcgacgccatcctcgatgccggcaagggcgtcgcggccgcggccgcgggcgccgccaggggccggggcggaggctggggcggggaccggccctcgctgctcctccgcgagcgcggccacttctcccccgcgcgctactttgtcgaggaggtcatcaccggctacgacgagaccgacctctacaagacctggctccgggcgaacgcgatgcggagcccgcaggagaagaacacgcggctggagaacatgacctggaggatctggaacctcgccaggaagaagaaggagtttgagaaagaggaagccattcgcttgtccaaacaccgtttagagactaagaagccacggaatgatgctactgcagaaatgtctgaagatctttttgaaggagtgaagggagaagacgctggtgatccatctgttgcctacggtgacagcacaactgggaacacacctaggaccagtttatttgacaagctatacatagtggttgatcagtctgcatggcctggtgcgtggagagaacatggagcttggccgggttgcgatcctgggggccag

SEQ ID NO: 2374 - DNA, 474 bp, Zea mays
  Clone ID: PAT_MRT4577_63251C.1
attcggctcgtgggtacatagtcgacctgattttgttttacctgaccctctagaaggggtgcggcgggcttcctgtggacgtgacgggcaccctgttccacaaggccatgaaggctcgcatgctcctgggcgccgccggggaccacatcatctaggaccgacacgagggcgagcggcatcgcgggagcgacctcctggcctcctatctggacgaccgcgaggcgctcaccgactcccagatcgccgacaacctgatcggcgtaatctgcggcgaccgcgacaccacacacagagtgctcacctggatggtcaagttacttgggcaccaccctgcagttcacaaggctcatatcgtggagcagcaggagaatctgcggtccaaaggctcatccggggagctcctgacctgggcggacaccaggcggatgcgcacgactagccgtgtgatccaggagactatgcaggtggcgtcca

SEQ ID NO: 2375 - DNA, 1185 bp, Zea mays
  Clone ID: PAT_MRT4577_63260C.1
tgatggtgttaagcgccggtggaaaaggcaggcctctccgtccccaatcccccatccggattgcccaccatggcgtcgcagtgcgccctactgccgtgcggcgggaccgtcgcggtgcgcgacgacgcactcgccgctctcgcgcgccgtctccgagtgctccgactgcgcccgaatcgtccccacgcgacacctccgcacttagagagagatgtgaaggtaaacgcagagtactttttttttttttttttttttcattggcgccctcgaggccggccgggacacatattccctacgcctcgctagcgccttccgcgaactgaggactcccgagaggccgagaccaccccgatgtccgccatggagaccgacatcaacgcgccgccgcccgccccagccggcgagggatcctccgtggtcggtccgtcctcctcctcccgcaagcccaacaagcgcttcgagatcaagaagtggaacgccgtcgcgctctgggcatgggatatcgtcgtcgacaactgcgccatctgccgcaaccacatcatggatctatgcatcgagtgccaggcgaaccaagctagcgcgaccagcgaggagtgcactgtcgcttggggagtctgtaatcatgcttttcacttccactgcatcagcaggtggcttaagactcgccaagtgtgcccattagataacagtgagtgggagttccagaaatatggccactagttcctgggcaccctcatgtgatgttggggctttgctgccactcaagtgtttttttctgccaaacagctccatctcttactgctttcgatgcttgcatctatcacacgtcaattataactagctagcagtacgtccacctgggactgtatttggatgattcattgagaggatagtaggcccattttatcaatggtatgtggatcttcataagtgagcttgtattgtgctgtggtaccattttctgaagtcatgtttttttatacgtgcctgtcttgatgttatgaagtgggtttgcctttcggccgcatgtatataggttactgaatgttgcggacatgccctgaaattatgttgggcactatatcctgtcttgcaaaaaaaaaaaaaaaaaaaaaaaaaaaaaaaaaaaaaaaaaaaaaaaaaaaaaaaaaaaaaaaaaaagtactctgcgttgttaccactgct

SEQ ID NO: 2376 - DNA, 828 bp, Zea mays
  Clone ID: PAT_MRT4577_63263C.1
ggaccctcgaggccggccgggacatattccctacgcctcgctagcgccttccgcgaactgaggactcccgagaggccgagaccaccccgatgtccgccatggagaccgacatcaacgcgccgccgcccgccccagccggcgagggatcctccgtggtcggtccgtcctcctcatcctcccgcaagcccaacaagcgcttcgagatcaagaagtggaacgccgtcgcgctctgggcatgggatatcgtcgtcgacaactgcgccatctgccgcaaccacatcatggatctatgcatcgagtgccaggcgaaccaagctagcgcgaccagcgaggagtgcactgtcgcttggggtgtctgtaatcatgcttttcacttccactgcatcagcaggtggcttaagactcgccaagtgtgcccattagataacagtgagtgggagttccagaaatatggccactagttcctgggcaccgtcatgtgatgttggggctttgctgccactcaagtgtttttgtctgccaaacagctccatctcttactgctttcgatgcttgcatctatccacctgggactgtatttggatgatccattgagaggatagtaggcccattttatcaatggtatgtggatcttcataagtgagcttgtattgtgctgtggtaccattttctgaagtcatgtttttttatacgtgcctgtcttgatgttatgaagtgggtttgcctttcggccgcatgtatataggttactgaatgttgcggacaatgtcctgaaattacgttgggcactaaaacaaaaaaaaaaaaaaaaaaaaaaaaaaagcggcc

SEQ ID NO: 2377 - DNA, 326 bp, Zea mays
  Clone ID: PAT_MRT4577_63267C.1
tgcaacataaaaagcacaatatttgtttctacaatggcagcctatatattatggcgggttatgctcctaggtatctcttcaagtgctgctactgcgaccattttcacgcattgcccacaagctccaatagcttcccttctttccccgtaacctcttaccatcgatgtcttcgtgatgtgaaaacccaattcttcaaccctacaggatccaacaagctatcactactggcatcttaccttttttacccatgtgcttcaacaatcattatccctatttcatcagttacctttggtgcatttattggatcaaatcattatggcacaaca

SEQ ID NO: 2378 - DNA, 358 bp, Zea mays
  Clone ID: PAT_MRT4577_63382C.1
gcagcaccaatatacaccttttttttcttaattataatttataataaatctgtatggggttaacagcttccattgatccgcaatccatgctggtatgagcatgggtctgctggaaacccagggatgaacacattactaacaactgtacacagtaacgaccttggctatcaaaaacacagatggggcaacaacaaacaccacacgcaacgaagataaaccctctggactatggtaaacattacggtaaccaacaggataacttggccgagcgggccccaccgctcaattcctccagttcccgtcgtgaatgacgtaaccgccaccacaattgccacagccgtaaccgtcgtcaccacca

SEQ ID NO: 2379 - DNA, 266 bp, Zea mays
  Clone ID: PAT_MRT4577_63385C.1
tttgtgatggatagtccaataacagtgttttgccatggggattggagtgtcttcagcatagtactccctgtttcctcggttctccaaagtctgcgtcctttgcggtggactgtggtggtagtagagcaatatcaggttcagataattccgtctatcaagctgataatgccaaccttagtgctgcatcatactatgttgcgggtgcacctacatgggccgttagcagcgttgggttattcttggacgcagatgcaccaatgcaagtt

SEQ ID NO: 2380 - DNA, 186 bp, Zea mays
  Clone ID: PAT_MRT4577_63436C.1
gatgaggcctttgcgaagaggttggattcagattggaaggagttacatattggcggaaattggtctgcacggagatttcctgagtttaatcacatgtgagtgttaagctggtaggatcagaagtcagaagcagaggagatttgtggacatacagcctggaagagagtaaaaaataccaaacagggg

SEQ ID NO: 2381 - DNA, 2874 bp, Zea mays
  Clone ID: PAT_MRT4577_63582C.1
agctcgccacgacgctcgttcgtcgctgctccctcctccaccaccttccagtcctgtccagtgccgccgccttgccctgccctcccctcccttcccccgattaccctcgcggttgacctcgccaatccggtcccgcctccgtataaatccgcccttctcgcccccgctccgaccacaaaccctagcggcgcgccccggcatgggctagggttcccgcggcgatggagtgggacagcgattctgacggcggcgatgacgaggaggaagaagaggtccgccccgggggtggggacgcgggcccggggttctcgctggccatcgagggcgtgctgggcgcgtgcggcatggtggtctccgacgcgctcgagcccgacttccccatcatctacgtcaaccgcgggttcgagagctccactggatacagcgccgaggaggtgcttgggaggaactgccggttcctacaatgcagaggaccatttgctcagaggaggcatccccttgttgatgcagcagttgttactaggattcggagatgtttagatgaagggactgaatttcatggtgatctgttaaattttagaaaagattgttctccatacatggccaggctgcaattaacacccatatacggagacgatgaagtaataacacactatatgggcattcagtttttcaatgattctaatgttgacttggggccatcttctggctctgtgacaaaggaacttgcaagatctacatggattgcacctggcaacactgactcaccaactccagtaggcaagggtaatttgtgggaacattctagtctctttctgctgagtgatgaggtaatttgccagaagatcttgtccaaactgtcgcccagggatatagcatcagtaaactctgtttgcaagcgacttcatcacatgacaaggaatgaagacctttggaggatggtttgtcagaatgcatggggcactgaagctactcgggcccttgagactgtggcaggatcaagaagtttggcatggggccggctagcacgagagttaaccacccttgaagctgttgcctggaggaaattgacagtcggtggtgcagttgagccatctcgctgcaacttcagtgcctgtgccgtagggaaccgtgttgttctatttggtggagagggtgttaacatgcagccgatgaatgatacatttgtgctggacttgagtgccagcaagccagaatggaggcacatcaacgtgagcgcagctcctcctggtcgctggggccataccctgtcatgcctgaatggatcacggctgattctgtttggtggctgtggggggcagggtctgcttaatgacgtcttcattttggatcttgatgcacagcatccaacttggcgtgagattcctggccttgcaccccctgtaccacggtcatggcatagctcctgcactgttgatggaaccaagctggtggtttctggtggatgtgcggactctggtgttcttctcagcgatacctacctcctagatgtgacaatggaaagacctgtttggagggagatacctgcatcttggtctccaccttcaaggctggggcactcgctatctgtctatgatggcaggaaaatcctgatgtttggtggccttgctaaaagtggtcctctacgacttagatctagtgatgtgttcactctagatttaagtgaagacaagccttgctggcggtgcataactggcagcaggatgccaggagctggtaatcctgctggggtcggcccaccacctcgcctcgaccatgttgtcgtgagccttcctggtgggagagttctgatatttggtggttctgtggcgggtcttcactctgcttcaaaactttacctcctggatccaacggaagataagccaacctggaggcttctgaatgttccagggcatcctccacggttcgcctggggccacagtacttgtgttgtcggagggacaaaggcaatagttcttggaggacaaactggagaagagtggacgctaactgaaatacacgagctttctctagcaagctcattagtctgaagatgggaaggtcccagcaagctttccagcttccttgaagcaatgtctctggagacagctacctgttcatatgacttgaggcagattttttttccaacagtggtgtgcaagcacaagcacaaaagggttggtgaagtggacaaccagacctgattacttgtgccatgcctgggagtcagctggtctaaaagtaggaataagttacctctgctgctgctgttcgtatgatctgaaatgatggaatagctggcatccataagctaatctcagttcttatcatgtttcaaatgggacactggcattatgtcgctggagcccctgatgcaacaggtaccctgccttctggttgcgcctgccttcggtgacaactgatgctgtggtcttctgttttttgacccatcaactgctgtgaagcttctttgttatgcttttgcgccacttcgtgcttactcaattgctgctttctggagaagctgtaacacagacacacctgctgtatttaattttgcctttcgtatcactttgtgcttacctcagctgttagtgatacctataacattttctttttaatctgattatcaaaggatgaattatgaatatcaacagttccatcttaccgcgacatttatcttacctgggatcagggtttggtgctggcaaaccaacaacaggcgacggccatgtatgtgtcgtgtctagagtttctgttatttgatttttatcgtcttactatgattcaatgtgtaaatattgttatcgtgacctgccgaactgcctggttggctgcttatattatcgacaactataaccgttccaaaaaaaa

SEQ ID NO: 2382 - DNA, 398 bp, Zea mays
  Clone ID: PAT_MRT4577_63852C.1
aaacattcatgagcaatatctcctacgtcacctgctgtgcaaccattgtggctactgtgagcaacagcagttacctttggtgcatttgtaggcacaaaacatcacggcacaacaactacaacaactcgtgctagcaaaccttgatgactactctaatcagcaacagattctgtcattcaaccaactagctgcattgaactctgctgcttattcgcatcaacaacaactactaccattcagccagctagctgctgcctacccgcggcaattccttacattcaactaactggcagcattgaactctcatgcttatgtacaacatacaacaactactaccattcagccagctagctgctgcgagcactgttgccttcttgacacagcaacatttgatgtcg

SEQ ID NO: 2383 - DNA, 605 bp, Zea mays
  Clone ID: PAT_MRT4577_63854C.1
cactatcttatttctgggaagccacaaacatcaaacataaaactttattattgaactgtaactcataagaaatctaaaagagggcaccaccaatgatgggttgccaggtataacactgctgggtttgtcaaagcaagttggctgaatggcaacaattgttgcagttgtaagagggtgccagcgttaggcgcagcgtgctggtagaacggcaacaactgtggtctagtgtcaagaaggcagcagggctcacaccagctagctggctaaatggtagtagttgttgctgctgtaaataagcaggagagttcaatgctgccagttggttgaatggaagaaactgctgggggtaggcagcagctagctggttgaatggtagttgttgttgctgcaaataagaagcaaagttcaaagcatcttggtggttgaatggaagaaactgatgttgcttatagtaagcaacaaggtttgctagcacaagttgttgtagacgcagcgccctgatgtttcgtgccaacaaaagcctcaaaggtaactgttgcaatatggctcgatgattgcaggaggaacaagggtgataaatgtgatatgccaaatgcgattggctg

SEQ ID NO: 2384 - DNA, 338 bp, Zea mays
  Clone ID: PAT_MRT4577_63857C.1
accgtcttgattcccggacgagaccaactgcacatagaagcacaatagtgtaccaacaatggcagccaaaatattttgcctccttatgctccgtggtctttctgcaagtgctgctacggcgaccattttcccgcaatgctcgcaagctcctatagcttcccttcttcccccgtccctctcaccaccggtgtcttcggtatgtgaaaccccaattcttaaaccctccaggatcccacaagcaatcgcagcttgccatctaacctttataaccctggttcttcaaccattattaaccctattacaacagttaccttttgtgcatttattggcacaaaaca

SEQ ID NO: 2385 - DNA, 477 bp, Zea mays
  Clone ID: PAT_MRT4577_63860C.1
ctcaccagcggagtcttagggtatgagaaaacccacttctgcaaccctacaggatccaacaggcaatgacagctggcatcttacctttatcagccttggtcctcctacaatcatcaggcctattacatcatatacctttggtgcatttattggcacaaaacataagggcgcaacaactacaacaactcgcgctagcaaaccttgatgcctactatcaggaacagaagtttgttacattaaaccaactagcttggttgaactctgcttcttatttgcaacaacaacaactaccattcaggcagctacctgctgcctacccccagcaatttcttccattcaaccaactggcagcattgaactctcctgcttatttacagcagcaacaactactaccattcagccagctagctggtgcgagccctgctaccttcttgatacaaccacagctgttgccgatctaccagcacgctgcgccta

SEQ ID NO: 2386 - DNA, 428 bp, Zea mays
  Clone ID: PAT_MRT4577_63862C.1
gcaacatagaaagcacaacagtgtaccaacaatggcagccaaaatattttgcctccttatgctacgggggctttctgcaagtgctgctacggcgaccattttcccgcaatgctcgcaagctcctatagcttgccttcttccaccgtacctatcaccagcggagtcttacgtatgtgaaaacccaattcttcaaccctacaggatccaacaagcaatcgcagctggcatattacctttatcacccttgttacttcaacaatcatcaggcctattacaacagttacctttggtgcatttattggcaccaaacatcaaggctcaacaactaccacaacttgtgctaacaaaccttggtggctactgttagcaacagcaggttccttcattcgacccacttggctcattgaactccgcttcttaattgcaac

SEQ ID NO: 2387 - DNA, 495 bp, Zea mays
  Clone ID: PAT_MRT4577_63865C.1
tagcaaatagaattccaatagtgtaccaacaatggcagccaaaatattttgcctccttatgctccttggtctttctgcaagtgctgctacggtgaccattttcccacaatgctcacaagctcctatagcttcccttcttcccccgtacctctcaccagcgctgtcttcggtatgtagaaaacccaattcttcaaccctataggatccaacaggaaatcgcagatggcatcttacctttatcacccttgtatctccaacaatcatcacccctattacagaagttaccttcggagcatttactgcgcacaaaacatctgtgtactaccactacaacaacttgtgccagcataccttgctgcctactctcagcaacaacagcttcttcaattcaatcaattacctgcatggaactctgcttcttatttgcgactacaaagaactaccaatcaacccaactatgctgctgcctacccccaagaaatttccttcaattca

SEQ ID NO: 2388 - DNA, 450 bp, Zea mays
  Clone ID: PAT_MRT4577_63866C.1
caactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaccattaataagccttattacagcagttaccttgggggcattaattggcccaaaaaataagggcccaccacttccaacaactggggttagcaaacttggttgcttattttaacaacaacaagttttttcatttaacccactaactggattggactctgcttcttatttggaacaacaacaactaccattt

SEQ ID NO: 2389 - DNA, 475 bp, Zea mays
  Clone ID: PAT_MRT4577_63868C.1
agcatagagaccaactaacaacatatttagcacttttttggaccaacaatggcagccggggtatgtgtgcatcttatgctgcctgatatttctacacgagctgctacggtgaccattttcccgcaatgctcacaagctcctatagctatccttgttgccccgtacctctcaccagcggcgtcttcggtatgtgaaaacccaattcatcaaccctacatgatccaacaggcaatcgcagctggcatcttacctttatcacacttggtccttcaacaatcatgacccctattacagcatgtacctctggtgcatttattggcacaaaacatgatggcacaacaactacaacaacttgcgctatcaaaccttgctgcctactcttagcaacagcagtttcttacattcaaccaactaactgcattgaactctgcttcttatttgcaagaacaacaactaccattcaggcagctacctg

SEQ ID NO: 2390 - DNA, 396 bp, Zea mays
  Clone ID: PAT_MRT4577_63888C.1
acgcggacgcgtgggcgcaaccatttttccacaatgctcacacgctcctagcgcttactttctttccccatacctgttaccagcggggtcttcagtatgtgaaaacccaattcttcaaccctacaggatccaacaggcagtggctgaaggcatcttacctttataacccttgctactgcaacaaccggcagacctattacagccgttacctttggtgcatttgttggcacaaaacatcaagggacaacaactacaacaacttgtgctaggaaaccttgctgcctactctcagtaacaggagtttcttgcattcaaccaactggctgcattgaactctgctgcttatttgcaacaacaactaccattcagtcagctagctgctgcctacccccagca

SEQ ID NO: 2391 - DNA, 1436 bp, Zea mays
  Clone ID: PAT_MRT4577_6388C.1
gcgttccgaagcgccgtgctagattccacacctagacaggacgccgcacacggcagccaccctcgtgtgcgtgactgcgtctcgcgcgggcaagagtgcgcaggcagagccatggacgtagaagcgcgtaagtccgacgcgccgcccgcgcgcggcaaggcgatgcaccgctttctcgtagcgctcaactgcgggatgctggcggtgggagccatcggcgggccgctcctgagccggctctacttcagcaagggcgggcaccggcagtggctgtccgcgtggctggagaccggcgggtggccgctgctggtgattcccgtggcggcgtcgttcgtggcccgccgcgcgcgcgacaggggcgccccggtcctgctcgcgccgccgcggatcctgctggccgccgcgggcctcggcgtggccacgggcgcggacgacttcatctacgccttcgggctcgcgtacctcccggtgtccacgtccgcgatcctgatctcgacgcagctggcgttcacggtgttcttcgcgttcctcgtggtgcggcagcgcctgacggccgcgtccgtgaacgccgtggcgctgctgacggtgggcgccgtggtgctgggcctgcacgtctcgtcggaccggcccccgggcgtcaccaggggccagtactggctgggcttcgtgctgacgctcggcgccgcggcgctctacggcctcgtcctgccgctcgtggagctcgcctacaggcgcgccgcgggcgctggccgcgccgtgacgtacgcgctggtggtggagatgcagctggtgatggggttcttcgccaccgccttctgcacggtaggcatggtcgtgaacaaagacttccaggcgatcccgagggaggcgaggcagtacgagctgggggaggcccggtactacatggtgctggcgtgggcggcggtgctgtggcagtgcttcttcctgggcgcggtgggcgtcatcttctgcgtgcacacgctgctggcgggcatcctcatcgccgtgttcatcccggtgacggaggtggcggccgtcatcttcctgcacgagaagttcagcagcgagaagggcgtggcgctggcgctctcgctctggggcctcgcgtcctactcctacggcgagtggagccaggccaaggccaagaaggagaagaagagcgaggaggacgacggcgaagtggcccaggcagtcccatgatccgtgccccacacacacaaacacaatggtctgccccgttgtactctctgtctgtgtgtatgtaaatgttgtgttgattgcggccgtgttggtcctgtgaatggcgtcctgagtcgtcggttgtcagtgatgtttgatttccagggattaatcttttgtctcaaaattttcattttatttaataatttacatattaccatacaatagaatatatgaactaaaacgagttagacaag

SEQ ID NO: 2392 - DNA, 858 bp, Zea mays
  Clone ID: PAT_MRT4577_63892C.1
acagcagtatattgagaccactagtcaacgtaggaaagcactaatagtgtaccaacatatggcagtataacatattgcgcctacttatgctgcttggtctttctggaagcgctgctacggcgaccattttgccacaatgctgacaagctcctataggttagcttgttgccccggacctttcaccaacggggttttccgtgtgagaaaacccaattcttcaaccctacaggatccaacaggcaatcgcaggtggcgttttacctttatcacccttgttcctgcaacaatcatcagccctattacagcaggtacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctatctgctgcctacccccagcaatttcttccattcaaccaactgacagcatttgaactctcctgcttatttacagcagcaacaactactaccattcagccagctagctggtgtgagccctgctaccttcttgacacacccaccagttgttgccgtttctaccagcacgttgcgccctaacgctgggccctttcttacaactgccaccaattgctgccatttcaaccaaccttgcttttgccaaacccagccagccattctacccaccaaccccatcattggtggtgccctcttttagatttcttatgagttatagtccaataataaagttttttgtctgatgtttgtggcttcccagaaataagaaaggtccatttct

SEQ ID NO: 2393 - DNA, 662 bp, Zea mays
  UNSURE (1)..(662): unsure at all n locations
  Clone ID: PAT_MRT4577_63894C.1
  unsure (1)..(662): unsure at all n locations
acccttctttttaccttagaaggaccattattgtcccaggcggtgccatcacaaaatattttgggctccttatgctcccttggtcttttctgcaagtggctgcttaccggcgacacattttcccgaaatgctcgcaagctcctatagcttccctttttcccccgtacctttaaccagcggtgtcttgggtgtgggagaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaccaactacctttcagcctgttacctgctgcctgcccccagtcctttcttcctttcatcccactggccgcattgaactctcctgcttttttacagcccctacaactcctaccattcagcctgctttctggtgtgtgccctgctgccttcttgntccatccccaatctgttgccggtccttccggctcgctgcccctccccctggctcccct

SEQ ID NO: 2394 - DNA, 883 bp, Zea mays
  Clone ID: PAT_MRT4577_63895C.1
tcttaactagcaacatagaaagcgcaatagggtaccaacaatggcaggcaaaatattttggctccttatgctccttgggctttttgcaagggctggtacggggaccatttttcccgaaaggttggaaggttctatagctttccttttttccccgtaccttttaacaacgggggctttgggattgggaaaacccaatttttaacccttcaggattcaacaagcaattacaggtggcattttacctttatcacccttgttccttcaacaatcatcagccctattacgacgagttacctttggtgcatttattggcacaaaacattagggcacaacaatctacaacaacttgtgctagcaaaccttgttgcttactctcagcaacagcagtttcttccattcaaccaaataggttcattgaactctgcttcttatttgcaacaacaacaactaccattcagccagctacttgctgcctacccccagcaatttcttccattcaaccaactagcagcattgaattctcctgcttatttacagcagcaacaactactaccattcagccagctagctggtgtgagccctgctaccttcttgacacaaccacagttgttgccgttctaccagcacgttgcgcctaacgctggcaccttcttacaactgcaacaattgctgccattcaaccaacttgttttgacaaacccagcagtgttctaccaacaacccatcattggtggtgccctcttttagatttcttatgagttagagttcaataataaagtttttatcgatgtttgtggctcccagaaaaagaaatactcggccggaccacgtaggggaattcaatatccacacatggggcgtccgagctgcatagagggccata

SEQ ID NO: 2395 - DNA, 1134 bp, Zea mays
  Clone ID: PAT_MRT4577_63896C.1
ccaactagcatcatagaaagctcaataacgttccaacaatggctgctaaaatattttgactacttatgcttctaggtctttctgcaacgtctgctaccgctaccattttcccacaaggctcacaagcattctatagcttccattcttcccccgtacctatcaccaacagtgtgtatggtatgtgaaaacccaattctttaaccctacaggatccaacaggcaatcgcagctggcatcttacctttatcacccttggtcctccaacaatcatcagccctattacagcagttacctttggtgcctttattggcacaaaacatcagggcacaacaactacaacaacttgtgctagcaaaccttgctgcatactctcagcaacatcagtttcttccattcaaccaactggctgcattgaactctgctgcttatttgcaacaacaaacaacaactaccattcagccagctacctgctgcctacccccagcaatttcttccattcaaccaactagcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacccaacagcattctaccaacaacccatcattggtggtgccctcttttagatttcttatgagttatagttcaataataaagttttttgtctgatgtttgtggcttcccagaaataagaaagtacatttctagattcttatgtgcttctagtctccaaatgtggttgatagttattttgctctaagatcagcagtaatgaagtataaatcatcgttgtggtgtgctactcggttaattgagcattaacacacacaaacatgacgaggatggtataatctccaaaaatatgtactttgttaggtgggaccctatagccttgcataatgtgctatgttaggcatgcctggaaacgtgtgacgcatatgttttgtgaacctgttgatattatatgtgcttttaaaaaaaaaaaaaaaaaagcggattaatatttattact

SEQ ID NO: 2396 - DNA, 743 bp, Zea mays
  Clone ID: PAT_MRT4577_63901C.1
attgataccaaactgcctccttaaaaggcccattgtgtcccacattgcacttaggtatgtgcctcctatcctcctggccttctgcagtgctgctacagcgaccatgtttccacattgctcacaagctcctatagcttcccttcttacaccgtacctctcaccaacggtgtcttcggtatgtgaaaacccaattcttcaaccctacatgatccaacaggcaatcgcagctggcatcttacctttatcacccttgttcctccaacaatcatcagccctattacagcagttaccttaggtgcatttattggcacaaaacatcagggcacaacaactacaacaacttgtgctagcaaaccttgctgtctactctcagcaacagcagtttcttccattcaaccaactagctgcattgaactctgcttcttatttgcaacaacaacaactaccattcagccagctatctgctgcctacccccagcaatttcttccattcaaccaactgacaaatttgaactcttctgcttatttacaggagcaacaactactaccattcagccagctagctggggtgagccctggtacctttttgacacaaccacaattgatggcggtctaccagaacgctgggcctaacgcttgcacccttttacaactggaacaattgctggcatttaacccacttggtttgacaaaaccaacaagattctaccaaccacccaatattgggggggccctcttttaaa

SEQ ID NO: 2397 - DNA, 905 bp, Zea mays
  Clone ID: PAT_MRT4577_63923C.1
gctcttatacgactaactatacggaaagctggcacgcccgcaggcaccgatcctgtatagcgggcgcgatccacgcgttcgattgagaccaactagcaacatatactgcacaatagtggccaacaatggccgtcaaactataaagcctacttatgctccttgctctttctgaaagtgctgctacggccaccattttaccgaaatgctcgcaagctcctatagcttcccttcttcccccgtacctctcaccagcggtgtcttcggtatgtgaaaacccaattcttcaaccctacaggatccaacaggcactcacagcatggcatcttacctatatcacccttgttcctccaacaatcatcagccctattacatcagttacctttggtgcatttattggcacaaaacatcagggcacaacaactacaacaacttgtactagcaaaccttgctgcctactctcagcaacagcaggttcttccattcaaccaactagctgcattgaactctgctgcttatttgcaacagcaacaactaccattcagccagctacctgctgcctacccccagcaatatctaccattcaaccaagtgacagctttgaactctcctgcattatttacagcagcagcaactactaccattcagccagatagatggtgtgagccctggtacgttcttgacacaaccacaagtgtccccgttcacacagcacggtgcgcgtaacgctggcagcatgtatcaactgcacccaatgctgccattcagccaccttgctttgacaagcccggcagcattcggccagcaacccatcataggtggagccctgtaagagatttctcatgagcatagtcaagaataaagtcatctggtagatgcggtggattcgcggaaataaggaagaccct

SEQ ID NO: 2398 - DNA, 669 bp, Zea mays
  UNSURE (1)..(669): unsure at all n locations
  Clone ID: PAT_MRT4577_63926C.1
  unsure (1)..(669): unsure at all n locations
caaccatggccttcaaaatattttggcctcctaatcctcctgggccgttttgcaagtcctgttacggcacccattttcccgcattgctcgcaggctccaatagcttccttttttcccccgtacctttaaccagcggtgtcttcggtttgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccaggtacctgctgcctacccccagcaatttcttccattcaaccaactgggagaattgaactctcctgcttatttacaacagcaacaactactaccatttagncagctagctggtgtgagccctgctaccttttttggcacaaccacaggtggtggcggtctaccagcacggtgggcctaacgctggcacccctctttcaacttggaacaaattggttggcctttcaaccccaattnggttttgaac

SEQ ID NO: 2399 - DNA, 872 bp, Zea mays
  Clone ID: PAT_MRT4577_63927C.1
cacgcctgcgtgtaccgggcccctaattacacggtcgacctagcgttctttttataccactgcacatagaagcacattagtgtaccaacaatggcagccaaaaatttagactacttatgctccttggaatttctgcaagtgctgctacggtgaccattttaacgcaatgctcacaagactcctatagctgccgttcttcccccatacctctcaccagcggtgccttcggtttgtgaaaacccaattcttgaaccctacaggatccaacaggcaatctcagactggcatacttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccaacaatttcttccattcaaccaactggcagcattgaactctcctgcttatttacagcagcaacaactactaccattcagccagctagctggtgtgagccctgctaccttcttgacgcaaccacagttgttgccgttctaccagcacgctgcgcctaacgctggcaccataaaacagctgcagcaatcgctgccattcaaccgtcgtgctttgacaacccgagcagtgttctaccagcatcccatcgttggtggcgccctcttttagatttcttatgaggtatagttcggataataacgtttttttgtgtgaggtggttggcttcccagggataagagagtg

SEQ ID NO: 2400 - DNA, 697 bp, Zea mays
  UNSURE (1)..(697): unsure at all n locations
  Clone ID: PAT_MRT4577_63929C.1
  unsure (1)..(697): unsure at all n locations
caacaacggccgccaaaatatttagcctccttatgctccttggtctttctgctagtgctgtgtacggtgaccattttcctcgcatgctcacaagctcctataggttcccttcttaccactacctgtcaccagaagagtcttcggtatgtggaaaacccaattcttcaaccccacaagatccaacaggcaatggcaggtggcatcttacctttatcacccttgttcctccaacaataatcagccctattacagcaagtacctttggtgcatttattggcacaaaacatcagggcacaacaactacaacaacttgtgctaacaaaccttgctgcctactcttagcaacatcaggtacttccattcaaccaactagctgcattgaactctgcttcttatttgcaacaacaacaactaccattcaaccagctagctgctgcctacccccaggagtttcttccattcaaccaactggcagcattggactctcttgcttatttacagcagcaacaactactaccatttaaccagctaactggtgtgagccctgctaccttgttgatacaaccacagntggtgccggtctaccagcacgctgcgcctaacgctggcaccctgttacaactgcaacaattgctgccatggaaccaacttggctttgacaaacncagcagggtgtgtactacaacccatcatgggg

SEQ ID NO: 2401 - DNA, 782 bp, Zea mays
  Clone ID: PAT_MRT4577_63935C.1
atacgacttctatgaggaaagctgccgcgcccgcaggctccgatcctgtatagccggcgcgacccacgcgtccgattgagaccaactagcaacatagaaagcacaatagtgtaccaacaatggcagccaagaaattacgcctccttatgctgctaggcctttctgcaagagctgatactgcgaccattatcccgaactgctcgcaagctcctatagctccccttcttcccccgtacctctcaccaacggcgtcttgggtatgtgaaaacccaattcttcaaccctacaggatccaacaggcaatcacaggtggcatcttacctttatcacccttgttcctccaacaatcatcaggcctattacatcagttacctttggtgcatccattggcacagaacatcagggcacaacaactacaacgggctggtgctagcaaaccttgctgcctactctcagcaacagcagtttcttccattcaaccaactagctgcattgaactctgcttcttatttgcaacaacaacaactaccattcagccagctacctgctgcctacccccaacaatttctttcattcaaccaactggcagcattgaactctcctgcttatttacaacaacaacaactactaacattcaaccaactagcttgtgttaacccttcttacttctttatacaaccacaattggtgcccttctaacaacaaccttggcctaacgcttgcaaccttttaacacttcaaccattgcttgcattcaacccaattgctttgaccaaaccaac

SEQ ID NO: 2402 - DNA, 711 bp, Zea mays
  Clone ID: PAT_MRT4577_63936C.1
cacacattgaagacaccgctggtgagaggtatgggggaagaagggaagctataggagcttgtgagcattgtgggaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgcttatgagttatagttcaataatgaagttttttggatgatgtttgtggcgtcccagaaataagaaagtacatttct

SEQ ID NO: 2403 - DNA, 638 bp, Zea mays
  Clone ID: PAT_MRT4577_63951C.1
gacgaactagcaacatagaaagcacaattttgtaccaacaatggcagccaaaatatttgggtgccttatgctccttgggctttctgcaagtggtgctaccggaaccatttttccacaatggttacaagcttctatagctttccttctttccccataccttttaacaacgggggcttcaatgggggaaaacccaattggtcaacccttacaggtcccaccaggcatcggaaccaggcattctaccattataacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctaacttatgtgaacccttgttgctttttgacacaacaaccagtggtggccgtcttacctgcacgctatgcctaacgc

SEQ ID NO: 2404 - DNA, 807 bp, Zea mays
  Clone ID: PAT_MRT4577_63957C.1
accaacaatggcagccaaaatattttgcctccttatgctccttggtctttctgcaagtgctgctacggcgaccattttcccgcaatgctcacaagctcctatagcttcccttcttcccccatacctctcaccagtggtgtcttcggtatgtgaaaacccaattcttcaaccccacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacatcagtttcttccattcaaccaactagctgcattgaactctgtttcttatttgcaacaacaacaactaccattcaaccagctagctgctgcctacccccagcagtttctttccattcaaccaactggcagcattgaactctcctgcttatttacagcagcaacaactactaccatttagccagctagctggtgtgagccctgctgtcttcttgacacaaccacagttgttgccgttctaccagcacgctgcgcctaacgctggcaccctcttacaactgcaacaattgttgccattcaaccaacttgctttgacaaacccagcagtgttataccaacaacccatcattggtggtgccctcttttagatttcttatgagttacagttcaataataaagttttttgtctgatgtttgtggcttcccagaaataagaaagtacctgcccgggcggccgctcga

SEQ ID NO: 2405 - DNA, 679 bp, Zea mays
  UNSURE (1)..(679): unsure at all n locations
  Clone ID: PAT_MRT4577_63959C.1
  unsure (1)..(679): unsure at all n locations
ctacaggatcgcaacccaggcaatcgcagctttggcatcttaacctttatcaacccttgnttcctccaacaatcatcagcccctattacagcagttacctttggtgcattaattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccaacaatttcttccattcaaccaactggcagcattgaactctcctgcttatttacagcagcagcaactactaccattcagccagctagctggggtgagccctgctaccttcttgacacaaccacagttgttgccgttctaccagcacgcttggcctaaagcttggacccttttacaactgcaacaattggtggcattcaaccaacttggtttgacaaaactaacaatggtctaacaacaacccatcattggtgggggcctcttttaaaattcttatgaagtataagtcaataataaaagtttttggctgatggttggggcttcccaaaaataagaaaggacatttctagatttaaaaaaaaaaaanaaaaaaaaaaaaaaaaaannnnnnnccccc

SEQ ID NO: 2406 - DNA, 765 bp, Zea mays
  Clone ID: PAT_MRT4577_63961C.1
cattggcagccaaaaaagatggcctaccttactgctcacttagctcctttctcgcaagtgactgatacgtgcgaccatattttccgaaatgctcgcaagctcctatagctcacgttcttccaatgtacctctaaccagcggtgtcttcggtatgtgaaaacccaaatcttcaaccctacaggatccaacaggaaatcacagctggcatattaactatatcacccttgttcctacaacaatcatcagccctataacatcagttaccttaggcgcatttattggcacagataatcagggcacaacaactacaacaacttgtgctaccaaaccttgctgcctactgtaagcaacagcagtttcttccattcaaccaactaactgcattgaactttggttcttatatgcaacaacaacaactaccatgcagccagctacctgctggctacccccagcaatttctttcattcaaccaactggcagcattgaactcttctggttatttacaggagcaacaactactaccattcaaccaactaactggtgggaaccctggttactttttgatacaaccacaagtggtggcggtctaacaacacgctgggcctaaagctggcacccttttacaactgcaacaattggtggcctttaacccacttggtttgacaaaaccaacaagggtctaacaacaacccattattggtggtggcctcttttaaaattcttaagaggtataagtcaataataaagatttttatttgaaggttg

SEQ ID NO: 2407 - DNA, 815 bp, Zea mays
  Clone ID: PAT_MRT4577_63967C.1
tgaccaggatctagatggtgagatcttcgtcagaaaggcagccatggccatgatgaggctgtgaagggttttaggtggacgatgaacatatatgaatatatagttgtactgttctagggcttcagtagaagccatgctaccgtgttaaaaaaaaaattatcacacatattattaagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacaactaccaccattcagccagctagctgatgtgagccctattggccttcttgacacagcacagttgttgccgttctacctgcacgctgcgcctaaacgctgc

SEQ ID NO: 2408 - DNA, 706 bp, Zea mays
  Clone ID: PAT_MRT4577_63970C.1
aaggaaagcacaatagcgtaccgagaatggcagacaaaaacatcaggctgattatgatcgttggtgtttctggacgggctgttacagctaccattttctctgaaaggtagaaagcttgtataggttccgttcttcaggcgtagctctgaccagcggcgtgtttggcatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacagcaacttacaacaacttgtgctagcaaaccttgctgcctattttcagcaacagcagttttttccattcaaccaacttagctgcattgaactctgcttttattttgcaacaacaacaacttaccattcagccagctatctgctgcctacccctagcattttttccattcaaccaacttacagcattgaactttcctgcttatttacagcagcaacaactactaccattcagccagctagttggttgtgagccctgctaccttcttgatacaaccacagttgatgccgttctaccagcacgctgcgcctaacgctggcaccctcttacaactgcaacaattgctgccattcaaccaactttgctttgacaaacccagcagcgttctaccaac

SEQ ID NO: 2409 - DNA, 2985 bp, Zea mays
  UNSURE (1)..(2985): unsure at all n locations
  Clone ID: PAT_MRT4577_63975C.1
  unsure (1)..(2985): unsure at all n locations
atcctccctctctctctctcatcgtcctcctccgcgttctctcgtctccatctgcctctctttctgccaccacagagaactcttcttggagagcctgtgaatctcgagaggcattgagtccgtcttgagttgttgttagtgtcgccttggtctttcgtttttggctttcgtgccgatcaactccggtgctgttcggcggcagtcgcgatggccggcggcgcggttgtgaacaccggcggggggaaggactaccccggcaagctcaccatgttcgtgctcttcgcctgcatcgtcgccgccaccggcggcctcatcttcggatacgacataggcatctccggtggcgtgacctcgatgaaccccttcctgatgaagttcttcccgggcgtgtaccaccaggagcaggaggcggagcggaaccagagcaaccagtactgcaagttcgacagccagctgctcaccatgttcacctcctcgctctacctcgccgcgctcgtcgcctccttcttcgccgccaccgtcacccgcgtcgccggccgcaagtggtccatgttcgccggcggggtcacctttcctcgtcggcgccgcgctcaacggcgccgccaagaacgtcctcatgctcatcctcggacgcgtcctgtcggnnatcgggggtcggcttcgccaaccagtccgcccccggccgggagggacctgcaggccacctcgacctccttccgttcctcgtcgtctcgtgttgtttctcgcgttgccattgccccagctgtccgcccgcgcccgcggcaatggcaggcggcgtggtggtgaacgcggccgggggcaagacgtaccccggccgcatgacgccgttcgtgttcttcacctgcctggtggcgtcatcgggcggcctcatcttcgggtacgacatcggcatctccggcggtgtcacgtccatggcgtcgttcctcaaggagttcttcccttccgtgtacgccaaggcggcggcgaacaaggacacgaaccagtactgcaagttcgacagccagctgctgacgctgttcacgtcgtcgctgtacctggcggcgctggcgacgtcgttcgtggcggcgtccgtgacgcgggtgttcgggcgcaagtggtccatgttctgcggcggggtgaccttcctggccgggtcggcgctgaacggcgccgccaccgacgtgatgatgctcatcatgggccgcatcctgctgggcgtgggcgtcggcttcgccaaccagtcggtgccgctgtacctgtcggagatggcgccggcgaagctgcgcggcatgctcaacatcgggttccagctgatgaccaccatcggcatcctggcggcgaacctgatcaacttctggacggcgggcatcgagggcgggtggggctggcgcatcgggctggggctcgcgggcgtgccggcgctcatcatcaccctgggcgcgctggtgctccccgacacgcccaactcccttatcgcccgcgggttcaacgacgacgccaaggcggtgctggtgaagatccgcggcacggacgacgtgcaggacgagtacgacgacatggtggcggcgagcgaggaggcgaacgccatcgagcacccgtggcgcaacatcctggagcgcaggtaccggccgcagctgacggtggcagcgctgatccccttcttccagcagctgacgggcatcaacgtgatcatgttctacgcgccggtgctgttcctgaccatcggcttcggcgacgacgcgtcgctgatggcggccgtcatcacggggctggtcaacatgttcgccaccgtggtgtccatcgtgtgcgtggaccgcctgggccggcgcgcgctgttcctgcagggcggtacgcagatgttcgtctcccagatcgtggtgggcacgctgatcgcgctccagttcggcaccgccggcgtgggcgagatgtcccgctccaacgcctggctgctggtgctcttcatctgcctctacgtcgccgggttcgcctggtcgtgggggccgctgggctggctcgtcccctcggaggtgttcgcgctggaggtccggtcggcggggcagagcatcgccgtgtgcgtcaacatgctgctcaccttcatcatcggccaggccttcctcagcatgctgtgctcgctcaagttcgggctcttctacttcttcgccgggtggatgttcatcatgaccaccttcatcgccctcttcctgccggagaccaagggggtgcccatcgaggagatgaacctcgtctggagccgccactggttctggggcaagtacgtcaacgtcgacacacaacacggcggcgccagcccgagatccaacggcgtctgatctgagcaagctgcagcaacacctcggcacctgacctggccatgcatgcacacgtatactataatctaacaacgtagctgacctgggcaaattgccagcctgacaggggccagggtgctcgaatgtctcactctcaccgccgactaactttccatcaaaattgattcttgttcatactccatagcatgcacagattgattgaactgctacttgagattcttgtcattgttattagagagagagacagagacagaacgattggcatagcatgcagaattgtttggaagaagctagcaaagcagttccttgtttgtatcctctgtaccagaagatgagtttgatctaggattaatccctgcaaggcaaggtaaagtaaattcatgttgtactcaaaactaacttctcccatatctgtacgtcgtataaaacaaatccctgcaatgtgcaaagattgtcccgcgtagtgattttttcgtctccagcaagatctcaaacaagccccaaatctaagtgtaacatgtttgcattcgaattaaaaaattgaatcccttattgtgacaaaaaaaaaactgaacccggccgcgacagctgtttttgtaatggttgaatatatgctaaaatagtgccttggcgaaaaaaaaaaaaaaaagcggcc

SEQ ID NO: 2410 - DNA, 780 bp, Zea mays
  UNSURE (1)..(780): unsure at all n locations
  Clone ID: PAT_MRT4577_63994C.1
  unsure (1)..(780): unsure at all n locations
tggcatcttataaagcccactattgtgccaacaatggcggccaaaattttttgcctccttatgctccttggactttctgcaagcgctgttaccgggaccattttcccgaaatgctcgcaagctcctatagctatccttctttcgccgcacctctcaccagcggtgtcttcggtatggggaatcccaattcttcaaccctacaggatccaacaggcaatcgcagctggcatcttacctttatcacccttgttcctccaacaatcatcagccctattacaacagttacctcttggtgcatgtggttggggcagaacatcagggcacaacaactacaacaacttgtgctagcaaaccttgctgcctactctcagcaacagcagtttcttccattcaaccaactaggttcattgaaccttgcttcttatttgcaacaacaacaactaccattcagccagctacctgctgnctacccccagcaatttttttcattcaaccaactagcagcattgaactcatctgcttattacagcggcaacaactactaccattcagccagctagctggtgtgagccctgctaccttcttgacacaaccacagttggttgccggtctaccaggacggttgcgcctaacgcgtggggccctcttacaactgcgacaattgctggcctttgaccaacttgctttggcaaacccagcaggggtgtaccaacaacccctcattgggggggggctcttttggatgtagcttgggggggtagggagaggaaccccccccca

SEQ ID NO: 2411 - DNA, 879 bp, Zea mays
  Clone ID: PAT_MRT4577_63998C.1
aaaaaaaaaatacacatattattaagaccaactagcaacatagaaagcacaatagtgtaccaacaatggcagccaaaatattttgcttccttatgctccttggtctttctgcaagtgctgctaccgcgaccattttcccgcaatgctcacaagctcctatagcttcccttcttcccccatacctctcatcagcggtgtcttcagtatgtgaaaacccaattcttcaaccctacaggatccaacaggcaatcgcagcaggcatcttacctttatcacccttgttcctccaacaaccgtcatccctattacagcagttacctttggtgcatttgttggcacaaaacatcagggcacaacaactacaacaacttgtgctagcaaaccttgctgcctactctcagcaacagcagtttcttccattcaaccaactggctgcattgaactctgctgcttatttgcaacaacaactaccattcagccagctagctgctgcctacccccagcaattacttccattcaaccaactggcagcattgaactctgctgcttatttacaacaacagcagctaccaccattcagccagctagctgatgtgagccctgctgccttcttgacacagcaacagttgctgtcgttctactcgcacgctgcgcctaacgctggcaccctcttacaactgcaacaattgctgccattcaaccaacttgctttgacaaacccagcagcgttctaccaacaacccatcattggtggtgccctcttttagattgcttatgagttatagttcaataatgatgttttttggatgatgtttgtggcttcccagaaataagaaagtacatttctaaaaaaagaaaaaaaaaaaaaaaaaagcggcc

SEQ ID NO: 2412 - DNA, 904 bp, Zea mays
  Clone ID: PAT_MRT4577_63999C.1
ctttttactcggctcggatccctagtaacggcgcgccagtgtagctggcaatagggccttatcttcatagtggcgtgaggctgtttggttatcttctagcaaacctccagcatgctccaaaaaactctattattgaactataactcataagcaatctaaaagagggcaccaccaatgatgggttgttggtagaacgctgttgggtttgtcaaagcaagttggttgaatggcagcaattgttgcagttgtaagagggtgccagcgttaggcgcagcgtgcaggtagaacggcaacaactgttgctgtgtcaagaaggcaatagggctcacatcagctagctggctgaatggtggtagttgttgctgttgtaaataagcagcagagttcaatgctgccagttggttgaatggaagaaattgctgggggtaggcagcagctagctgactgaatggtagttgttgttgcaaataagcagcagagttcaatgcagccagttggttgaatggaagaaactgctgttgctgagagtaggcagcaaggtttcctagcacaagttgttgtagttgttgcgccttgatgttttgtgccaacaaatgcacataaggtaagtgctgtaatagggctgacggttgttggaggaacaagggtgataaaggtaagatgcttgctgagattgcgtgttggatagtgtagggttgaagaattgggttttcacatactgtagataccggtggtgagaggtatgggggaagaaaggaagctataggagcttgtgagcattgtgggaaaatggttgaggtaggagcgcttgcagaaataccaaggagcctaaggaaggggaatattttgactgtgattaaaggtacgattattgtgctttatatgctgccgcaggcgtgggtcg

SEQ ID NO: 2413 - DNA, 735 bp, Zea mays
  Clone ID: PAT_MRT4577_64005C.1
acccaatggcccagccaaaatatttgtggcctgggcttatgctccttgggtcttgtctggcaagtgccctgctacgcgcgaccccattttcccgcaatggctcgcaagactcctatagcttcccttcttcccccgtaccctctccaccagctggtgtctttcggtatgtgaaaacccaattcttcaaccctacaggatccaacccaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccccagcaatttcttccattcaaccaactagcagcattgaactctcctgcttatttacagcagcaacaactaccaccattcaggcagctagctgatgtgagccctattgccttcttgacacagtgacagttgttgccgttctacctgcacgctgagcctaatgctggtaccctgttacaactgaaacaatggtgtggcttcaaacaacttgctgtgacaaacccaacaggggtctaccaacaacccatcatgtggtggtgccctccttttaga

SEQ ID NO: 2414 - DNA, 1303 bp, Zea mays
  UNSURE (1)..(1303): unsure at all n locations
  Clone ID: PAT_MRT4577_64024C.1
  unsure (1)..(1303): unsure at all n locations
gctatagtccacaatctcgaggaaagagcagccctgaggcagccaagtctttcgtccagtgggangacagaggacagtttggcaccaagggcacacaacaacagtgtgggagtgcctgaaagcagcggctacgctgaagcccccctggcagttaacacgccacgaagagcgcagggatcgcacatattattgagaccaactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctatctgctgcctacccccagcaatttcttccattcaaccaactgacagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacccagcagcattctaccaacaacccatcattggtggtgccctcttttagatttcttatgagttatagttcaataataaagttttttgtctgatgtttgtggcttcccagaaataagaaagtacattggtcgattctaaataaaaataacaaattcacaaaaaacgcaggtgtacccaaacttgcaacaccagaaggagctgttgtagttcatctaacaattgcatacttttgctttgtacgtcaatattctatgggccatgaatacattttctgttaagtacaatggtcaatgttcacacttcactcgtggtttcattgttgatgagaaaaaaatnanagactgtaatatgtgtacattgtatttgngtatggnctattatttgtatgcccatggggtgtgttactacctgctg

SEQ ID NO: 2415 - DNA, 1272 bp, Zea mays
  Clone ID: PAT_MRT4577_64025C.1
agatgcatccacacatacaagggtcatacccaacgaattaatgtgcttaaatttactcctgatggccgatggattgtttctggtggggctgataactcagtgaaggtccagtcaactgcttatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacaacagtttcttccattcaaccaactagctgcattgaactctgcttcttatttgcaacaacaacaactaccattcagccagctatctgctgcctacccccagcaatttcttccattcaaccaactgacagctttgaactctcctgcttatttacagcagcaacaactactaccattcagccagctagctggtgtgagccctgctaccttcttgacacaaccacaattgttgccgttctaccagcacgctgcgcctaacgctggcaccctcttacaactgcaacaattgctgccattcaaccaacttgctttgacaaacccaacagcattctaccaacaacccatcattggtggtgccctcttttagatttcttatgagttatagttcaataataaagttttttgtctagaaatgtactttcttatttctgggaagccacaaacatcagacaaaaaactttattattgaactataactcataagaaatctaaaagagggcaccaccaatgatgggttgttggtagaatgctgctgggttttcacatactaaagcggtcattgatggaaggtatgggggaagaagggcagctataggagcttgtgagtattgagggaaaattgtcgcgttagcaacacatgtagaaagagcaaggagcataaggagggaaaatatcttggtcgccattgttgctctattgttgctaatggattctactttctatgttgcttgccggacgcgtgggcggacgcgtggg

SEQ ID NO: 2416 - DNA, 1493 bp, Zea mays
  Clone ID: PAT_MRT4577_64028C.1
ggccgcttttttttttttttttttaagaatctagaaatgtactttcttatttctgggaagccacaaacatcatccaaaaaaacttcattattgaactataactcataagcaatctaaaagagggcaccaccaatgatgggttgttggtagaacactgctgggtttgtcaaagcaagttggttgaatggcagcaattgttgcagttgtaagagggtgccagcgttaggcatagcgtgtaggtagaacggcaacaactgttgttgtgtcaagaaggcagcagggctcacatcagctagctggctgaatggtagtagttgttgctgctgtaaataagcagcagagttcaatgctgctagttggttgaatggaagaaattgctgggggtaggcagcagctagctggctgaatggtagttgttgttgcaaataagcagcagagttcaatgcagccagttggttgaatggaagaaactgatgttgctgagagtatgcagcaaggtttgctagcacaagttgttgtagttgttgtgccctgatgttttgtgccaccaaatggaccaaaggtaactcttgtaatagggctgacggttgttggaggaacaagggtgataatggtaagatgcctgttgcgattgcctgttggatcctgtagggttgaacaattgggttttcacacactgaagacaccgctggtgagaggtatggggaaagaagggaagctataggagcttgtgagcattgtgggaaaatggttgcggtagcaacacttgcagaaagaccaaggagcataagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactagcagcattgaactctgctgcttatttacaacagcaacagctaccaccattcagccagctagctgatgtgagccctgctgccttcttgacacaacaacagttgttgccgttctacctgcacgctgcgcctaacgctggcaccctcttacaactgcaacaattgctgccattcaaccaacttgctttgacaaacccaacagcgttctaccaacaacccatcattggcggtgccctcttttagattgcttatgagttatagttcaataatgaagttttttggatgatgtttgtggcttcccagaaataagaaagtacatttctagattctt

SEQ ID NO: 2417 - DNA, 862 bp, Zea mays
  Clone ID: PAT_MRT4577_64032C.1
ccgggccgggaatcgcacatattatttagaccaactagcaacatagaaagcacaatagtgtaccaacaatgcgcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttcccagaaataagaaagtacatttctagattctt

SEQ ID NO: 2418 - DNA, 873 bp, Zea mays
  Clone ID: PAT_MRT4577_64035C.1
atcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctagattctaaaaaaaaaaaaaaaaaagcggcc

SEQ ID NO: 2419 - DNA, 500 bp, Zea mays
  Clone ID: PAT_MRT4577_64087C.1
cccacgcgtccggcttgctggtttcaacaaggatgacaagcagctggatgctgatatccatcgcaagtacatctatggtggccatgttgctaactacatgaagaacctcgctgaataggagcccgacaagtaccagtctcacttcagagagtacattaagaaaggaattgaggctgatgacatggaagctctgttcaagaaggtccatgctgccatccgagctgatccttctgtggacaagtgaacgaagcaaccaccaaaggagctcaagatgctcaagctccagaaactgacgtacgagacagaggaaggccagacttattgaaaggctctagccaatcaactcctcggacggcgcatatgacgacgatgaggatgacgagtctggtctggacctatcgaagaagtgctatcttatgcggcgatcactatttgagctatagcattaatcgctacctgtagtcaggctgcatgcattattgttcaaggctgtcaatgcg

SEQ ID NO: 2420 - DNA, 409 bp, Zea mays
  Clone ID: PAT_MRT4577_64111C.1
ccggctctagccactcgtccttcgacatataaagcacaatattttaccttcaatggcagccaaaatattttgcgtccttgtgctccggggactgtctgcaaccgctgctaccgtgaccattttaccacaatgctcacaagcttctatagcttaccttcttcccccatacctctcatcatcggtgtcttcagtatgtgaaaacccaattcttcaaccctacaggatccaacacgcaatctcatcattcattatacctttatcacccttgatccttcaacaaccttcatccctattacagcacttacctttgatgcatttgatggcacaaaacatcaagacacaacaactacaacaacttgtgctatcaaaccttactgcctactctcataacaatcaaataattcaatta

SEQ ID NO: 2421 - DNA, 120 bp, Zea mays
  Clone ID: PAT_MRT4577_64349C.1
agaggtgggctggcttgtcctgcccctgttaccaagtcgtcctcgggtcagggttccttagggctttgtggaagggctatggcggccgctgatgtggagcaccgttggctcgtcggccgg

SEQ ID NO: 2422 - DNA, 652 bp, Zea mays
  UNSURE (1)..(652): unsure at all n locations
  Clone ID: PAT_MRT4577_64409C.1
  unsure (1)..(652): unsure at all n locations
aatatatctncgaacgggaatttgagctcaacacaaacatgatgcctaatgaagatgatttgcaagattttgctgcaacaagtgtgaaggccaaaaactggaaacgcatggcaacaaattcaagcaaacatcggcacctcggcagattttattaatggagacaagagtagaaatggttcttttgggcatcaccatgctcgaactctgaaagggccgtgccgtagtctaacgttaagcacatactatgtgcctgccactacgagcagcagaaagtggagtggcacgcaagcaggaatacaggatggacaaaatcggcaggccattgtgcgttagtctatcttagcgaaatgtacacttggtccagcaggtacacaagtccatctttatttcacatggtcaaacagccgaaaacaaacccgcgcagatgagtattgtccattaagacaattcaagcaagaacattttcgtacacctctccagcatatttccagttcatcaccttccagatgttgttcaggtaatccggcctaacattcttgtactgcaggtagtacgcatgctcccagacatcaatccccaacagcggaaccaagcttgcacctttagtcaccagaggatcctgattaactgtagtttcaactgaaagcttttt

SEQ ID NO: 2423 - DNA, 219 bp, Zea mays
  Clone ID: PAT_MRT4577_64410C.1
tttttgatacctcccgtattgtcgaacatccccaagtgcgtacgcgtgcgtgtgagagtgatatcgagcgcccgccgtgttgtgcgcgcgtacgtatgtatgcgctcgtgtgatgcacgaataagcgtggctacttaatctatcgtatggatacgtgtgtgtatgcatgagcttgtgtatgatcatggtacaaggaccgaaataatgtattcatctctg

SEQ ID NO: 2424 - DNA, 212 bp, Zea mays
  Clone ID: PAT_MRT4577_64472C.1
gggggcgcatgagggaggcatataaactctgaccaaaaattggagcagcaggtcacaagggtcagccaaaaactaagaccgcccaacgggtttgggatcccttacttcaaaaggcagggggggattcgacccccagattttaccccaaaaatccgggggaacctttagcctagctagagcccggggccccccagggggcgaagcaaaggcaa

SEQ ID NO: 2425 - DNA, 368 bp, Zea mays
  Clone ID: PAT_MRT4577_64503C.1
acgacggcgggccgcgggggccggcgatgaagcctgcgggaggaacggaacgtgaccctcgaggcgggcaaatctggatgcttccttccagccgacgcatcccatcccatacagccccgggacgtacggtgatcggtgaccccactccatcccacggccacgccacacctcctctccacctcctcgtcctcgattcccaagcagtcagtcttcctcgtcactcgcctcctcccgttaggtacgctggcgagccgtcggccgccgtcccttcctccctggatttgattggtgctcgcggctgcagcccagcgagttccttgattcggctgggagcaccgccatcgccatgggatggcaccgctggctgt

SEQ ID NO: 2426 - DNA, 474 bp, Zea mays
  Clone ID: PAT_MRT4577_64568C.1
cacccgccccaaccaattttattgatatttaatactaaacagtggggggcttaaaaccataaaaaatacagggtccaaaatgtaaccacagataatgcaaacacggggcaacacccaacaatccctgcatttgtttttgccataccaaaagccacctaaacccaaatggatgtctttgaagcattccttgaaacactttttttttcaatttaggttttgaaatacagtattccaaggcaggaaagttatttggggccaaaatccttaagggcccaaatctgctcttcccccttagcaaactggacagtcacaacaagatccttgccgttttaaaacctttccttgttttgggccacaagagtctaataagttgggagtctaagaccatccttagcgtcgccatcggaagtaaaaaggctaacaaatccatcctctgatatattaataagctggtcctcaggacggttcacatgc

SEQ ID NO: 2427 - DNA, 2938 bp, Zea mays
  Clone ID: PAT_MRT4577_64622C.1
ccgtccgggaaaaaaaaaaaaaaaaaaaaaaaaaaaaaataccctcgaggccggccgggtcctctccgctctgctccctccgccgtgcgctcgaacgaactccacacgaaattctccgcgtaaagttggggagcagcgaacccgtagcgcgcgccccggatccctccacggggggcaatggcctcgtcggcgttcctgcccgagctgggcacgcaggtggtggtgcccgtcgcggccgtggtaggcatcgcgttcgcggtgctgcagtgggtgctggtctccaaggtgaagctctcccccgagccgcgccgcggcgacggctccgccgggaagagcggcgccggcgccggcgccagcgagtacctcatcgaggaggaggaggggctcaacgagcacaacgtcgtcgtcaagtgcgccgagatccagaacgccatctccgaaggagcaacttctttccttttcaccgaatacaagtatgtgggactattcatgggcatttttgctgtcctgatcttcctcttccttggttctgttgagagcttcagtaccaagagtcagccatgccactacagcaagggcaagacgtgcaagcctgcccttgccaatgctatcttcagcaccattgcctttgtgcttggtgcagtcacctctcttgtttctggtttccttggaatgaagattgccacatatgcaaatgccaggacaactcttgaggctaggaagggtgttggaaaggcattcattactgctttccgctctggtgctgtgatgggcttcctgcttgctgctagtggcctttttgttctttatattgcaatcaacttgtttggaatttattatggtgatgactgggagggcctttatgaggctatcactggttatggtcttggtggttcttctatggctctttttggtcgtgttggtggtgggatttacactaaagctgctgatgttggtgctgatcttgttgggaaagtcgaaaggaatatccctgaagatgatccgagaaacccagctgtcattgcggacaatgttggtgacaatgttggagatattgctggtatggggtcagatctctttggctcttatgctgagtcttcatgcgctgcacttgtcgttgcctcaatctcttcattcgggatcaatcatgaattcacccctatgttgtacccactcctcattagctctgtgggtatcatagcttgcttgataaccactctttttgcaactgatttctttgagatcaaggctgtagatgaaattgagccggctctcaagaagcagcttataatttccactgctgtgatgactgttggcattgcacttgtcagttggttagggcttccatatacattcacaatcttcaactttggtgtgcagaagacggtgtataactggcaattattcctatgcgtggcagttggtctgtgggcaggactagttattggatttgttacggagtattacacaagcaatgcatacagtcctgtacaggatgttgctgactcctgcagaactggagctgctacgaatgtcatctttggccttgctctgggatataaatccgtcattatccctatttttgctattgcttttagtattttcctcagcttcagtcttgctgccatgtacggtgttgctgtggctgctcttggaatgctcagcacaatcgctactggccttgccattgatgcctatggtcctatcagtgacaatgctggaggaattgctgaaatggctggcatgagccacagaatccgtgagagaactgatgctcttgatgctgctggaaatactactgctgccattgggaagggttttgcaataggttcagcagccttggtgtctcttgccctctttggtgcttttgtcagccgtgctgagatctcgactgttgatgttctgacacccaaagttttcattggactgattgttggtgccatgctcccatactggttctcagcgatgacaatgaagagtgttggaagtgcagcactcaagatggttgaggaagtccgcaggcagttcaacaccatccctgggctcatggagggcattaccaagcctgactatgcgacgtgtgttaagatctctactgatgcatctatcaaggagatgatcccacctggtgcacttgtcatgcttacacctcttattgtggggatcttctttggtgttgaaaccctctctggagttcttgctggtgctcttgtttctggtgtccagattgccatctctgcatccaacactggaggtgcctgggacaacgcaaagaaatacattgaggctggtgcatctgagcatgcaagaaccttgggcccgaaaggttcagacccacacaaggctgctgtcatcggtgacaccatcggtgatcccctcaaggacacctcaggcccctcgctgaacatcctcatcaagctcatggctgtcgagtcccttgtctttgctcccttcttcgccacccatggaggcatcctcttcaaatggctttagaggaagaatggaagatggatgggtagtttatttttgccgggggagagcactagatatatgtcatagagaagtttcagtttacccatatggtgcacttcatccttttttgtttcgcttgtactgtgtcgcagtcttgttgaacttgtcagccgtggtatcacctagtttttgggtctagatgcagtagccgagtggagcaaaaacgtctagcattctacaggattggaatttggacatggatgtgttgggaagtttgatactgcatgtagatatttcgaaaaaaaaaaaaaaaaaccgtccacatccgtcctccagcactccacctgcatcgacgaggaacgccgtagcgatttgcgaagcgaagcgggacgggagaggaaccccgaggaaggccaaaatgatctaccgctactggacgctgctctcgactacagactaaatttgg

SEQ ID NO: 2428 - DNA, 399 bp, Zea mays
  UNSURE (1)..(399): unsure at all n locations
  Clone ID: PAT_MRT4577_64676C.1
  unsure (1)..(399): unsure at all n locations
ggtgatagtaaatgatcaatggggagacagccggctgtgacaaggagggggtgaagcgagggccatggacagcggagaggacaagaagctcattagcttcatcctgacacatggccggtgctgctggcgggcagtgcctaaactcgcagggctgcttcgttgcggcaagagctgccgtctgcggtggactaactatcttcgccctgacctcaagcgtggcctcctcagcactgccgaggagcagcttgtcattgacctccatgccaagctcggaaatagatggtcccagattgctgccaagttgcctgngagaacagacaacgagatcaagaaccactggaacacgcacatcaagaagaagcttgtcaagatgggtgtcgacccggccacacacgagcc

SEQ ID NO: 2429 - DNA, 2991 bp, Zea mays
  UNSURE (1)..(2991): unsure at all n locations
  Clone ID: PAT_MRT4577_64700C.1
  unsure (1)..(2991): unsure at all n locations
cgcacgcgtccgcccacgcgtccgctgtaaaaggattggctctgagggttgggctggggggttccggccccgaacccgtcngctgctggcggaatgctcgagctgctcgcgcggcgagagcgggccgccgcgtgccggccgggggacggaccgggaacggccccctcgggggccttccccgggcgtcgaacaaccgactcagaactggtacggacagtccagtccctgtacctccgtataaaccctagtacctcttatccgttcgtcactccccaagcgtcacaccgaatcaccacagtcgagctcgagcaggaacaagccgtgagcgcctgcccccggtgctcaatatctattccacacctcatggcgccggcgctgagcaggaccctggggccgtcgtcggtggccgcgctgcgcccgagcccgtcgtgccggggtctgttacgggccgcgctcgcgccgcagggcaggggcgcctccgcgaggtgcgcggtaggggtgagatgggaggcagccaggcggaggaggatggccggggtgaggtgcgacgccgccgtcgctgagaagcctgccggcgaggaggagacggccggcgagaagtacgagtaccaggctgaggttacccgcttgatggacttaattgtacacagtttatacagccacaaggaagtatttttacgtgagcttgtaagtaacgcgagtgatgcactggataagctgagattcctcagcgtaactgatccttctgtgttggctgatggcggtgagttggagataaggattaaacccgacctagaggcggggacaatcactatcacagatactggcattggaatgactaaagatgagctcaaagactgtcttggaaccattgcacaaagtggcacctcaaagtttttgaaggctctaaaggagaacaaagaccttggtgcagataatggactcattggtcaattcggtgttgggttctattccgctttccttgttgcagagagggttgtggtgtctactaaaagtccaaaggcagataagcagtatgtgtgggaagcagaggctgacagcagctcgtatgttatcaaggaagaaaatgatcctgagaaaatgctttcacgtggaacagaaattactctttatttgagagatgatgacaaatatgagtttgctgaccctaccaggattcaaggcttagttaagaactactcgcagtttgtctcattccccatatatacatggcaggaaaaatcaagaacagttgaggttgaagaggaggaagaatcaaaaggtgaagaggctactgaagaatcaaaaagtgaagaggctactgagggtgaaaagcagaaaaagaagaaaaccataactgagaagtactgggactgggaattggctaatgaaacgaagcccatatggatgaggaatccaaaggaagttgagaaaactgagtacaatgaattctacaagaagacatttaatgagtttctggatccgcttgcttacactcacttcaccactgagggagaggtggaatttcggagtgttctctatgtcccagggatggcgcctcttagtaatgaggagataatgaatccaaagaccaaaaacatccgattgtatgtcaaaagagtgttcatatcagatgattttgatggcgagctgtttcccagatacttgagctttgtgaaaggtgtagttgactcaaatgatctccctctcaatgtttctcgtgagatccttcaagaaagtagaattgtcagaattatgcgtaagagacttgttaggaagacatttgacatgattcaagagattgccgagaaggatggcaaagaggactacaacaaattctgggagagctttggcaagttcatgaagcttggttgcatcgaggacacaggaaaccacaagcgtcttgcaccattgctgagattctactcttccaaaaacgagacagatttaataagtctggaccagtatgtagaaaacatgcctgaaaaccagaaggcgatctattatatcgctactgatagtctccagagcgcgaagactgctcctttcttggaaaagctggttcagaaagatattgaggttctttacctcattgagccaattgatgaggttgccattcagaatttacagacatacaaagagaagaagtttgtagatattagcaaagaggatttggaattgggtgatgaagatgaggacaaggagaaagaaagcaagcaggagtatactcttctatgcgactggataaagcagcagcttggcgataaagtcgccaaggtccagatctcgaagcgactcagctcttctccatgtgttcttgtttctggtaaatttggctggtcagccaacatggaaaggctcatgaaggcacagacccttggtgacacatcaagcctggagttcatgagaggtagacgaatttttgagatcaaccctgaccatcctatcatcaaggacctgaacgctgcttgcaaaaacgagcctgaaagtactgaagccaagagggcggcagagttgctatacgaggctgcgctgatctccagtgggtatactcctgacagtccagcggagctgggaggcaagatctacgagatgatgaccatggccctcggcgggagatgggggaggttggagacagaggaggctgaagtcatcgccagcatcgacgacgcggactcgtctgaaggtgccacgaccacgacagaggtagtcgagccctctgaggtcaggacagagagcgacccgtggaaggattagatagttctgtatgcaaggattatgccctggtgtggtgtatgagcactggatgtaacgaaagtacgaaccagagccaggatagaggaatgcagcgtttgataagaacactggtgttaaaagtgtagatctctggtttgggttgtgctgataaatttttgtaggctataaccatccaatgaaaaatgccctctgcgctttcgtgcattctttctaaaataattataattataattt

SEQ ID NO: 2430 - DNA, 3298 bp, Zea mays
  Clone ID: PAT_MRT4577_64728C.1
tttcctgtcctctcctctcctcaattcggcacgaggctccgaaccctcacaacagtgcatcgtctctcctgtccccgccatttggttcggaactctcgcggcctcatctcctcctcgtcatcgtaacacccacgcttagagttcgtgagggtcgcccccaggggatctcgagacgtccgtttccaagagtggaccggctcggaggcgctgctgttaccttgggtggagctcggacctgcggatcagttggattctcaagggagacggagtcgggagcaactggttttgggcgtcgcggagcacatggcttaagaataatttcttccagcccggcgacaaattcgcagttggattcagcatatgcattttttatgctgacataggatgtgctcaaccatccgtggactccctctagttgcacaaaccacctcagtgctctctctttcttcgaatcgggctaataatgggcagtgcttgccaagctggcacagacgggccttcccgcaaggatgtgttagggatagggaatgccgccttagagaatggccaccatcaggctgaagctgacgcagatgaatggagggaaaaggaagaggacttggccaacaacgggcacagtgcgccaccgccaggcatgcagcaggtggatgagcataaggaggaacaaagacaaagcattcactgggagaggttcctacctgtgaagacactgagagtcttgctggtggagaatgatgactctactcgtcaggtggtcagtgccctgctccgtaagtgctgctatgaagttattcctgctgaaaatggtttgcatgcatggcgatatcttgaagatctgcagaacaacatcgaccttgtattgactgaggttttcatgccttgtctatctggtatcggtctgcttagcaaaatcacaagtcacaaaatttgcaaagacattcctgtgattatgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagaaaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagccttcaccaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggttcgctaccaaagcaggaagaggcttgctgagcagcggccacgggtccgaggacagtttgtgcgacaatctgagcaagaagatcaaacagcgcaaggttcagaaagatgacacgtaatttctaatacaacgtatcatcttcttcggcagatctgagaattaggcggttcttcctattgcgcatcttcgtcgacagatctgagaattaagtggtccttcccattgctgatagtagcccactgattcccaacgttagagtacacaataaataagactctagttgtcaatttctgtggttgactgcagatgatcaccctagcgctatggagtcaacaatgtaatatttatatactatgttcgtgccttggcgccttggcggtttgcaatcttcagtttcctttctgagagattcttggccaagtgccttgaggaggagcaaactagcagcgtcgccattgctatattaatagctggaatcatgtagtagtagttcatccattcattcgaagatcgtgttccaaatcaacacaagtaggggtttgcttctcctctttccaagaaaagtggttgtagcgtgagatgcaaataggtctcttgtgctagatcaagctcaataaactttaggccgtgttaggcagctgatct

SEQ ID NO: 2431 - DNA, 4063 bp, Zea mays
  Clone ID: PAT_MRT4577_64730C.1
ctctcctctccccgccatttggctccgaaccctcacaacagtgcatcgtctctcctgtccccgccatttggttcggaactctcgcggcctcaactcctcctcgtcatcgtaacacccacgcttagagttcgtgagggtcgcccccaggggatctcgagacgtccgtttccaagagtggaccggctcgcaggcgctgctgttaccttgggtggagctcggacctgcggatcagttggattctcaagggagacggtggtttctgatttcctttctctaagcataccaaatcctttgtctcgagtcgggagcaactggttttgggcgtcgcggagcacatggcttaagaataatttcttccagcccggcgacaaattcgcagttggattcagcatatgcattttttatgctgacataggatgtgctcaaccatccgtggactccctctagttgcacaaaccacctcagtgctctctctttcttcgaatcgggctaataatgggcagtgcttgccaagctggcacagacgggccttcccgcaaggatgtgttagggatagggaatgccgccttagagaatggccaccatcaggctgaagctgacgcagatgaatggagggaaaaggaagaggacttggccaacaacgggcacagtgcgccaccgccaggcatgcagcaggtggatgagcataaggaggaacaaagacaaagcattcactgggagaggttcctacctgtgaagacactgagagtcttgctggtggagaatgatgactctactcgtcaggtggtcagtgccctgctccgtaagtgctgctatgaagttattcctgctgaaaatggtttgcatgcatggcgatatcttgaagatctgcagaacaacatcgaccttgtattgactgaggttttcatgccttgtctatctggtatcggtctgcttagcaaaatcacaagtcacaaaatttgcaaagacattcctgtgattatgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagaaaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagccttcaccaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggtagcctgttttcagttacatgcctgttgtagctatgacttgaaatcagtaatagttatttgagggttgaagggccttccacttaatatataaaagtaagggtagggattcaaatggtttgcacaattataatcagaaaaaagatagaagtgattattaataatctctacctttggaggatataaaaatgcttatgctacttccagctatgccttttgtctttttttagaaaaacttccagttatgacttaattgttaatattgacaataccagtgtaggaatactgaaattagtcttgaaagtaagacattagttgctgctgtttgcgtgatggcccctagcttgaggatactttgccgctactcttgcggatgctttgccgctccatgtcatctctagcggacgctctgctgtcgtgctgctggatgtttgtctcgtctcctctcaggggatgctctgccactgcagtgtcttcgtctttattggcaacctggagttgatgtgcttttccttctgcaggttcagtcggttagattttaggtggagagtccttcttactgcattttctttctctggttctttgggtcggtttaggttgctaaccacttctgtgcttttgtaatatgggcgacggggtctctcagtagctttgtcataaaacaattctacttccccttaatatagtacatgtgactctgacatgttatcgaacaaaaaaaaacattgctcgctctaaattttatgagatctggcatgatttcaaactattcttcttttcaaaatcctgttttctgactgcagtttttacaagattttatggtcttgccgcttcatttttctgactgtttgcattggaccgataccttctgatggccttgtccgcctattttcaggttcgctaccaaagcaggaagaggcttgctgagcagcggccacgggtccgaggacagtttgtgcgacaatctgagcaagaagatcaaacagcgcaaggttcagaaagatgacacgtaatttctaatacaacgtatcatcttcttcggcagatctgagaattaggcggttcttcctattgcgcatcttcgtcgacagatctgagaattaagtggtccttcccattgctgatagtagcccactgattcccaacgttagagtacacaataaataagactctagttgtcaatttctgtggttgactgcagatgatcaccctagcgctatggagtcaacaatgtaatatttatatactatgttcgtgccttggcgccttggcggtttgcaatcttcagtttcctttttgagagaaaaaaaaaaaaaaaaaaaaaaaaaaaaaaaaaaaaaaaaaaaaaaaaaaaaaactcgaggaggggcggcggtacc

SEQ ID NO: 2432 - DNA, 930 bp, Zea mays
  Clone ID: PAT_MRT4577_64777C.1
actctgcaaggcctcaatcagaatcatctaggacatcttgtgatgggagtcgcagcaacactagtcgcagaatcaatttgttgaacagaagtccttttgatcctcagatacccctgcaaagcacttttgcatccaggataacgaatttggctaccaaggtcacaaataaagttcgttctcgggtcagcacagacgattatggcatagaacgggaaggtggcagtggtgagagtcattgttcggatcgtggtgcaaaggaagaaccaacatctagcggaacaaatacacctagagggaatgcaccacatggtcccttttctacagatgagaactcccctgggaaatcaacgaacccaagcagtgatgaattagaaggaaaagtaggtctgcacaagtttttgagttcaaaggcagaggcactactgaacaagaaagggatatcatggccttggaaagtgcgcgagaatgacggacctgatgaaagaaatcatgtgatattgttgcatggagaccaagagaatgttatgaatcatcagaaggtttcagattctagcatagctccagattcccaaggcgctgaacacaacctacctagcaaaaatgaggcatcaggttcctggtcctcttacaacaataacagcacaagcagtgcaagcagcacaggaagcactaatagcagtgctctctacaaagtagatcatgaagcggattgtctggattatgagatcttatgggaagaccttgtcattggagaacaaatagggcaaggctcttgtgggacagtatatcatgctttgtggtatggttcggatgtggctgttaaagttttctccaggcaagaatattcagaagatgtgatactgtcctttcgacaagaggtgtcccttatgaaaaaactgcgccattctaacatactgcttttcatgggtg

SEQ ID NO: 2433 - DNA, 1921 bp, Zea mays
  Clone ID: PAT_MRT4577_64810C.1
ccacgcgtccggattccttttcaccccgccccgcccgcgcagtcgtcctccccaccccacccaccccaccccacccggtccccactttccactcccaaccccaccagaccttcaaccgctacatttccgtcactaccggagccgccactcccacgaacgcgggcggcggagcggaagcgaaccagttatctagtggagttgcctccttcaagctactctaatgtcctttctattcaagtctagcaatggcggcaccactgaaaaaatcccatccccagaagaacagcgagaaaaaataaatgaattacgcaaggagcttggtgaacactcatcagcagccattaaagacttcctttcagatgcctcgttagcgagatttcttcgagcaaggaactggaatgtgcagaaagctagtaaaatgatgaaagcagctgtgaagtggcggcttgcattcaaacctgaaaacatctgttgggatgatattgcagaggaagcagagactggaaagatatatagggcggattataaggacaaacatggcagaactgttcttgtattgaggcctggcttagagaacactacctcagcaataggacagatcaaatatctagtctactctctggagaaagcaattatgaacctgacggaagatcaagagaagatggtatggctgacagatttccagtgctggacattgggaagcacaccactgaaggtgacccgtgagactgtcaatgtcttgcaagactgctatcctgagaggttggggcttgcaatcctttacaaccctcctaggatatttgaatcattctggaagatagtgaagccgttcctagaccatgagacccgcaagaaggtgaagtttgtgtactccaacgacaaggagagccagaagataatggcagaagtctttgacatggaggagctcgactcggcattcgggggaaagaacccagcgacatttgagtacaacagctacgcagagcagatgcaggacgacgacaagaagatgggatcttcgcacggctcagccaatagcttgcttggatcagctgggaaggaggctaatggcgcagactcggacgcctcaagcgaggcctccttctacagtggaactgactctccgacacatgagaacggtgaacacagcatcgcgaagaagaatggttgagctgagttgaactgctttgattgctcaaactgagggagctgactaatgtagttggtcaacataacagttatatctagcttgaacgattgtcaggaccgatggcgatgacagattccaggctggttagatcaccttgtcgggtctaggcggaatgtatatttgctgctcatgatattatagtatgtaagaccataaacggtgagtttgtgatgcgctatatatcttggaataaagttcaacttcttcgttttcttaaaaaaaaaaaaaaaaaaaaaaaaaaaaaaaactcgtgccactggtgccttcccggcgtgcctgacacctggaacgagatccttgcggcccagctatagcctgtagctgaatttgaagatgccaagggttatgtcgaattgtttatgggtgaagctcgtatatacagtaactaccacggagtactacgtcgttgccggagacccaatgctgctggtagtgaaacactgagctgcagtacattctttcgggaccgtgcttaactgtagaaaatacagggccttttttttgtgtaagtacatgttgtgtttgcctactgttacctgtgtacgccagttgttaattggagaactggattgatagatagtttggaagtgttgcctgagaggtagggcaacgcatcttgcagcatccagtcctttgagaactcatctgttatgtaccaaacacgaacagagagcatcatgcattgctgatccatgtgatgtggttgttggt

SEQ ID NO: 2434 - DNA, 396 bp, Zea mays
  Clone ID: PAT_MRT4577_64914C.1
cctatagtgagtcgtattatctggacaacgggttcaagttcgacgccaccaccgcgcgggggcgtgacgtccacaggctccagggatgtctaggcgagccacgcagtcgcgacgggctccacgtgggcactgaactgcacaggtcacgtcggtatatcggtgctgctgcccgagaagccgccgcgaccgtctggagtgaaggccacgtggtgggcatggcccgtgggtgtccgcgccggtggggtgctgggaaccagcgccttgacgctctctgtaggcggcgcggtgagctggaccaggatacgggcaatggatgagatggatcagcgggccatgggcggggaggagccggggaggatgacggtgcgctggagcaggatgccatcggcgaccgtg

SEQ ID NO: 2435 - DNA, 211 bp, Zea mays
  Clone ID: PAT_MRT4577_64958C.1
gccacaccacgaagggggattttttccttaggattaacttagaacaaatcctgacaggagtaacagcatccatggatccacagtccatgctggttgatgcacgggtttgctggggccaaggatgaacacaagactaactacctgcacaaagggaccttgacactcaaaacacagatgggtgacaacaaacgtgacgtaccaagataaaccc

SEQ ID NO: 2436 - DNA, 301 bp, Zea mays
  Clone ID: PAT_MRT4577_65052C.1
ggttcgtgaggctctccgagttcggttcgtggtgacggacgagatgccgcgggggatgttgagtaccgctgcttcatcggcggactcgcctgggccacggacgaccactctctccacaacgccttcagcacctacggcgaggtcctcgagtccaagatcatcctggatcgggagacgcagatgtcccgctgcttctggttcgtcaccttctacacggaggatgctatgcggaacgccatcgagggcatgaacggcaaggagctggactgacgcatcatcaccgtcaacgaggtccagtccc

SEQ ID NO: 2437 - DNA, 315 bp, Zea mays
  Clone ID: PAT_MRT4577_65128C.1
gaactagcaacatagaaagcacacttgtgtattaacactggcagccaaaatatggcggtgccttatgctccttggtcgtgctgcaagtgttgctaccgcaaccattttcccacaatgctcacaagctcctaaagcttcccttcttcccccatacctctcaccagcggtgtcttcaatgtgtgaaaacccaattgttcaaccctacacgatccaacaggcaatcgcaacaggcatcttaccactatcacccttggtcctacaacatctcgtagccctattacagcagctaccttgggtctcatttggtggcacaaa

SEQ ID NO: 2438 - DNA, 322 bp, Zea mays
  Clone ID: PAT_MRT4577_65136C.1
ggaccttcagtaaaatattagtgttatgtgagccattaaaatatacatacatatagaccatagaagcttatcctagaccgatgaaagagaacttcttcaatgacaataaaataaactaaactcatccagactaatttttaaaaaatcaatcatcgttttttttttttttatactgacggaccgatacgactcaggaacaaactgaaagtcgatgattcacaaacatgacatagggcgcatatataggacgtaaaacagagagggacgaacgaaccatatttgtgcaagtgcaaccaaaagaagtcatcagtcgtcctttttg

SEQ ID NO: 2439 - DNA, 651 bp, Zea mays
  Clone ID: PAT_MRT4577_65217C.1
gccctctcctcgagtttttttttttttttttttttttttttttttttttttttttttttttttttttttttttttttggcagcaccaaaaaccaccattttttccttaggattaacttaaaacaaatcctgacgggggtaacagcttccatcgacccacagcccatgctggttgaggcatgggtctgctggacccgaggataaacccagcattaacaactgacacagggggaccttgcaatcaaaaacccaggggggcaacaccaaacgagacgaacgaagataacccctttggactagggaaaacatcacgggagcaaacaggataacttggccgggcgggccccaccgttaatttcctccagttcccgggggagttgccgaacccccccccacggttgccaccgccgtacccgccaccaccaccaccgtagccaccgccgccaccgtaaccgccgccgccaccgccgtaacccccgccgccatcacggggcccgccaccgccgtaaccgccgcctccacggccaccaccgtagccgccgccgccgcctccacggccgccggggaactggccctctttgacggggatgttgcggccgtccagctctttgccgttaatgccctcgagggcgttccgaatcgcctcctccgg

SEQ ID NO: 2440 - DNA, 248 bp, Zea mays
  Clone ID: PAT_MRT4577_6533C.1
gccaatgaattccctcccctatccgccgccttctccgctcgtctccctgagaggtggcgtagccgatgtactggccgagtactacgtatagaatctgtttttcttgtctcatcccggtgtctgctgcgtctggtggtggtgaaggggagaaattcttgagatctgttccggatcaggcgtgcgagctcgttaatcatgtgtttcacacatagcttcgtcgatttgaatttgatgtactaatggagtct

SEQ ID NO: 2441 - DNA, 1764 bp, Zea mays
  Clone ID: PAT_MRT4577_65496C.1
cattgggtacctcgaggccggccgggtccgctgtggtgtgactgcctgcccccttgcgcctcgcttcatcttcttgtgcaaagcccacctaccgcactcccgtcgtcctcttcttcctcctcgccctcgtcgcggagcggagtggaggcgcgcgttccgggacggcacgggacagagcagaagctcatctgggtgttggcctcatcccctgcacaagctgaggaatggggcaaaaggactccaagccttcaaatggatatggctactcttctgattacgggggtacttcatcgggatataacttgagaaatactggaagtacgtcctccagttatggcgcgaggtatgtgccttcttcagagaacaatgtacagccagaaacacatgccaggttgcagaggaagtattccaggattggtgatgactatcgttctctgagtcaggtgactgaagctttggcgcaagcaggccttgaatcttcaaatcttatcgtaggcattgattttacaaagagcaatgaatggacaggtaaaatttcatttaatcgccgctgcctacatgatattggaaacactccgaacccatatgagcaagctatatctattattggaaggacactttcagtatttgatgaagataacttgattccctgctttggatttggtgacgcatcaactcatgatcaggaggtattcagcttttacccagagaaccgcccatgcaacggatttgaagaggcactagacagatacagagaaatcgttccaactcttcgattagcaggacctacatctttcgctccgatgatcgagacagcaattggaattgttgacagcactggtggtcaatatcatgttcttctgataatcgcagatggacaggttacccgaagtgtcgatacacaatctggacaattgagtccacaggagcgggatactatagatgcaatagtaagagcaagccagttccccctgtcaattgttcttgttggggttggtgatggaccatgggacatgatgcaccagtttgatgacaatatacctgctcggtcatttgacaatttccagtttgtgaacttcacggagattatgtcaaagagcatagcagctgacagaaaggaggcagaatttgcattgtcagcgctgatggaaatccctacacaccgccgccaaagaataactccaagaattgctctgccgccaccaacaaggactgcttattcacggactactagctttagccaacagtctggtgtttattcgcgatcaagtagctttgaccaacaaacaagtgtctaccagcaacgttctgagagcttgaaacagcagcaacctgcagccccaaagggacctgacacttacgtatcagaaagtgctctggaggacagaattctgtgccccatctgcatgtataaatcgaaggaccttgcatttgggtgtggacatcagacttgctatgaatgcgggagagatttggagcgctgccctctgtgccagcaacacataaccacgaggatcaggctctactgatttgaagccaatgggattgaaaaatgttcagaaccagctttgatgctactgtgcttcatcattttgtaattctgaatgagataacactgtctcagtagtttcgctacactagttatgccaaaaggaagcgcaccagaaaataatgtacagatttttcctccttttatctcttttgttaggtaaacaagttagacagcagtaaaattctgaatgagataatggatattgtgaagca

SEQ ID NO: 2442 - DNA, 2056 bp, Zea mays
  UNSURE (1)..(2056): unsure at all n locations
  Clone ID: PAT_MRT4577_65499C.1
  unsure (1)..(2056): unsure at all n locations
ccggccggggcggcactgcctccggcgccgggagtaattgacttgacctcacttcccctgtggggaggctttaattttcttccgatcgatcatagtatccgctgcggtgtgactgcctgcccccaccccattgcgcctgcgcctgcgcctcgcttcatccggtgcgcaccccgcctcactcccgtcgtcctcttcctcgtcctcgctctcgtcgcggagcggtgtggaggcgcgcgctccttgaaggcacggggcaagagcggaggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtgtacagccggagacacatgccaggttgcagaggaagtattccaagatcggtgatgactaccgttctttgagccaggtgactgaagctttggcacaggcaggccttgaatcttcaaatcttattgtaggcattgattttacaaagagcaatgaatggacaggtaaaatttccttcaatcgccgctgcctgcatgatattggaaaacactccaaacccatatgagcaagctatatctattattggaaggacactttcagcatttgatgaagataatttgattccctgcttcggatttggtgacgcgtcaactcatgatcaggaggtattcagcttttaccctgaggcccatcaatgacacagatttgaagaggcgctagacagatacagagaaatcgttccaactcttcgattagcaggacctacatcttttgcgccgatgattgagacagcaattggaattgttgacagcactggtggtcaatatcatgttcttctgataatcgccgatggacaggttacccgaagtgtcgatacacaatctggacagttgagtccacaggagcgggatactattgatgcaatagtaagagcaagccagttccccctgtcaattgttcttgtcggggttggtgatggaccatgggacatgatgcaccagtttgatgacaatatacctgctcggtcatttgacaatttccagtttgtgaatttcacggagattatgtcgaagagcatagcagctgacagaaaggaggcagaatttgcattgtcagcgctgatggaaatccctacacagtacaaagcaacaattgatctccaactcttaggccgtcgccaaagaataaccccaagaattgctctgccaccaccaacaaggaccgcgtattcgcggtccagtagctttagccaacagtctggtgtttattcgcgatcaagtagctttgaccaacaaacaagtggcgcctctcagcaacgttctgagagcttgaaacagcagaagaaacctgcagccccgaagagacctgacacttatgcttcagaaagagctttagaggacagaattctgtgccccatctgcatgtataaatccaaggaccttgcatttggatgtggacatcagacttgctacgaatgcgggagaaatttggagcgctgccctctgtgccagcagaacataaccacgaggatcaggctctactgatttgatcaggctatgaattagaaaaatgttggaacaacagactcccgggcaagatgttcagaaccagctttgtttgtaccgtgcttcattttgtaattggtgtcacttttctctgtagttatgccaaaggaaagcgcaccagaaaaaaataatgtacatatttatcttccagtagtactgtacattgcgagctgcacataaataaaggtgtttttttttaaaatatttgtgtgcgtgtgggtgtgtctgaccccatggattaaagcttcagtaataagtaagatggtcccttctatatatattgcatatatgttccagtaaaaaataaaaaaaaaagcatttcttggtattgccanatggaccccccnatggggatttaaaaagcctttcaggttaa

SEQ ID NO: 2443 - DNA, 771 bp, Zea mays
  Clone ID: PAT_MRT4577_65500C.1
tcggccgggaaaaaaaaaaaaaaaaaaaaaaaaaaaaaaaggtgacgtgcctgccccaccccattgcgcctgcgcctcgcttcatccggtgcgctgcccacctcacctcactcccgtcgtcctcttcctgctcctcgctctcgctctcgtcgcggagcggtgtggaggcgcgcgctcctggaaggcacggggcaagagcggaggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtgtacagccggagacacatgccaggttgcagaggaagtattctaagatcggtgatgactaccgttctttgagccaggtgactgaagctttggcacaggcaggccttgaatcttcaaatcttattgtaggcattgattttacaaagagcaatgaatggacaggtaaaatttccttcaatcgccgctgcctgcatgatattggaaacactccaaacccatatgagcaagctatatctattattggaaggacactttcagcatttgatgaagataatttgattccctgcttcggatttggtgacgcatcaactcatgatcaggaggtattcagcttttacccagagaaccgcccatgcaatggatttgaagaggcgcta

SEQ ID NO: 2444 - DNA, 2180 bp, Zea mays
  Clone ID: PAT_MRT4577_65503C.1
aaattgcagcattgcctccggcttgagcaataattgacttgacctcacttcccctgtggggaggcttttcttccgatcgatcatagtatccgctgcggtgtgattgcctgccccaccccattgcgcctgcgcctgcgcctcgcttcatccggtgcgctgcccgcctcactcccgtcgtcctcttcctcgtcctcgctctcgtcgcggagcggtgtggaggcgcgcgctccttgaaggcacggggcaagagcggaggtgagtgagtccgagccccgtggattgctggttcggtggtcggaactcgtggagtagcaagagcggcggcggttacgatatctcacgccagcagtttgtcctcatctaccacccacttcccctgatcccctccccagtacccacttctctcatatcccctcccgcatcatctctctttttttcctcctcttagcgaggacgccgaattcgcgattggcttaggcggtgtgtgcggatcaaatcgagtctggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtgtacagccggagacacatgccaggttgcagaggaagtattctaagatcggtgatgactaccgttctttgagccaggtgactgaagctttggcacaggcaggccttgaatcttcaaatcttattgtaggcattgattttacaaagagcaatgaatggacaggtaaaatttccttcaatcgccgctgcctgcatgatattggaaacactccaaacccatatgagcaagctatatctattattggaaggacactttcagcatttgatgaagataatttaattccctgcttcggatttggtgacgcgtcaactcatgatcaggaggtatttagcttttacccagagaaccgcccatgcaatggatttgaagaggcgctagacagatacagagaaatcgttccaactcttcgattagcaggacctacatcttttgcgccgatgattgagacagcaattggaattgttgacagcactggtggtcaatatcatgttcttctgataatagcagatggacaggttacccgaagtgtcgatacacaatctggacagttgagtccacaggagcgggctactattgatgcaatagtaagagcaagccagttccccctgtcaattgttcttgtcggggttggtgatggaccatgggacatgatgcaccagtttgatgacaatatacctgctcggtcatttgacaatttccagtttgtgaatttcacggaaattatgtcgaagagcatagcagctgacagaaaggaggcagaatttgcattgtcagcgctgatggaaatccctacacagtacaaagcaacaattgatctccaactcttaggccgtcgccaaagaataaccccaagaattgctctgccaccaccaacaaggaccgcgtattcgcggtccagtagctttagccaacagtctggtgtttattcgcgatcaagtagctttgaccaacaaacaagtggcgcctctcagcaacgttctgagagcttgaaacagcagaagaaacctgcagccacgaagagacctgacacttatgcttcagaaagagctttagaggacagaattctgtgccccatctgcatgtataaatccaaggaccttgcatttggatgtggacatcagacttgctacgaatgcgggagaaatttggagcgctgccctctgtgccagcagaacataaccacgaggatcaggctctactgatttgatcaggctatggattagaaagtgttggaacaacagactcccgggcaagatgttcagaaccagctttgttggtaccgtgcttcattttgtaattggtgtcacttttctctgtagttatgccaaaggaaagcgcaccagaaaaataatgtacatatttatcttccagtagtactgtacattgcgagctgcacatagatcaaggtgttttttttttgtgtgtgggtgtgggggtgttcaaataggggccgggtgaagggaagaaatcaaggtgtcatatat

SEQ ID NO: 2445 - DNA, 2244 bp, Zea mays
  Clone ID: PAT_MRT4577_65505C.1
attgggacctcgagccggccgggaaaaaatgatacccacctcaccagcaaacgtcttgagctcgtgctggtgatcgtgacaagcattgtcccttttaccaaatcatcgtcttctcctctcccgcgccgaagcttcctcggacaagtgcggcgtgagtaagagacccggcggacaagaaacctctccccccaccttcgttgcggaattgcatcgccttcggcttgagccaattgacttgacctcactccctcccgaagctcatctgggtgttggcctcatcccctgcacaagctgaggaatggggcaaaaggactccaagccttcaaatggatatggctactcttctgattacgggggtacttcatcgggatataacttgagaaatactggaagtacgtcctccagttatggcgcgaggtatgtgccttcttcagagaacaatgtacagccagaaacacatgccaggttgcagaggaagtattccaggattggtgatgactatcgttctctgagtcaggtgactgaagctttggcgcaagcaggccttgaatcttcaaatcttatcgtaggcattgattttacaaagagcaatgaatggacaggtaaaatttcatttaatcgccgctgcctacatgatattggaaacactccgaacccatatgagcaagctatatctattattggaaggacactttcagtatttgatgaagataacttgattccctgctttggatttggtgacgcatcaactcatgatcaggaggtattcagcttttacccagagaaccgcccatgcaacggatttgaagaggcactagacagatacagagaaatcgttccaactcttcgattagcaggacctacatctttcgctccgatgatcgagacagcaattggaattgttgacagcactggtggtcaatatcatgttcttctgataatcgcagatggacaggttacccgaagtgtcgatacacaatctggacaattgagtccacaggagcgggatactatagatgcaatagtaagagcaagccagttccccctgtcaattgttcttgttggggttggtgatggaccatgggacatgatgcaccagtttgatgacaatatacctgctcggtcatttgacaatttccagtttgtgaacttcacggagattatgtcaaagagcatagcagctgacagaaaggaggcagaatttgcattgtcagcgctgatggaaatccctacacagtacaaagcaacacttgatctccaactcttaggccgccgccaaagaataactccaagaattgctctgccgccaccaacaaggactgcttattcacggactactagctttagccaacagtctggtgtttattcgcgatcaagtagctttgaccaacaaacaagtgtctaccagcaacgttctgagagcttgaaacagcagcaacctgcagccccaaagggacctgacacttgcgcatcagaaagtgctttggaggacagaattctgtgccccatctgcatgtataaatcgaaggaccttgcatttgggtgtggacatcagacttgctatgaatgcgggagagatttggagcgctgccctctgtgccagcaacacataaccacgaggatcaggctctactgatttgaagccaatgggattgaaaaatgttcagaaccagctttgatgctactgtgcttcatcattttgtaattctgaatgagataacactgtctcagtagtttcgctacactagttatgccaaaaggaagcgcaccagaaaataatgtacagatttttcctccttttatctcttttgttaggtaaacaagttagacagcagtaaaattctgaatgagataatggatattgtgaagcaaaactatcgccatggaaaatatgcattctgtatgcaatgaccccatggattaaagcttcagtaataagtaagatggtcacatctatatcttgctgcataggcatatactaagaactagtaccagttttagtgtttggtaacattgtctcagtagtttcgctacactagttatgccaaaaggaaacgccccagataataatgtacataattttcccccctttatctcttttgttaggtaaataagttagacagcagtaaaattctgaatgagatgagataatggatattgtgaagcaaaactatggccatttttgagccatggaaaaaaaaaaaaaaaaaaaaaaatatgaaatttgaatgccatttttatcta

SEQ ID NO: 2446 - DNA, 123 bp, Zea mays
  Clone ID: PAT_MRT4577_65624C.1
aagagactgggacatcaagtgactcttatccgccgagttgcggataaagtgttgcgccaaggtgtgcaatactatcgggtacaaagtttggtctatgattgagctccccagggcaactctggt

SEQ ID NO: 2447 - DNA, 2361 bp, Zea mays
  Clone ID: PAT_MRT4577_65639C.1
ccggccgggcttgccacccttacttggcatcacttcatgacataagtgatgagccagtctgctcaatgcccttcagcttcgacttcgagcagcatgcattatctgaagaacagatgaaggatctgatctaccaagaggctcttgcattcaacccagattaccagtagccaaagttcggttccagccggtgattgcgttcattgacatggagatttttatcccacctgatgtcactgcaaaaagtcgccaactccgattgctagctgtaaataattgccttccccgaagacccccccattccttccttgattaaaaaaagcaggagacggtggccattcaagggtagaaaagagcgagcttgtgaaggtcaaatttctgcgcagctatggattcttgtgcttacaatatgttgtttttaatcaggttttcctttctttttcttcttaagtacttctcggtgttgtctgtaagagaggtagctcatgaacgatggctgcctgaattcagtggctgtcgtcaaagtgaacagttctagtcgacttaagaattcttgttttaaaaacggtgcgccccgcaacggattgggctgatgccccccaccggcaccccccacttttggctctcgcagcaacgaattgggcatattccccgcgcctgcacccccacttttggcactttcccttccggccccctctcctcggcgcgatctaaatccggtccggcgatggacggcggggggcagcccccggacacggagatgacagacgccggcgcgggcggcggggggcagccgccgcagcagccactgccgccggtgggcgggggcgtgatgttggacaacatccaggcgacgctcagccacggcggccgcttcatccagtacaacatcttcggcaacgtgttcgaggtcaccgccaagtacaagccccccgtcctccccatcggcaagggcgcctacggcatcgtctgctcggcgctcaactccgagacggcggagcaggtggccatcaagaagatcgccaacgccttcgacaacaagatcgatgccaagcgcacgctccgcgagatcaagctgctccgccacatggaccacgagaatattgttgcaataagggatatcatacctcctgcgcagagggctgcattcaatgatgtgtatattgcatatgaattgatggatactgatctgcatcaaattattcgttcaaatcaagctttgtcagaggagcactgtcagtattttctttatcaaattcttcgtggcttgaagtatatacattcagcaaatgttcttcaccgtgacttgaagcctagcaatcttcttttgaatgcaaactgtgacctcaagatatgtgattttgggcttgctcgcaccacctcagaaactgattttatgactgaatatgttgtcacaagatggtatagagcaccagagcttttgttgaactcctcagaatatactgctgccatcgatgtgtggtctgtgggctgtatatttatggaactgatggaccgcaaacccttgtttcctggaagagaccatgtccatcagctacgtcttctaatggagctcattggcacgccaaatgagggtgatcttgattttgtaaatgaaaatgcaagaagatatatccgccaacttcctcgtcaccctagacagtccttacctgaaaaatttccacatgtacaacccttagcaattgacctggtggaaaagatgctgacttttgatcctagacagagaataactgttgaaggcgcacttgcacacccttacttggcatcacttcatgacataagtgatgagccaggctgctcaatgcccttcagctttgacttcgagcagcatgcattgtctgaagaacaaatgaaggatcttatctaccaagaggctcttgcattcaaccctgattatcagtagccaaagttcaatttcagccggtgattggcttcattgacatggagattttttccccacctgatgtcagtgcaaaaagtcaccaactccgattgctagctgtaaataactgccttacctgaagatactccattcctctgattaaaagctggtgacggtgtcattaagggtagaaaagaacgagcttgtgaaggtcaaatttctgcgaagccatggatttctgtgcttacaatatgttgttttcaatcggactttccttcctttttcttgtcaaaaacgtctcgatgttgtctgtgagaggtagttcatgaacgatggctgcctgaattcagtggctgtcgtcaaagttaacagttctggtcgacttaagaattcttgttttatctacttcattgtttatataaatggacctgtatctcaaaaaaaaaaaaaaaaaatcccgg

SEQ ID NO: 2448 - DNA, 330 bp, Zea mays
  UNSURE (1)..(330): unsure at all n locations
  Clone ID: PAT_MRT4577_65653C.1
  unsure (1)..(330): unsure at all n locations
agcaactagcggcatcgatactgaagaagggggagctaattttgcaccacaaggctcaaggatgtcttacaactgccaatcaagctgctgctgcggctcaagctgcaagtgcggcaagaactaccctaacctgaaggagacgagcaccgccgcgcaagccaccaccatcctcagggggggcccgcaaaaaaaagcctcccccgacttattcnaggccgcagaggactccagcgaggccgcccacggctgcagctgcggaggcaactgcaagtgcgacccctgcacctgctgaacacatcgatccacaaccatggatatgacgattatcta

SEQ ID NO: 2449 - DNA, 378 bp, Zea mays
  Clone ID: PAT_MRT4577_6566C.1
acgctttcgtataactttgaacctttttcttgtgctctgtctgtgtgttttcaaagcatattaatgatgttttggttgtcgagcaacagcgtgtcatgttttttctgcggctcaagctgcaactgcggggagatgtaccctcacctgggggcgaagagcggcgggggccctcaggccagcaccgcccccatcgttctcggccgctgcccctgagacgaagaacgcgccccaattctaggcggggggcgagtctggcgaggccccccacgggtgcagctgctgtgacagctgcaagcgcagcccctgcaactgctgatcctgatgcggtgcttcgtttgcggcctgcatggatgacaccttttttgtactgcctgcttt

SEQ ID NO: 2450 - DNA, 310 bp, Zea mays
  Clone ID: PAT_MRT4577_65816C.1
ccccccttaaaaaatccccttgaggaaagcaattttttcataaaccacaaataacttgaccaaatcctttacaaatgataatcaaataagtggagtcaacaaaacaaaactttttttggaaacccaaattgccttaccccagccgattacaccattttttttaaaaaaaagaaaacaattccttccctcccccttagttaaagcgataaccataaggaaaccttctcccccactgcgtatataaaaatgcatatgcctccaaaaaaaaactgacaggccagtgtagcaaacttcatatcccacaaccccc

SEQ ID NO: 2451 - DNA, 1661 bp, Zea mays
  Clone ID: PAT_MRT4577_6582C.1
ggatcccaacacattcctccctcagtccctcttcccccccggttgcatcccttcacacccacagcccacctggtctgtcatcccctttgctacgctccccttgccctgtcccctcgccgcccgcgcccgtggagttcttcgatcgagtcctcggagcccggagcacctggtgcaacaatccggacccgcgcgaggaagggcggagagagagccgaatctgagcctcggcacaagttgggcacccgtcaagattctcggcccgatctgctgcggaacatggagctggacagcatcgagtgcatgtcctactccgacagcatgggggacgacgacaccgacgccgtcacctcgtcccagctccctcgccccttcctcaaatcctcctccaccgccggtactgccgccgtcaacgtggtcgtcgtctccgaccgcgtcggtgccgccgggccggtagcgggagcgggttcgctggtgatttcgccagccacgggcgtgcacgagctgctcgagtgccccgtctgcaccaattccatgtacccgcctatccaccagtgccaaaatggtcatactctatgttccacctgcaaaactcgggtgcacaaccgctgcccaacttgtcgacaagagctaggtgacatcaggtgtctggcattagagaaggtggctgaatcacttgagctcccctgcaaatactactctcttggatgttcagaagtcttcccatactacagcaaactcaagcatgaatcacagtgtaattttaggccatacaactgcccttatgctggttctgaatgctcagttgttggggatatttcttttcttgtggcacatctgcgagatgatcataaagtggacatgcactctggatgtacatttaatcaccgctatgtcaagtccaatccaagagaggttgaaaatgcaacttggatgctaactgtttttcattgttttgggcagtacttttgcttgcactttgaggcatttcagcttggaatggcaccagtatacatggctttcctccggtttatgggcgatgaaaatgatgctaggaactacagctatagccttgaggttggtgcaaatggcaggaagatgatatgggagggaactccccgcagcatccgggacagccaccggaaggttagggacagccatgatggtctaataattcagcgcaacatggctctcttcttctcaggtggagaaaggaaagagctgaaactgcgagtcacaggccgtatctggaaggagcagcagaatcctgactcaggagcctgcattcccaatttgttcagctgagctcagtaacaagaggatggatccaggtgtatattgatacggccgatgtgtttgtgtgagcgtgtgcctgtgctttgcgttttgtcctgccaagctgccattgcagcccgccctaaattagtcagggcgtatttactgttggcaggataatgaaaatactggcttactccttttgtgggctgtgactaagctcccatgaatctcacgataagcatttttctcgatccaatggtgtatactgtatcgttttgggctgaaggctgcagcttttttgctgttatgtttgtctcggtgtatttgtgtgtctgcaaataaagtattgaacagtaactgggtaccttgcataaggtttggttggc

SEQ ID NO: 2452 - DNA, 352 bp, Zea mays
  Clone ID: PAT_MRT4577_65893C.1
gcttcgaggaaggaaaaccctaccgctgtgggagtagcctgcagcgatggttgcggcgcgatcctgcctgatctggcgactcaggtgctcatcccggtcgcggcggccgtgggcatcgcgttcgcaggggggcattgggtgctgggctccaaggtgcggggtacccccgagcgccgatcggaccgagggcccgtgaacagcgcgcccacgcactacctcatggcggaggaggagggactcaacgaccacatcgtggccggccagtgcccccagatccagaccgccctgtctgaaggagctacactctttccttttcactgatcacaagtatgctggattattcatgggcatc

SEQ ID NO: 2453 - DNA, 362 bp, Zea mays
  Clone ID: PAT_MRT4577_65914C.1
acaattcttaaaccctacaggttccaacatgcaatcgcagcaggcatcttacctttatgacccttgttccttcaacaaccgtcaggcgtattacagaagttacctttggtgcatacgatggtacatagcatcaagggacaacatctacaacaacttgtgctaggaaaccttgctggctactgtaagcaacagtagtttattccattcaaccaactgggtgcattgaactctggtgcttatttgcaacaacaactaccatgtaagtagatagctgctgcctaccaccagccatttcttccattcaacccactggcagcattgcactctgctgcttatttacaacagcatcagctaccaccatt

SEQ ID NO: 2454 - DNA, 394 bp, Zea mays
  Clone ID: PAT_MRT4577_65929C.1
ggtgggttggcttcttctccccctccggttcgggttcgggtacgtgaggggctccggggttcggtttcatggatgagcggatcgaaatggctgcgtcagatgttgagtaccgatgcttcgccggcggcctcgcctgggccacggacgaccactcattccacaacgccttcagcacctacggcgaggtcctcgagtacaagattatcctcgatcgggagacgcagaggacccgcagcttcggcttcatcaccttcttcacggaggaagcgatgcggaacgccatcgacgacatgaacggcaaggagctggactgccgcaacatcaccgacaacgaggcccagtcccgcagcaaccgcagaggcggcggccgccgctactaccaaggccgatgagg

SEQ ID NO: 2455 - DNA, 379 bp, Zea mays
  UNSURE (1)..(379): unsure at all n locations
  Clone ID: PAT_MRT4577_65932C.1
  unsure (1)..(379): unsure at all n locations
gttgctccaagaagcacctttttttccttaagattaacttaaaataaagcccgacgggggtaacagcttccatcgatccgcaanccatgctgtttgatagcatgggtctgcgtgaaaccgaggatgaacacagccctttcaactgacacagagcgaccttgccatcaaaaacacagatgggcaacaacaaacaccacccgaacgaagataaaccctctggacttggggaaacatcacgggagcgaacaggataacttggccgggcgggccccaccggtcaggtcctccagttcccgccggagttgccgtatccgccgccacggttgccaccgccatagccggcggcacctccaccgtagccggcgccggctccgtagcc

SEQ ID NO: 2456 - DNA, 464 bp, Zea mays
  Clone ID: PAT_MRT4577_65936C.1
gcagcaccaagaagcaccattttttccttaagattaacttagaataaagcctgacgggggtaacagcatccatcgatccgcagtccatgctggttgatgcatgggtctgctggagccgaggatgaacacagctctatcaactgacccagagcgaccttgcaatcaaaaacacagatgggcaacaacaaacacgacaagaacgaagataaaccgtgtggactagggtaaacaacacggcagcaaacaggataacttggccgtgcgtgccccaccggtcagctcctccagttaccatcggagttgccgtagccgccggcacggttgccaccgccgtagccggcgtcgccaccaccgtagccgtcgtcccaccgtagccgtcgtcccgacgtagccgtcgtcggcatacggaggccggcaccgccgtagccgtcggcttcacgggcaccaccgtacccaccggcggc

SEQ ID NO: 2457 - DNA, 383 bp, Zea mays
  Clone ID: PAT_MRT4577_65937C.1
taactcacaataaagggtgaggggggtaacagcatccatcgatccgcagaccatgctgtttgatgcatgggtctggtgaagccgcggatgaacacagcagtaacaactgacacagagcgaccttgcgatgaaaaacacagatggggaacaacaaacacgacacgaacgaagataaaccctgtggactagggcaaacaacacggcagcgaacaggattacttggccgggcgggccccaccgctcagttcctccagttcccatcggagttgctcgagcctccgccacggttgccatccgtcgtgtcgtcgccaccaccaccggatgctgctccggcacctgaggctgacgcgccagcgtcgttgccgccggcggcatcacgggga

SEQ ID NO: 2458 - DNA, 427 bp, Zea mays
  Clone ID: PAT_MRT4577_65975C.1
agagcaactatcatcatagaaagcacattattgtaccaacactggcacccaaaatatttggcctccttatgcttcttggtctttatgcaagtcctgataccgcgaccattttcccacaatgctcacatgctcctataactacccttactaccccgtacctctcaccaacattgtattcggtatgtgaaaacccacttcttcaacactatacgatccaacaggcaatatgcactggcatcatacctttatcacccttactacttcaacactcatcacacctattacagcagttacctttgctgcatacatttgcacaaaacatcactgcacaacatctacaacaactcgtgctagcaaaccttgctgtctactctcagcaacagcaagttcttccattcaaccaactacctgcatagaactatgctgc

SEQ ID NO: 2459 - DNA, 542 bp, Zea mays
  Clone ID: PAT_MRT4577_659C.1
gacgacttgctatattgttctcgaagagatcgacttcttttgcaccacatggtccaggatgtcttgcaactgcggatcaagctgcggctgcggctcaagctgcaagtgcggcaagaagtaccctgacctgcaggagacgagcaccgccgcacaggccaccgtagttctcggcgtggccccggcgaagaaggccgcgcccgagttcgtcgaggcctgcgtcggagtccggcgaggcgcgaccacgcctgcggctgccgtagcaggtgctagtgcgacccctgcaactgctgatcacatccatcgacaaccatggatatgattattatctatctagctggaggcggcggttgaacaataataagcgatgccgagctatgctgccatacatacgtatagcttggcgtgtacagagagagagagaaacatatttctttagatcgatatctttttctctgcatgatcggagtgagaccatgggctcatgtacgtgtgtctacatacatgttggttgatccaattgcgtatcgggtaaccatatatta

SEQ ID NO: 2460 - DNA, 1945 bp, Zea mays
  Clone ID: PAT_MRT4577_66050C.1
ttgggaccctcgaggccggccctatagaatcctgctcctgctcctgcctgcgcccgtccccttttcatgttgctttccctttcctcctcctcctcttcttcctcctcacctcacctcctatttagccgtccgaattgcttgtcagcatcttcccagcttcttcttcttcttccaaccgcgctacgctctcttgtccccggtgctcgcttggattcttctctcttcataggaaggaaggattggctaccgagatattcctactagtccagggctgtagtgcatcctgcgcgcttggtttattctgcagccagtaccagtaccagtaccccagctgagccggtgaggagaggagatagagagagcgagcgggagcgggagcgggagcgggagcagaggaggagggccatggaaggcgacagcttctccggcggcgccatggccaacggcggcggcggcggcggcggcggcagcgggcaggtggtggacgggaagctgatccacacgttccacaggagcttcgtgcaggtgcagagcctgctggaccagaaccggatgctcatcagcgagatcaaccagaaccacgagtcccgcgcgcccgacaacctcacccgcaacgtcggcctcatccgcgagctcaacaacaacatccgccgcgtcgtcggcctctacgccgacctctccgcctccttcgcgcgcaccatggaccacgcgtcctccgagggcgactcctccggcaccggcaataacggccgcgccggcgccggcgccggccacaagcgcgtccgccccgcctagagctagcttttagtttttttcttcttcttcttctgctgggtctagcttggcgtggcaatcctaggtgttgccattgccactaggaggcgtatttagtcttttctcttgcggttcttcttgttcgccttcttcctttgtgctcgctagctgcgacgaacgccggtgattagtgtatggtaatttagtgtcaaacagagagctgccatgtggatgttgctcctataacaacaataaaaacgatgaagaaacaccagagaagcggcacacggtaggcagccttgctgctgcgcttagctagcaagcatcttgaatggaaactattttgcagcgtactaggacacactcatgtcatggtggagcgaatgcgttggaggcgaggctggctgctcactctattatgtcactgcagatgggtcaggtcaggtagtaggcagttcatgttcatgttcagttcggcagggcaggacagatcttgagagggcaatgtttaccatctgacactacccctcgccctttccatccacctgcctacctacctgagctccgaatcgaatctggtgaagtgcatggccactttggagacgcgcatgggtcggtcggtcgatcgatcgatcgatctccccaactctgaatctgatgattgagttgcaaaatggtgtctagtactggcagtgcaaagtgcaatgctttacagctttacaaaacctgctcctcgctcgctcgctggctcgactcctgccgtgtctttccttcctgtcctgatgagttatcatgaaaaaaagctcagcaacatggccaagctagctagtacgttgttgtaccctgaaaattttctagtagctttttttctcccctctttctgttcctgctactaaactgaacagtatggtttggatgagggcaggctctccttttctttctgaatgccaaaacggtgaaagaaagaaagaaagaaaagcagggtctgtctgtctagtggccgtctatctgcgagatgcatgctgctgggcagcatcagcattcagcaggagcaggacgggagaaagcttcgatgattttttttttctggttggttggttgccaatcatggcgtgccacaccatggcatggccagaatcttactcctagaaaaaaaaaaaaaaaagcggcc

SEQ ID NO: 2461 - DNA, 726 bp, Zea mays
  Clone ID: PAT_MRT4577_66051C.1
ctctcgtccccgttgctcggttggattcttcttctctcttcataggaaggaaggattggctaccgagatattcctactagggctgtagtgcagccagtaccagtaccagtaccagtaccccagcagccggtgaggagaggagacagagagagcgagcggaggagagccatggaaggcgacagcttctccggcggcgccatggcgaacggcggcggcggcgggcaggtggtggacgggaagctgatccacacgttccacaggagcttcgtgcaggtgcagagcctgctggaccagaaccggatgctcatcagcgagatcaaccagaaccacgagtcccgcgcgcccgacaacctcacccgcaacgtcggcctcatccgcgagctcaacaacaacatccgccgcgtcgtcggcctctacgccgacctctccgcctccttcgcgcgcaccatggaccacgcgtcctccgagggcgactcctccggcaccggcaccggccgcgccggcgccggcgccggccacaagcgcgtccgccccgcctagctagcttttagtttttttttgtcttcttctgctgggtctagcttggtgtggcaatcctaggtgttgccattgccactaggaggcgtatttagtctttttctcttgcggttcttcttgttcgccttcttcctttgtgctcgctagctgcgacgaacgccggtgattagtgtatggtaatttagtgac

SEQ ID NO: 2462 - DNA, 322 bp, Zea mays
  Clone ID: PAT_MRT4577_66070C.1
cggacgcatgggcggacgcgtgggcggacgcgtgggtgagaccaactagcaacatagaaggcacagtactgtacgaacaatgggagacaaaatattatgcctccttatgctcccagggctttctggatgcgctggtacggcgaccatattccctaaatgctcgcaagctcctatagcttccattcttacctcgtacactctcaccagcagcgtcttccgcatgcgaaaacccaatttttcaaccctacaggatccaacaggcaatcacagctggcatattacctttatcacgcttgttcctcccacaatcatcagccctatt

SEQ ID NO: 2463 - DNA, 981 bp, Zea mays
  Clone ID: PAT_MRT4577_66146C.1
ttgggaccctcgaggccgggcccgggaccaaggaaattcacaaagagatactagtccctaccaaagcatacttcctgaaacactcttgcaatccactgagtcctgtttgttgagacttgagacgcatagagctagcgtcgacaatgtcgctcgtgaggcgcagcaacgtgttcgaccccttctccatggacctctgggaccccttcgacaccatgttccgctccatcgtcccgtcggcggtctccaccaactccgagaccgccgccttcgccagcgcccgcatcgactggaaggagacgcccgaggcgcacgtgttcaaggccgacctccccggcgtcaagaaggaggaggtcaaggtcgaggtcgaggacggcaacgtgctggtcatcagcggccagcgcagcagggagaaggaggacaaggacgacaagtggcaccgcgtcgagcgcagcagcggccagttcgtcaggcgcttccgtctgccggagaacgccaaggtggaccaggtcaaggctggcctcgagaatggcgtgctcacggtcaccgtgcccaaggcggaggagaagaagcctgaggtgaaggctattgagatctctggttgagcatccaatccaatatggacgtggacggaaggtgtactgctgctggtctgtggctgtcgttgtcctgtgtggatgtttcctgtgtcttctactatatatataatgtacttctgtctgtttcgtttcgtatgtacaatcttccgggtatcgttcatgtatccctttgaataataacaaataaaatcgggtttgtcacggtaatctgaataaaaaaaaaaaaaaaaaaaaaaaaaaaaaaaagaaagttggtcatataatacatacataattgtatgtataactataagaaaaaggaagtgaaattggataagataagaaagattttgggttatacatatagaaaagcaaaagtagaaaaaaaaaaaaaaaaaggccccta

SEQ ID NO: 2464 - DNA, 821 bp, Zea mays
  Clone ID: PAT_MRT4577_66149C.1
ctgtgcggcgctcgaggcggccgtttcgggacaaggaattcacaagcgcctagcaaaagcatacttcccgaagcactcttgcaatccactgagttctgtttgttgagacgcatagagctagctgctagcgtcgacaatgtcgctcgtgaggcgcagcaacgtgttcgaccccttctcgatggacctctgggatcccttcgacaccatgttccgctccatcgtcccgtcggcgacctccaccaactccgagactgccgccttcgccagcgcccgcatcgactggaaggagacgcccgaggcgcacgtcttcaaggccgacctccccggcgtcaagaaggaggaggtcaaggttgaggtcgaagacggcaacgtgctggtcatcagcggccagcgcagcagggagaaggaggacaaggacgacaagtggcaccgcgtcgagcgcagcagtggccagttcatcaggcgcttccgcctgccggagaacgccaaggtggatcaggtcaaggctggcctcgagaacggcgtgctcacggtcaccgtgcctaaggcggaagagaagaagcctgaggtgaaggctattgagatctctggttgagcatccaatccaatatggacgtggatggaaggtgtactgctgctggtccgtggctgtcgctgtcctgtgtggatgtttcctgtatcttctacagtatataatgtacttccgtctgtttcgttttgtatgtacaatctcaatcttgcgggtatcgttcatgtatccctttgaataataacaaataaaatcgggtttgtcacggtaaaaaaaaaaaaaaaggccccta

SEQ ID NO: 2465 - DNA, 841 bp, Zea mays
  Clone ID: PAT_MRT4577_66150C.1
gccggccgggtgcacataaggtgacctatagaaggccgtccggtccgggaccaaggaaattcacaaagcgcctagcaaaagcatacttcccgaagcactcttgcaatccactgagttctgtttgttgagacgcatagagctagctgctagcgtcgacaatgtcgctcgtgaggcgcagcaacgtgttcgaccccttctcgatggacctctgggaccccttcgacaccatgttccgctccatcgtcccgtcggcgacctccaccaactctgagactgccgccttcgccagcgcccgcatcgactggaaggagacgcccgaggcgcatgtgttcaaggccgacctccccggcgtcaagaaggaggaggtcaaggtcgaggtcgaagacggcaacgtgctggtcatcagcggccagcgcagcagggagaaggaggacaaggacgacaagtggcaccgcgtcgagcgcagcagtggccagttcgtcaggcgcttccgcctgccggagaacgccaaggtggatcaggtgaaggctggccttgagaatggcgtgctcacggtcaccgtgcccaaggcggaggagaagaagcctgaggtgaaggctattgagatatctggttgagcatccaatccaatatggacgtggaaggaaggtgtactgctgctgctggtccgtggctgtcgctgtcttgtgggatgtttcctgtgtcttctacgatatataacgtacttctgtttgtttcgtttcgtatgtacaatcttccgggtattgttcatgtatccctttgaataataacaaataaaatcgagttttcacggtaaaaaaaaaaaaaaaaaaggccccta

SEQ ID NO: 2466 - DNA, 480 bp, Zea mays
  Clone ID: PAT_MRT4577_66168C.1
gggggtatagggccatacatttataaaaaaggcacccaagcccaaaggacgggggaggtttttcgagggctttagttttgacaaccttgggggagctatatttccctggattagattacatgcatacatacatatatacccccacgacagaaaaaccaaccaggggaattcctccctgatttctggggcattggggcataaacataaacaggtgggggcgaaaaactatgcaatgggtcccagcaggggaacgagcaaattttttgactggtttccgaattttgaccagtatacacattcagatgcgaagcctaacaaaaatgggcgggtaaagacctgggctggcaaaaaagctaggcttttattttgactggggaccattcgggggactggggacaaagatcctccgaagcaaatatccatagcaaaggggaggtgggggctttaacttggagggggatttaaggggggcattcccct

SEQ ID NO: 2467 - DNA, 407 bp, Zea mays
  Clone ID: PAT_MRT4577_66422C.1
tggtggaggacggtaacgagaccaccaatacaacacgccgggtggcacacaggttcgcatgtgacgccctcaccgtggaattcttccgctcacgagcatctctgcgcaggagcgccctgcccataggcatgcccccaagagggtcaaatccacattgaggcttgacaggacaggataatcccagacggaaatggctgaattcacgacgtactgattttgaacactgggcattggcggacacccaccaaatcgtttgatacgggtcgctattttcaggctgcacgtcatcttaaattaggtacatgcatagatgctggtttcagaatggcactggagacctgggcctcaagggtacaaaaaaaggtggatttaaaccgcacacatgtattgtttcacacatatgagcc

SEQ ID NO: 2468 - DNA, 226 bp, Zea mays
  Clone ID: PAT_MRT4577_66479C.1
cagagcacattaatttctttatttggtttttattttggcaaaaaattttagatgcattatttcttcaccccgcttcccgcgaggtcaccggctttttagagaaaaaccctggtaaaaacaattacaacacgcgcccactccacttttgaaaaacataacaatatgaaaaaagggagagagaaaagaaactccctaaaaagacggtgtcccaaccataccattaaat

SEQ ID NO: 2469 - DNA, 4078 bp, Zea mays
  Clone ID: PAT_MRT4577_66490C.1
cgtagcactgccctcttcctctctgtcctctcccctgctgccgccccctttcccaaatctggccgcacgacgcaccagccaccaaccgcacacaccccaaacttgaaggcacaacccgagcgctcgcccgcctcgcctctgcgccgcgtccggccgccggtagcgggccggtcacttaccgggagggagaggtgctttggttcctggatgagctgtgaaggaactgggagcaagaagaattgatgtttactccgcagggcaaaggatggaccggctggtcgacgccaactccggccaaccagcggagcggtggtggggctcctgctgcgtcggcgccccttggaaagggcaaaggaagggtcgccgagctcgagcaggagttgcatgaatatcagtacaatatggggcttcttttgattgaaaagaaagaatgggcagcaaaatttgaagaaatcagtgaagtgctgacacagaaagaggagatactgaagagggagcaggcggcacatctgaatgctatatcagagtatgaaaggcgggaggagaacatgcggaaagcactaggtgttgagaagcaatgtgtcgctgatcttgaaaaagccttgcgtgatatacgagcagagatagctgaggttaaatttacatctgagaaaaagataacagatgctcagtctcttgaggctagtttggaggaaaaatccttggagatcgagggaaaacttcatgctgcagatgccaaacttgcagaggcaaaccgcaagaagtctcaagctgaccgtgatttagaagaggcggaagctcgtcaacgtagactggagaaggagaaactgtattttgagacagagcggaaggcccgagaaaagcaacttaaggagcaggaggaatcactgcaggaatgggagaaaaagctgaaggaaagtcagaatagacttaatgagttgcagagatctataaatgagcgagaggagagagcaaataagaatgatcaacttttcaagataaaacaggacgaactggaggaggcacgaaggacagtggaggccgctaaagttactctgaaagtcaaagaggatgatattaacaaaagactaaatgaattacatttacaggaaaaggatgctgactcaaagcgcagtgcattggaagagcaggggaaaaaattggatgagagagaggcaaaggtcactaatagagaaaaggaggggctccagaagcttcttgaggatcatcaggtggagcttgaatccaaaagacgggattttgaattagaattagagagggaaaggaaatcttttgatcaaaatatgacacagaagcaagcggatttattgaaaagggagaaagatgttaaatctttggaggctaaactttctaaaagtgagcaggcattgaatgataagaagaaatcaatggaaaacttgcagaatgatcttgatgccaaatctaaggctctgaagagttgggatgaatcattgaaaaatgacgagaaaaggttactgaaagaaaagcagcaaatggatcatgaaagagaacaattggagacatacaaattggagcttgaaaagatcaaatcagcattagaagctgagaaggaaaaaatatcagaagagcagaataatctgaaactcacagcgcaagagaggcaggagcatagcttgttgatagcaaaacttaagaaggagattgaggaatacagaatgcgaagcaactccctatctgaggaaatggaggatttaaggaagcaacggcagaaatttgaagaagagtgggaacaactagacgaaaagagagccctccttgtagaggaggacaaaaggttgaacattgagaggatgaatttagaacggtggcgtgacaacgaagaaaaaaggttaaatgatatgaaactcaaaatggatgaagaatacaagcagcagctggagagtcttgagcgcaaggaaaaggctttgagtgatgatatgaagcacaagcaaatggaaaatgatgaatttctgaagggagaacgtgctgatgttcaacgtaaattgcaactcaaacggcatgaattggagatggagatggagcaaaaacaagccacgaaggagaaggaactggaagaaaaggaaaatgagttaaataagaaaatagattttgtggaaaataaactccgacatgcaattgagttgaatgagtccaagattgagaagttattattggagaaaagggaggtgcagatggaaagagaattactgctggaggaaagaaagaaaacggagactgacaaggcagatattagaagggatattgagagtctgcactcattgagcaagagtttgaaggaacgtcgagaggcatataacagggacaggagcagactcatcgaactatttgaaaagtacaaggcgtgcaaaaactgtgggatttctatttttgagggattggattctctgctgcttaaagacagtgctgaaattgagcatccaagtttggctgttgagggagatgatcatgccttgaccaccgatacatcaggtccagatacaggaacccttgttaattcaggtggtcgtttttctttgttacagaagtgttcaaggcttttcaagttctcccctagaaaaaagggtgagcagtcatcagaacaaccatcagagaggaatatatcttttggtgcaagactcgaggaagcaacacagagcgatggagattatgtgccaactcctgtctatgagatagcccacgattctttcaatgcagaggatgagctcccttctgacggtgaaaccagggagaatgaagagtctgaaaggcatgacatagctgataatgcccagatggagtcttctgttggtgtagcagataacagtatagatattctcggtactaagtcatttgatggtgctaacgacatggcagttgaagcaactattgtctctgttgatcaaaatggcgaggactctgtagttcctgctgaagcaggtgtagagccctgaaacatcagagcaaggtcggcgccagcaaaaccagagaggggggaagaaaaggtggtatgaaaaagaacacggtctgttaatgctgtagttgaagatgctaagatgatacttggcgaggtttttgaggagaagactgatgatcagggagatacagtcaaggtgggtgctacacgaaagcggcggtttgctggagctacaataagtgaacaagatgaagaagggagcgaagcacattcagaaagtgtttcacttggagggcagcgccgtaagaggcggcaaactgctggggcagtgacagatgccccaggagaaagacgttacaatttgagacacagtagagctgcaaatgctggcgctgcaacagcccaagcagacaaaaaaaaatcttcaaaagcaagaaataaacatacagtagaagcttctgctgatgacaccgaaggaacatcaaaggttgttgaggaacctgcccctgagagcaagagggtatctgaatctgcagactacgatgcatcccagttgcatgagttttcccaggttgaagttggtgatgcccatgctgtagacggtgagggtgctggtgaggaagatggtgatattttggatggccaagatgcactgcctgatgtgccaatgacaccttctggaagcgagtttggagcggaacaggaagatgaggacgatgatgattcagagaggcgaaaccaatcaatcagcaagaagctatggtcattcttcactacatgacttgctgaagaggtcgtcatgtaggttatttctagcttttgtggtttcgattcatgataccccattcttggaactgtaggtcgtgtgcttttggtgattatgtactagatctcccacttgattgtgcttctctcccgtgtaattgaaatatatttgtagtggacatagtttgatggcactcacagaagtagctgatgagatgtacaatggcgatgatggtatgccctgtaaggctgtaacaccagtagcttggtttgtaattgttcttttcccccggttcgtgttacttcgttgaccttattccggggaaatattttagtgctgtgatgatggtctaaaaaaaaaaaaaaaaaaggccccta

SEQ ID NO: 2470 - DNA, 1809 bp, Zea mays
  Clone ID: PAT_MRT4577_66518C.1
ctcgcgtccgggccgggggacctgccaaacctccctcacactttgtcagtttgccgtcgctgtcggcgccgccgcctgtcctaatctcctctgagtccagcggccacctcctccaccgggagctccccgtaccataaccgcagtccgcagccattggaatttccgcttcatgcgtggatcctcgtagaccccgacccgcgtgcactcaatccctaggcggcggcctccggcgcgaggctagcgggcggcacccatggcgtccgtggcggagctcaaggagaagcacgccgcagctacggcgtcggtgaactccctgcgcgagcgcctccgccagcgccgggagacgctcctcgacaccgacgtggcgaggtactccaagtcgcaggggagggtgccggtgagcttcaaccctacggatctggtctgctgccgcacgctgcagggccatagcggaaaggtatattctctggattggacccctgaaaagaattggatagtcagtgcctctcaagatggaaggttaattgtgtggaatgcattgacaagccagaaaacacatgccataaagctgcattgcccatgggttatggcgtgtgcttttgcacccaatggccaatctgtcgcctgtggtggtcttgatagtgcgtgctctattttcaatctcaattctcaagcagacagagatgggaacatgccagtatcaagaattcttactggacacaagggctatgtctcatcatgtcaatatgtcccagatcaggaaacacgtcttattactagttcaggtgatcaaacatgtgttctttgggatgttactactggacagaggatatcaatatttggtggtgaattcccatcagggcatacagctgatgttcaaagtgtgtccatcaactcatcaaatacaaatatgtttgtctctggctcatgtgatacaactgtgaggctgtgggatatcagaattgcaagtcgagctgttcgaacctaccatggacatgaggatgatgttaacagtgtgaagtttttccctgatggccataggtttggtactggctcagatgatggcacatgtagattatttgatatgagaacagggcatcaacttcaggtgtacagtagggagcctgatagaaatagtaatgaactacctactgttacatctattgcattttcaatatcaggaaggctactttttgctggttactccaatggtgactgttatgtgtgggacacacttctcgccgaggtggtacttaatttgggaaacctgcaaaactcccatgatggccgtataagttgcctcgggatgtcatctgatgggagtgcattgtgtacaggaagctgggacaaaaatttgaagatttgggccttcagtggacaccggaagatagtttgaaggccaacttttctcccccatgttgtatgttccttgttgccccttaacaacggacagtggtgattggtgaccaactcgacttgttcctgggaatccctttgttgttttgtaagctctgttcgcgctatgtttaatggaaaaatgtgcaatttgtcagtgtcacggcgctacatcttgttgagttggtaactgtttatactgttattacgagaatatcagtaacgtgtgatctgcccttttctttgtacaaccgtttgatcttttcaggttttgtgaagtagcatgtatttccttaatcaatttatcatatcagtttgtccatttgctgaattaagaacaactggttcgaagacaatggaaaaaagcaaaaaaaaaaaaaaaaaaaaaaaaaaaaaaaaaaaaaaaaaaaaaaa

SEQ ID NO: 2471 - DNA, 1945 bp, Zea mays
  Clone ID: PAT_MRT4577_66519C.1
gacaaattgcacatttttccattaaacatagcgcgaacagagcttacaaaacaacaaagggattcccaggaacaagtcgagttggtcaccaatcaccactgtccgttgttaaggggcaacaaggaacatacaacatgggggagaaaagttggccttcaaactatcttccggtgtccactgaaggcccaaatcttcaaatttttgtcccagcttcctgtacacaatgcactcccatcagatgacatcccgaggcaacttatacggccatcatgggagttttgcaggtttcccaaattaagtaccacctcggcgagaagtgtgtcccacacataacagtcaccattggagtaaccagcaaaaagtagccttcctgatattgaaaatgcaatagatgtaacagtaggtagttcattactatttctatcaggctccctactgtacacctgaagttgatgccctgttctcatatcaaataatctacatgtgccatcatctgagccagtaccaaacctatggccatcagggaaaaacttcacactgttaacatcatcctcatgtccatggtaggttcgaacagctcgacttgcaattctgatatcccacagcctcacagttgtatcacatgagccagagacaaacatatttgtatttgatgagttgatggacacactttgaacatcagctgtatgccctgatgggaattcaccaccaaatattgatatcctctgtccagtagtaacatcccaaagaacacatgtttgatcacctgaactagtaataagacgtgtttcctgatctgggacatattgacatgatgagacatagcccttgtgtccagtaagaattcttgatactggcatgttcccatctctgtctgcttgagaattgagattgaaaatagagcacgcactatcaagaccaccacaggcgacagattggccattgggtgcaaaagcacacgccataacccatgggcaatgcagctttatggcatgtgttttctggcttgtcaatgcattccacacaattaaccttccatcttgagaggcactgactatccaattcttttcaggggtccaatccagagaatatacacagatagctgaagtgctgaatttccaagaatcaccgcaaaatccaaatatatgcaattatgcatcttcgaacaggtggaagtccatgtctccaaaagttttcataactttagcaacatgatgaggtgttctgctctagttaaatggccctcacaaaaaaatactctagttaaatggcaataaatctggaagatcctaatttttagcagcagggaggaggcttgcctcggtttatcccttccccaggccccttttatcaaagctagggcaaaagaaggctctagctaccaattatcgaataatatttcagtgacagatccatgcagcgctaagtatctctgcaacagaatgtacatgcagataatcctgtcccacagctcaaacatcaacctcgcaacggtatcattttcttcttcattactctggcagtctttccgctatggccctgcagcgtgcggcagcagaccagatccgtagggttgaagctcaccggcaccctcccctgcgacttggagtacctcgccacgtcggtgtcgaggagcgtctcccggcgctggcggaggcgctcgcgcagggagttcaccgacgccgtagctgcggcgtgcttctccttgagctccgccacggacgccatgggtgccgcccgctagcctcgcgccggaggccgccgcctagggattgagtgcacgcgggtcggggtctacgaggatccacgcatgaagcggaaattccaatggctgcggactgcggttatggtacggggagctcccggtggaggaggtggccgctggactcagaggagattaggacaggcggcggcgccgacagcgacggcaaactgacaaagtgtg

SEQ ID NO: 2472 - DNA, 515 bp, Zea mays
  Clone ID: PAT_MRT4577_665C.1
atgtagcatcaaatcatatcatcgaggaccaattaatatatggttacaggagctgcaatcgggtcaaccaacatgcaggtagtacacacgtacgtacatgagcacaaagactgacgccaaacatgcagtagagagatagcaaacgtgaagaactctgtttctctctgtcttacacacaccacacaatacctatgtatggcagccagctcggcctcgcttattattggtcaaccaccaccacaagctagatagataataatcatatccatggtcgtcgatcgatgtgatcagcagttgcaggggtcgcacttgcagttgccaccgtatctgcagccgtgggcggcctcgccggactccgccgcggcctcgacgaactcgggcgcggacttcttctacggggccactccgaggaccacggtggcctgcgcggaggtgctcgtattctccatgtcagggtacttcttgccgcacttgcagcttgagccgcagccgcagcttgatccgcagttgcaagc

SEQ ID NO: 2473 - DNA, 2537 bp, Zea mays
  Clone ID: PAT_MRT4577_6674C.1
gcacgagcctgactccaatcccattgctgctggaaagcacgaaggagcgatggtaaaagaggatgaaggccatggcgacagagtggccgccgacgctcctttccgtgtagtttaggactgcagattccttcgcgctcctcctgctcccagcgaggaaaagagagcacgaactaaactaggaaccatccctccccggcattcattcccttgccctttttttcaccgaattgtagcggttgttgctttcctgttcaggtgccttgttcttggcctccttcgcacgcaaagaaccgccggtcgtattgctctccgcactcacccaccgcgctgctgctgctcgactgctcgtggaagggttcttattggccgcctgtgcctgctttgcggtttcttgctctgcttttgagtggagccgctgtggagtggacggtgtggtgtggtgtgggtcggcggtgaggtgaaaggcttggtttctttctttcttgcgagggaggataagggaaagggaaggcgaagaggaggatggccggaggaggggcggcgccgccgccgaagcaggaggagctgcagccgcacccggtgaaggaccagcttcccagcgtgtcctactgcatcacaagcccaccgccctggcctgaggctgtcatccttggattccagcactacattgtgatgctgggcacatccgtcatcataccaagtgctcttgttccccagatgggaggaggaaacgaggagaaggccagggtgattcagacgctgctgttcgttgccggcatcaacaccctatgccagtcattctttgggactcgcctcccagcggtgatgggtggatcctacaccatcgtcgcacccaccatttccatcatcatggccggccgttacagcaacgaagcagaccctcgtgagaaattcttgcggaccatgcgaggaacacaaggcgctctcatcatcgcgtcgacaattcagatcgtgcttggtttcagtggcctttggcgcaatgtcgttaaattgctgagcccattgtctgctgtacctttggtttcgctagctggatttgggctatatgagctaggttttccaggggttgctaagtgtgtggaaattgggcttccggaaatcatcctaatgctcatattttctcagtacttacctcatgctgtccatgcggcaaagcctgtgttcgaccggttttctgtgattttcacaattgcgattgtatggctgtatgcgtacattctcacggttagcggtgcctacaagagtgcccgaacaaagacacaactccattgccgtgttgaccgctctgggcttgttggtggagctccttggattagtgtcccatatcctttccaatggggggccccaacatttgatgctggtgaatcatttgcaatgatggtggccgcatttgttgctcttgttgagtcatctggggccttcattgctgtgtcaagatatgcaagtgcgactatgatacctccttcagttcttggtcgtggcattggttggcagggcatcggtactttactgggtgcgttttttgggacagctaatggaactgcagtgtcagttgagaatgctggtctgcttgctttgacacatgttggcagccggagagtagtccagatatctgcaggcttcatgatcttcttctctgtccttgggaaattcggggcgatctttgcttcaatcccactgccgatattcgctgccctgtattgcattctctttgcatacattggtgcttgtggcctgagcttccttcagttctgcaacctgaacagcttcaggaccaagttcatcatggggttctccttgttcatgggcctgtcagtaccccaatacttcaacgagtacacgtccgtggctggctatggccccgtgcacaccggcgcccgatggttcaacgacatgatcaacgtgcccttctcgtcgaagccgttcgtggctgtgctggtggccttcttactggacaacacgatccaggtgcgtgacagcggcgtgaggagggacaggggctaccactggtgggacaagttccggagcttcaagacggacagccgcagcgaggagttctactcgctgcccttcaacctcaacaagtttttcccttccgtctgatcctgcagggtctgcacactcttcctcgcagccgcagtagccctgactggagtcaggcaagaaatgatcctatgcagatgatgctggagcatggactgatggcgttttgtacattcaggggtgaactgaactgtgcaggttgcaggggatagtgctctgggtagcatcagtattccctagtaaccgaaattgaaaaggccgcctgttaaacttctgcaaacactagcatgattacgtctcctagtgctactgttgtttagattggaaaacatggaactcaaccgtaagcatagatttaccttgaagcaacccttttcttttgcttagaaagaatttgtgttggggatttttttttcaccatgtaagaactgagagcacttagattacaagggagggtgaataggtgatcctgc

SEQ ID NO: 2474 - DNA, 669 bp, Zea mays
  Clone ID: PAT_MRT4577_6675C.1
ttgttcccccccccccccccccccccccccctccccccccccctcttctttttttttttttttctctttttttttaaaggaaaaaaaactggcccagttaaaacaaacaaatcacgatgggatttaccataggataaactggacccccggccaaacatttttatcgggcaacccgggggggctacagctaagggaacaagtttctttttgtttacaagcaacgcttccatgttccatttaccctagggaagcctcgtcagtttttccacccttttggacagttcctccagggggacccccatcgccttggacccctcctccattttgctccggttaagggcaaggaaaaactctatcaggcccccggggaggaagttcccaccctcccccgtttttttgtcgttatggaaggacccccattgctcggggctcaggtttcccaccccctttatgtacttcacaaggggcgacgggagcttttccaaaaaaattttttggccgggcgggagggaggcaataatgccaatccccccgtttattgggccaaaaatgaccggggggatctgccctatttccgagtctggaaggcgcatcaccagggaaccgggggggaatttgttcacaaaccccccaagggggtactttcccaccacctaaagccgggccctt

SEQ ID NO: 2475 - DNA, 285 bp, Zea mays
  Clone ID: PAT_MRT4577_66C.1
agcgctcgcccgctcagtcacaaatcctcaggtctcagtcgccttcatcgccgcttcgttcgtgtggaggggagaagacaggaaatggcggcgactgagggcgtgctcttggggatgggcaacacccctcctcgacatctccgccgtcgtcggtgacgccttcctgacaaagtatgacatcaagctgaacaatgctattctcgctgaggaggagcacttgcctatgtatgacgagttggctagctagagcaatgttgaatatattgccggaggagccgcccagaa

SEQ ID NO: 2476 - DNA, 486 bp, Zea mays
  Clone ID: PAT_MRT4577_67053C.1
ccggcaggcgtccggccgggcacaacgtggtgctggttatccaggttatcatcccgtcgactcccgataagcgggggaagtaggcgatgtttaagggcgttctcctcccctacatcgtcgtcgcgctctgctacttccccgttgcgctcatcggctactgggcgttctgaaacagcgttcaggacaacattctcatcacgctcagtaagcccagttggctcatcgcgctcgccaacatgatggtcgttatccacgtcattggcagctaccagatctacgccatgccagtgattgacatgatagacactgtgctggtgaagaagctgcgctttccttccggtctgacacttgtctttcatcgctgggaccgcctatgttgcgttcacaatgtttcatatgttttcatccttccccttcttctgtgggactgctcggctttcttcggcggattcgtctttgccccgaccgaccttattccttccctgc

SEQ ID NO: 2477 - DNA, 345 bp, Zea mays
  Clone ID: PAT_MRT4577_67111C.1
agaaatgtactttcttatttctgggaagccacaaacatcagacaaaaaactttattattgaactataactcataagaaatctaaaagagggccccaccaatgatgggttgttggtagaacgctgatgggtttgtcaaagcaagtaggttgaatggcacaaattgtcgcacttataagagggtgccaacgttaggcccaccgcgctgctacaacggcaccaaccgtggttgcatcacgaaggtaccagggctcacaccagctagctggatgaatggtagcacttgtcgctgctgtaaaataacacgacagtacattgctgccagtccggtcaatggaacaaatcgc

SEQ ID NO: 2478 - DNA, 142 bp, Zea mays
  UNSURE (1)..(142): unsure at all n locations
  Clone ID: PAT_MRT4577_67166C.1
  unsure (1)..(142): unsure at all n locations
cggtccgnatccccggtctgttaatccaatanaaaaagacatgagaatacatgtccaatgcaatctaaaaggaaacatggcagaagagattgtcaaacatgcctatgcacaaagctgaactgctgatttgattagctcaata

SEQ ID NO: 2479 - DNA, 418 bp, Zea mays
  Clone ID: PAT_MRT4577_67392C.1
gggagcaccaagaagcaccattttttccttgagggttaacttaaaacaaatcctggcggggggaacagcatccatggggccacaggccatgctgggtgaggcatgggtctgcgggggccgggggtgaacacaggactaacaacgggcacagagggaccttgcaatcaaaaacacaggggggcaacaacaaacggggcgaacgaagataaaccctttggactaggggaaacatcacgggggcgaacaggataacttgggcgggcgggccccaccggtaagtttctccagttcccggcggagttgccgtaaccccccccacgggtgccaccgccgtagccgccaccaccaccaccggaggcaccggcggcaccggaggcggcggcggcaccggcgtagcccccgccggcattaaggggcc

SEQ ID NO: 2480 - DNA, 3299 bp, Zea mays
  Clone ID: PAT_MRT4577_6745C.1
gataaaatttttaaatcctttaacaaaatactgttaaagtttaaaaaagtttatattaaatagtaaagttaacactattgatctcaataatattctcggttagatttgccacgaacggagaaggcctagagcctaggtccgccacatgctcagcagctagaacgcgccaatgctcagctaagcctcgatcatgctgacggacaacagaatcgcgctggcctcgatggctcgatccaatagtggagccatggcccatgggcctctgatgatgccagcaacacacgcacccaagtttcaagcctagccttgagtatgaatagatggccaataagcacgaggctagtgagcccggcacgaagcctgctttttaggtccggtccgagcccggcacggtacgaataagcgggcgggcttggacaggaaactaggcacggcgggctaaatcggtccggcctaagcccgttaagcccgttttttacactaaaacgtgtttacctgcccgtttagcccgcttttcggctcgattttttcgtgctaaacgggccggcccggcctgtttaggcccgctgtgggccggacttggacagaaaattaagcccacgggctcagcaggcctgacccggtttttagccaggcttcaccgggcccgagccgggcggcccgtttggccatctctaatgatagttgataccgggtctactacatgagcctccgttgttgaagatagatactatcgttacgctcttctggattatcaagatttccagatttaaatggaatataagcggccgcatgtcataactgttcatcacattttttcccccaaacggtgagacactgtattgtatttgagtgcttttcatgagaatttctatcatcttgatgtctaatattgaagatctattttttcatcctccttacgtttttttacgttcaaaattatgctctcgtattttatataacttatatttatacgaattaaaaaagcccatgtttagcgactatcggtacgagatcttttatatttcaatatatattgtgttgcatccttttcatatgtaattgggactcatgaatcatgcgtatacaagttaaaaaaactcgcgtttagcaatgatgcagagtctgatttaagtacttatgagttgcaactcacacgaacatggttgctagtatatgcctatataccacatgctgctgcgtctcccgtaggccgtgaatctgatcagtaggacttgaacgggcggtagactttgaggtcggacgcgatgccggcgatggacccggctgcggcggcgatggagatgacgaggcagccgaggctgagcatctgcaggcacacccaccgggagctccaccgcggcaccttcttctgcaccacgtacatctcgacggggaagtagacggtgagcggccagaagccgagcgcgcccaggaagcccaccacgtcgttgaagaagggcagcagcatggacacgaccgtcgtggccacgacgaacgccgtccgccacgtcgcccggaacaggttcaccttgcagcaccgccgccggctcgccgggagcgggagcgggacctcgacctccccggtgatgtacgccgagtccggccaccgctgcgcggcccacttctccacgaaggcgaacagcggctggcagtagacctggtaggcgccgaccaggtggaccacgatggcggcgttggccacgtccaggagccagaagggctcgtagaagccgaagcccgtgaggaggttcccgggcgcgccgtcgccgaacgccgcgtaccccatgcagccgcacagcatgtagaagagcgtggtgaccgccacgctcaccaccgtggcgcgcttcatcaccgtcgactccgacggcggcggcgcccggatggtgtcctggatctcgatcaggatgagggagtaggagtaggcgaaggcgacgtcgccgaacgcctggaggctgcgccacaccttgtccatcggggtcaccacgccgatggtgatgccggtcaggctgccctgcacgcctctgttcgctgcgttgcatcgcactcatggtaagtcctagtggcactgcctgctgatgacctgatgtttgccagagcgaaaaaaaaaggcatcatgcgtcacggcgtgtgcctgcagcgtaccgatgacttggacgacgcccaggccgagcccaatggaggagtaggtgaaggacatgacggcggcgaggatggagagccaggagatctggtcgaagtccgggatctgcgagaagaagatctccgccacgccgaagatgatcatgtagggcgtgctggagatcttgcaggggttgccgtgtcccttctggtggaagcagttggccctcctgatcgcgctgcatgcggttgcggcgcaccaacacgacaccatatgtatatcaagtcacaggaggtacgacattcatgcatcactgtccagatgaaaggctgcgttcactcacagcatgctaatggaggcagcgatggtgtagccgatggccacgcccacgatgttggcgtactgcaggaacccgcagatctggaccttgatgccacctgctcgacgaaattccagtccacgggatgcacagagtaagctctagctaatgggtctccaactctcgcaaagtcgcaatgcagagacgtgggaaggagggggacgaaggcggaggggcacgcactgaggttcgcgttgacggcgtccatgtaggtgtagttccgcttgccggtgctggggtcgccggagcggtagcagtctgcgagcagcgacgaggtgtagtaggtgacgagcgagaagagcagcatgacgacgggtccggccacccagccgagctgcgcgatggcccaccccagcgagagcaccccggagccgatcaccgccgtgatgatgtgcgcgctcgccgtccacatcgtccctgtagcacatgcatgcagcccaatacgtcggaatgcacatcagcactcaacgttaacacggcagcaagcgggaaaaaaaatcatggtccctcccagggcgtgcatccgctagacgcctagacccgagatgatttgctgacacgtcgacggacgttccctcgctagcctacgggccgtgcaatcgagcgagccgattttattaaattggaattgttcggtgtgcgcctgcagcgggaaaatttccatcgtagaatagcggcactccggtctccgttcccgcggggagaaaaaaatttcgtccaatttcgcagaaacactcaagcatgtttaggagcaaaaataccgaagaaatttgatggacaaaatgatgaactacgtac

SEQ ID NO: 2481 - DNA, 1843 bp, Zea mays
  Clone ID: PAT_MRT4577_67667C.1
cagcctccaggcccatgtgaaacggtggatggcccgccctacgcgacccggggtctgcaccctgccgtttcttctccattattcccagcgggcgcgctcgctctctctttctccctcccctcctcgtggcgacgattgggggcagtcgctgccgccgtacgccaggtgcccagatcttcttcatgcccttctccagcgacgagtatcagaagctgtttgtgcttttaaggatgcataagcgtatggcggttttgatggtatccattgtttgaacgatgggaggatagaagaccattctctgcataaataggcttcataagtattattgctttattgctttaatattatcatatgattgagtgcacaatgccatcaaccttacttgatgatctccctaacgaagttgctctccagtgccttgcacgggtaccattcttgttccatccgacgcttcagttggtttgccgctcttggcgagcatcagtttgcagtggcgaacttctcaaaattcgtaaccagattggtacgacagaagagctcttgtgtgtgttggcgtttgaaccagaaaacatgtggcaactttatgagcccctacgagacaagtggataactcttcctgtcatgccatctcagattaggaacatagcccgctttggcgtggcctcagttgctggcaagctctatgtaattggtggtggcagtgatcgagttgatccgcttactggagatcacgacaggatctttgcaagcaatgaggtttggtcttatgatccgctgcaccgtgtgtggtcccagagggctcctatgcttgtggctcgagcgatgtttgcttgttgtgcactggatgggaaaataatcgttgcaggaggcttcactaactgccgcaaatcgatatcaaaggctgagatctatgaccctgaagctggcatatgggagcctcttcctgaccttcgtctggctcatagctctgcatgtactggacttgtcatcaagggtaagatgcatgtattgcataaaggtctatcgacagttcagattctggaagatggtggcagtcattgggctgttgaggatttctcttggttgcaaggcccgatggcgatggtcggtggagagctgtatgtgctgagtaacagctgtattatgaagcaacgtggtgagaacttccctgataagatggtatcgtgtgcatctgagttccagagcaggatcggtttcgggatgattggtgtgggtgacaacatatatttggttggaggagtgattggacctgggccgagaaaccaatgcatcaagctgctctctgatgttgatatcttgaacgtcacaagtgagagaccaacctggagaccagggtcgccgatgacgcattgccgagggagcatctgtggctgcgctttgttgaggatttagcgtcttcccagtgtgatagtgtgagtattccaccattgctgaactgatcggtgacgtcctaagttttattttattttcaaaagggttgttatttacgctttccttttggatcctttgtagcattgagggcatgactcaatgttggattgccaatgagatatatactatattgaccatgaacagtgttccagaacacactatatacttcatcattttcatttggcatttaaatattttggtggttttaaatgacatcttgctggtttgaataagttttattttattttcaaaagggttgttatttacgctttccttttggatcctttgtagcattgagggcatgactcaatgttggattgccaatgagatatatactatattgaccatgaacagtgttccagaacaaaaaaaaaaaaaaaaaaaagggtta

SEQ ID NO: 2482 - DNA, 1374 bp, Zea mays
  UNSURE (1)..(1374): unsure at all n locations
  Clone ID: PAT_MRT4577_67670C.1
  unsure (1)..(1374): unsure at all n locations
cctcgnagccggccgggcggggccgggaccctgccgtttcttctccattattcccagcgggcgcgctcgctctctctttctccctcccctcctcgtggcgacgattgggggcagtcgctgccgccgtacgccaggtgcccagatcttcttcatgcccttctccagcgacgagtatcagaagtgccttgcacgggtaccattcttgttccatccgacgcttcagttggtttgccgctcttggcgagcatcagtttgcagtggcgaacttctcaaaattcgtaaccagattggtacgacagaagagctcttgtgtgtgttggcgtttgaaccagaaaacatgtggcaactttatgatcccctacgagacaagtggataactcttcctgtcatgccatctcagattaggaacatagcccgctttggcgtggcctcagttgctggcaagctctatgtaattggtggtggcagtgatcgagttgatccgcttactggagatcacgacaggatctttgcaagcaatgaggtttggtcttatgatccgctgcaccgtgtgtggtcccagagggctcctatgcttgtggctcgagcgatgtttgcttgttgtgcactggatgggaaaataatcgttgcaggaggcttcactaactgccgcaaatcgatatcaaaggctgagatctatgaccctgaagctggcatatgggagcctcttcctgaccttcgtctggctcatagctctgcatgtactggacttgtcatcaagggtaagatgcatgtattgcataaaggtctatcgacagttcagattctggaagatggtggcagtcattgggctgttgaggatttctcttggttgcaaggcccgatggcgatggtcggtggagagctgtatgtgctgagtaacagctgtattatgaagcaacgtggtgagaacttccctgataagatggtatcgtgtgcatctgagttccagagcaggatcggtttcgggatgattggtgtgggtgacaacatatatttggttggaggagtgattggacctgggccgagaaaccaatgcatcaagctgctctctgatgttgatatcttgaacgtcacaagtgagagaccaacctggagaccagggtcgccgatgacgcattgccgagggagcatctgtggctgcgctttgttgaggatttagcgtcttcccagtgtgatagtgtgagtattccaccattgctgaactgatcggtgacgtcctaagttttattttattttcaaaagggttgttatttacgctttccttttggatcctttgtagcattgagggcatgactcaatgttggattgccaatgagatatatactatattgaccatgaacagtgttccagaac

SEQ ID NO: 2483 - DNA, 271 bp, Zea mays
  Clone ID: PAT_MRT4577_67676C.1
gcagccccaagaagcaccattttttccttaagattaacttagaataaagcctgacgggggtaacagcatccatcgatccgcagtccatgctgtttgatgcatgggtctgctgaaaccgaggatgaacacagctctcacaactggcacagggcgtccttgccatctaaaacctagacgggccctaccaaacacgacccgaacgcagataaaccccctggaccagggtaaacatcacggtcgcgagccggataacttggcgctgcgggcccca

SEQ ID NO: 2484 - DNA, 956 bp, Zea mays
  Clone ID: PAT_MRT4577_67708C.1
ctcctacgcctacatcctcatcgagatacaggacacgatcaaggcgccgccgccatcggaagtgacggtgatgaagaaggccacgatggtgagcgtggcgacgacgacggtgttctacatgctgtgcggctgcatgggctacgcggcgttcggcgacgacgccccggacaacctcctgaccgggttcggcttctacgagcccttctggctcctggacgtcgccaacgccgccatcgtcgtgcacctcgttggcgcgtaccaggtcttctgccagccgctcttcgccttcgtggagaagcgggcggcagccaggtggcccgacagccggttcatgacccgggagctgaggctggggcccttcgtgctcggcgtgttccgtctcacctggcggacggccttcgtctgcctcaccaccgtcgtcgccatgatgctccctttcttcggcgacgtcgtggggctgctcggcgccgtctccttctggccgctcagcgtctacttccccgtcgagatgtacaaagcgcagcgtcgcgtgcgcaggtggagcacgcgctggctctgcctccagacgctcagcgccgtgtgcctcctcgtttccatcgccggcgccgttggctccacggccggcgtcataaacgcagtcaatttgcaccgaccattcagtggctaagagcgtgtgctctactgctccgtgcatcctcgtcttctctcgctccgtcgcagtcactatctatagcggaccaaattaaccaagcactccattagcgtggctgtttatcaagcctgctcctgttctgtttatgcaggcggagcctgcagcttgtttgcacgcccggggcataaagttggtgtccatcttctacatgtcacggttatattgtatttttttaagatgagcacgcctgatcacaccctaagattcctgtaaggtacactccaatgagaggtagattgaaggc

SEQ ID NO: 2485 - DNA, 591 bp, Zea mays
  UNSURE (1)..(591): unsure at all n locations
  Clone ID: PAT_MRT4577_67784C.1
  unsure (1)..(591): unsure at all n locations
aggtgaaaggcaatgcttatgtcccagaagagattggagaaacgatttggtcagtctcctatatttactgcatccacctttatgactcaaggaggcataccaccttcaacaaacccagcttctctactaaaggaagccatccatgtcatcagctgtggatacgaggacaagaccgaatggggaaaagagattggctggatctatggttcagttactgaagatattcttaccgggtttaaaatgcacgcaagagggtggatatcaatctactgcatgccaccccggccttgtttcaagggttctgcgccaatcaatctgtctgaccgtcttaatcaagttctacgatgggcgcttgggtcagttgaaattctgtttagcagacattgtcctatctggtacaattacggtgggcggttgaaacttctggagagggtggcttacatcaacaccattgtttacccattaacatccctccccttatcgcctattgtgtgcttcctgctatctgcctcctcaccaacaaatttatcatccccgagatcagtaataatggctgggatgttcnttcattctcatgtttgcgtccatctt

SEQ ID NO: 2486 - DNA, 2061 bp, Zea mays
  Clone ID: PAT_MRT4577_67810C.1
ccacgcgtccgcctgcccagagcagcgtacacgcgctggcgcgctgagggcggcggcaccttcgcggaccgacacagccggattggtcaattgtggattacgcttatgacacacgcgcggctaaagcgcactgagacagaccctgctccccgcgcagcgctatggctctcgccgtccgcacgcctcgcatccagcctcgaccggcctccgtttctgcgcccacaacacccacatcgacctccctcgccgccgggaacgcgttaccctgctatggcctcgcatactacggctgtgcctagcccttcaccgaggccacctcctcctcgcgctaccgccgcgacgcctggtcatacgccgccgatggctcctccaactccgcatccccgtcctccgctgccgctgctgccgcgggccgtcgggatgacgagatcgcgctgcagctgccggaactgcggaggctcctggacgtgctgagggcgtccagggggaggggcgccgaggagggcggcggacccggggaggtggcactggtgggcacagggcccggggaccccgagctgctcacgctcaaggcggtccgggccatcgaggcggcggacctggtgctctacgacaggctggtgtctaacgacgtgttggacttggtcggggagggcgccaggctgctctatgtcggcaagaccgcgggataccacagccgcacccaggaggagattcacgagctgctgctgagctttgcggaggccggtgccaatgttgtgcgcttgaaaggtggcgatcctctggtttttggaaggggtggagaagagatggatttcttacagcaacagggaattaaagttgaagttatcccaggaattacttctgcttcgggtattgcagcagagctaggcattccgttaacccatagaggtgttgctaccagtgtcagatttttaactggccactccagaaatggtgggacagatccactatatgtagctggaaatgcggctgatccagacactactttggttgtgtatatgggtttgtcaacacttccatcacttgctccaaagttaatgaagcacggcctgccaccagatacccctgctgttgcagtagagcgcgggactacaccccaacaacgaacggtgttcgcctcgttgaaggatcttgtggatgaagtcaagtcagccgatctagtttctccaactctaataattattgggaaagtggtatccttgtcacccttctgggttgagtcatctgaacatgatgcactgaaagttcagagctcgtatgcaaatgaggccagatgacaacagattttcttggtttttagtgactggacaatacttgagaaatgcaagatcccagatatgggagcacaggttcgacctggtgtacacagaaacatctcaggaagcatggatcctgaatggcggatggtagcttaagcttataacagacttggggcagaagcgcacttggactgatcatgcttgattctttggcctaatctacatgagattcacaatttttcgatttagttgagttcgacaatagttgtgtgcttctttgttactagtagccatgtacgtgcggcgcacgcgtgtttacgattctatgccctagcatagtaaggctattccaacgctgccacgttatgattttatgataatgggagtttcgtagcaccatgataatgagaaatagtgctacgaagctcttattatatgacaagtgccataaatcgtagcacttatgattttatgatatggggagcttcgtagagctctttctaaaaaaaaaaaaaaaaaaaaaaaaaagggcgacgctttcaattccgcgtcttcttcaccaaagaatactcggtagatgcatggttttcaattcaataacacctgcaaactactttctcactggaagtccattccgagtgcacggattttacagaaattacacaaaaaaagttctgttttttggggggaattaaaaaaatctctgcttcccaagcgtacataactgggagatttttacctgtcatctttaaaataatccgcattgactttatgcggt

SEQ ID NO: 2487 - DNA, 640 bp, Zea mays
  Clone ID: PAT_MRT4577_67817C.1
tccaaatccccccagcaaatccccaattcctccgagttcgagcgcccatgtcggggcgtggcaagggcgggaagggtttgggcaaaggcggcgccaagggtccccccaaggttttccgcgacaacatccagggcatcccgaaaccgccgatccgaaggctggcaagaaggggcggcgtaaagcgcatctcggggctcatttacgaggagacccccggcgtgctcaagattttcctcgagaacgtcatccgcgaccccgtaacctacccggagcacgccccccccaagaccgtcccccccatggacgtggtttacgcccccaagcgccagggtcgccccctttacggattcggcggctgaaaggccctcccccccctggtggccgtggcaaaagtcttgggtcccggtcaaaaaatcgaaagtattttggatgacgggcttagtttcgtagtattattatccctagtgcttattgttaccggttgttgggttcgccccctttaagcccctgtcaaacagtaatatatgagtcccgcctttccgtgttttgaacttttaaaaaaaaaaaaaaaaaaaaaaaaaaaaaaaaaaaaaaaaaaaaaaaaaaaaaaaaaaagaaaaaaaaaaaaaaaaaagcggcc

SEQ ID NO: 2488 - DNA, 312 bp, Zea mays
  Clone ID: PAT_MRT4577_6783C.1
caatagtgtaccaactatggcagccaaaatattttgcctacttatgctcctgggtctttctgcaagtgctgctacggcgaccatattgccacaatgctcacaagctcctatagcttaccttcttccatcgtacctgtcaccagctgtgtctaacgtatgtgaaaacccaatgcttcatctatataggatccaactggtattcgcagtttgcatcttacctttatcactctagttcctacagcaatcatcagctatattacagcacttacctatggtgcatagattgacccaaaacattaggtctcatcaact

SEQ ID NO: 2489 - DNA, 1504 bp, Zea mays
  Clone ID: PAT_MRT4577_67934C.1
ctcgaggccggccgggacagcatttctatcctactgccggcgttccagagttcgagctgagcagttgcacacagctgctcgtgaagctagctagcgaagccacaggcccccagtgactttgctcccccacaccgtagcggccgtataaaccagctccaaccgatccatcgaaatcgaaccacagtacgtgagcccgtactagagacatatggcctccgcgatcaaggctgcatcgacctcctcccggtggtcttcgtccccggcggcagtccactcgtcgccgttatcgaagcggcggagggcggtcgccgcggtagctccggctgccccggcggcgccggccaagctcaccgccggtgccggcggccgatgcctgccggtgtcgcagaccatgtccaggctcagggcgcagggcaagacggcgttcatcccgtacatcaccgccggcgacccggacctggcgacgacggcggaggcgctgcggctcctggacgcctgcggcgccgacgtcatcgagctcggcgttcccttctcggacccctacgccgacgggccggtcatccaggcgtcggcggcgcgggcgctggcgagcggcacgacgccggacggcgtgctggcgatgctgaaggaggtgacgccggagctgtcctgccccgtggtgctcttctcctacttcaaccccatcgtgcggtggggcctggccgacttcgccgccgccgtcaaggaagccggcgtgcacggcctcatagttcccgacctcccgtatgggaactcgtgcgctctcactctcaggaccgaagccatcaagaacaacctcgagctggtgctgctcacaacaccatctacgccagcggacaggatggaggagataacacgagcttcacgaggattcgtctatctcgcgaccgtcaatggagttacaggtccacgcgcaaacgtgaacacacgtgtccagtctctcattcaggaggttaaacaggtcactgacatacccgtggctgtcgggtttggcatatcgaaacctgagcatgtaaagcagattgcagagtggggtgcagatggtgtgatcattggtagcgcaatggtgagacagttaggcgaagcagcctctcccaaggaaggattgaagaggctagagaaatacgccaggagcatgaagaacgcgctaccatgccagtgaactagtcgtattgacgcgatataggctgtgttagcaagcacgttggagaacaatgttgcagaagtagcacaattaataatgatccattcggcaaggttgcttttttacaaattgcaacaatatgttatcaatataaaatcaacgattcctttgtttaaaaaaaggaagaaatgttacatcattgcatgatgcttcgattcagtggtcactccattcattctaaattacagttcagttcgagtttgtcctggctcagccctttaaagattgtcggtttgtaataataacaataataataatacaaagtggctcattacattcttc

SEQ ID NO: 2490 - DNA, 1005 bp, Zea mays
  Clone ID: PAT_MRT4577_68005C.1
ttcaaattcttcatcgaaaccacctgtccatatgactggtagtggtaggcctaatgctcctccataccgtcttccagttcttccaatggacgatgatgaaatctcatccaaagttcttctagcagttgaactttgctaattgaagctgcaaaaggaacttcgatagatcagcattacgaggcacagcagtgaaagccccatgtttaccttttccacggcttactcctcttggcgaacctccttcaccaagagctgcacatgtagcaactgctgttgaaccatggtggtcattcagggtggaattggtccagctggcttatccgctgaggaccttcatgtcttgatcttaaacaacaacgaccgcgatggcatagagtggtggttcaaggtcctggtccatggtatggatatgtgatggccttggttggtcaacgattcttattgacaattggtggcaatgatggaaaacgacccccggcagatgtatgggcccttgatactgcggccaagccatatgaatggagaaaacttgaaccggaaggtgaagggccaccaccatgcataacatgtgtctgattgaattctacaccagttcttggaagagaaagcctcaccaagtcatcatctccaggaacgatgttagtgaaagtcaatttaatctggtgctgaacattgagttgcaacaaattatcgatggagactgagtcaccgcagctagaaaccactgtctcaaggtgatgaacattgagttgcaacaaatcatcaatggagaccaagtcactacagtcagaaaccactgtctcaattttaggagattttccatctatgtttgttagaaggtataatgcctatttatctcttgtattcgaacatttggcaattaagaaatagaagattacttccccaatatcctttcttcctaatatcaccttttacggcttctggggaacaatcacttggtattaccgactgacatgtccatcatatgtgagatattgggttgat

SEQ ID NO: 2491 - DNA, 330 bp, Zea mays
  Clone ID: PAT_MRT4577_68112C.1
agggatgaagtcatagagaacccaaggggtgtacaccagcgagcgattccatgtgacatgcttacattgaaacggtggggggctctcactggattattgtgtatatactggaccacaaaaggccttcttcttcaaccaagctaaaaagcatttgcggccttttctagcacaaaagtgggcgctgtttattgcgtatgcccgtgcgtttatacgctgcaacttctaccgggcagaaccggcacggtggggcctacttgattaagaggtggcaatctgaccaaggtccttactctggctcgatagcactggacttctgaccgggcgttattg

SEQ ID NO: 2492 - DNA, 2877 bp, Zea mays
  Clone ID: PAT_MRT4577_6821C.1
gtcgcgtatgttctcgtctataccccacagccggccaccccccgcagccaggcaagtgaccgttgcatcctcttccccttccccttccagagcccaattcggcacgagggtaaattcatccgtccatccaccgacccagagccctcgatcccctaaaaaaaacccagagccctccattccacagccatcctcccctctgcagtgcactgctgcttgaccaagcaacaacaagaagctaccagcgcgctacctgcagattgcagcacacgcaagtgagagggcaggcaactccccggacgcaaggagttagagggcaagcatggcttcccttggtgacataggcctcgccgcgggtctcaacgtattgaccgccgttgccttcttgctcgcatttgcattccttcggctgcagccaatcaacgacagggtctactttcctaaatggtacctcaggggaatgagagacaatccaatcgtatctggtgcagctgtgcaaaagtttgttaacttagacgccagatcctacttgaagtttttaaactggatgccagctgctctcaagatgccccaggatgagctcattaaccatgcaggccttgattctgtggtctacctacggatatacgtaacagggctcaagatatttgttccaattacagttctggcttttcttgtactggtcccagtcaattggaccaatgacaccctaggacgcatcaacgtagtctacagtcctattgacaaactttcgatatctaatgtacctaatgggtcgaagaggtttatagctcacttgggcatggcttatgccatcacattttggacctgttatgtactgttgaaggagtatgaaattatttctaacatgaggctgcgctttctagcttcagagaaacgccgaccagatcagttcactgtccttgtgcggagtgtcccaccagatcctgatgaatcaatcagtgagcttgtggaacatttcttccttgtcaatcatcctgatcattatctacaacaccaggtggtttacaacgcaaataaacttgctgatctggttgaaaagaagaagaagatgcgaaattggcttgactattacctactaaagtatgagcgaaattcatcattgaggcctaccacaaagactggctttcttggatgttttggttccaaggtggatgctattgactattacaaatcagagatcgagaaaatcgggaaacaggaagctgaagagcgtaagaatgtcatgaaggatccaaaatcagttgtgccggcagcctttgtctcatttcgctcccgatggggtgcagcagtctgtgctcagacccagcaaacaagcaatccaacactctggttgacagaatgggctccggaacctcgtgatgtttattggaataatctgtccatcccatttgtgtcccttacaattaggagattgatagttgctgtggcattcttcttccttaacttcttttacgtcatcccaataacattcgtacagtctcttgcaaaccttgaaggaatagagaaggcacttccatttctaaaacccttgattgacttgccattcattaaatcattcatccaagggtttcttcctggaattgctttgaagatcttccttatagtgcttccaactatactgatgtttatgtctaaatttgaaggactgatatcgcagtcatctctggagaggcgatctgcatctaagtattacatattcttgttcttcaatgtatttttggggagcgtaattgcaggatctgctctggagcagcttaaaacttatctccatacatcagcaaacgacataccaaggatcattggtgactccatcccaatgaaggcgacttttttcataacatatgtgatggttgatggttggactggaatagctggtgaaatattgagactgaagccgcttatattcttccatctgaagaactttttcttggtcaaaaccgaaaaggacagagaagaagctatggaccctggcagtatctgctttgactcaactgaacctagaatacagttgtacttcttgcttggccttgtttatgctgcagtgacgccgttcttgcttcctttcatattggtgttctttgggttcgcatatgttgtcttccgccaccagataataaatgtctataatcagcaatatgagagcgccgcacagttctggcctagcgttcatgggcgtataatcacagcgttgattgtatcgcaactgctgctcctgggactgatgagcacgaacgactttgagcagacgacacctgtgctccttgttcttcctgtgctgacctttgggttttacaagtactgcaagaaccgctttgagccggcattcgtgaggaacccgctgcaggaggcgatgaagaaggacaccctagaacgcgcccgggagcccaacttggatctgaaggcgtacctggccaactcgtacctgcacccggtgttcaagggggacgaaggcgacgacaggtactcggtgatggacgacgatgggtggatggaggaggaggtgatcgtgccgacgaagcggcattcgaggaggacgacgcccgcgcagagcaagcatgaagggtcggactcgctctctgtgctcgagagttctctacagcggtagtcacagtaggagcttagcctgtacagaatggatgaaaatgatcacggccctgctccattgcttttgctttggttgttggttgttcatgtcacaggggacacacacacacagatagaattcaagagagctgtggggaggactgaggggagagatagtttactgtagcttggacaaagaatctgaatacagcagttacattatctgatgaatctgttagcaccatccaaaaaaaaaaaaaaaaaaaaaaaaaa

SEQ ID NO: 2493 - DNA, 391 bp, Zea mays
  Clone ID: PAT_MRT4577_68294C.1
aaaaaactgggaaggctcttttttatttttgggaacccacaaacatcaacaaaaaaactttattattgaactataactcaataaccaatctaaaagagggcaccaccaatgatgggttgttggtaaaaccctgttgggtttgtcaaaacatgttggttgaatggcaacaattgttgcaattgtaaaaaggtgccaaccttaggcccagcgtgcaggtaaaaccgcaacaactgttgctttgtcaaaaaagcagcagggctcacaacaactaactggctgaatggtaatagttgttgttgtacataaacaggaaagttcaatgctgccagttggttgaatggaaaaaattgctggtggtaggcaacaactagctggctgaatggtaataatt

SEQ ID NO: 2494 - DNA, 648 bp, Zea mays
  Clone ID: PAT_MRT4577_68371C.1
ggagatggagcaaagcttgtccgggatgcattccagcttgcgaaagagaaagctccttgtattatatttattgatgagatagatgccattggcaccaagcgatttgatagtgaagttagcggtgatcgagaagttcagcgaaccatgttggaattactgaatcaactggatggattcagcagtgatgagagaataaaggtcatagctgcaacgaaccgtgctgacatccttgaccctgctctgatgcgatctggacggttggaccgaaagattgagttccctcacccatctgaagaagcaagagctagaatcttgcaaatccattcaagaaaaatgaatgtaaatcccgatgtcaactttgaagaattggctcgctcaacagacgacttcaacggagcacagctaaaggcagtttgtgtagaagctggtatgctcgctctacgccgggatgctacagaggtaacacatgaggacttcaatgaaggaatcgtacaggtccaggcgaagaaaaagtcaagcttgaactactatgcttaagctatactttatgcaaaaatgtggaccacaagttgtttgtaacactactgtatggatgatcgaagctacgtttttacgtttgctttgagagtgcaagtttttaacattatc

SEQ ID NO: 2495 - DNA, 1614 bp, Zea mays
  Clone ID: PAT_MRT4577_68373C.1
cattgggtacctcgaggccggccggggtcgccgtagatacggcgctaggaaggaacaacgcagacaaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaagctcaacaagcagctgccctacctcgttggcaacatcgttgagatcttggaaatgaaccctgaggatgaagctgaggaggatggtgctaacattgatttagactcacaaaggaaaggaaaatgtgttgttctgaagacctccacaagacaaactatattccttcctgttgttgggctagtggaccctgacaagctaaagcctggtgatctggttggagtcaataaagatagctaccttatactagatacattgccatcagagtacgattcacgagtgaaggcaatggaagtggatgaaaagcccactgaagattataatgacattgggggtcttgaaaagcagattcaagagcttgtagaggcaattgtactgcccatgacacataaagaccggttccagaagttgggtattcgtcctccaaaaggggttcttttgtacggaccaccaggaactggcaagacactcatggctcgtgcatgtgctgcacagacgaatgcaacgtttcttaaattagctggtccacaacttgtgcagatgtttattggtgatggagcaaagcttgtccgggatgcattccagcttgccaaagagaaagctccttgtattatatttattgatgagatagatgccattggcaccaaacgttttgatagtgaagttagcggtgatagagaagttcagcggacaatgttggaattattgaatcaactggatggattcagcagcgatgagagaataaaggtcatagctgcaactaaccgtgctgacatccttgaccctgctctgatgcgatctggacggttggaccgaaagattgagttccctcacccatccgaagaagcaagagctagaatcttgcaaatccattcaaggaaaatgaatgtaaatcctgatgtcaactttgaagaattggctcgctcaactgatgacttcaacggagcacagctaaaggcagtttgtgtagaagctggtatgcttgccctacggcgggatgctacagaggtaactcacgaggatttcaatgaagggatcgtacaggtccaggcgaagaaaaagtcaagcttgaactactatgcttaagctgtttgtcaaaacatatggaccataaggtgtttgtaacactactgtatgaataatcgaagctatgtttttaatgcaagatttttacagcatataagaccccacgccagcccacccgatttttttttgtattttagctcttttcttgaaaagtattcacgtttagaccgttggatgattt

SEQ ID NO: 2496 - DNA, 413 bp, Zea mays
  Clone ID: PAT_MRT4577_68380C.1
actgtctgatgccgcccaggtgtccctgctcaggccacccagggcgatgccatcaggaactactaccatgacaaccatgtgatccaggacatgctggtgcccctgtacaaggttggagacgccctcgagttcgtccaccacgaaatggaggtgtacccgttgtggctgtgccctcaccggctgttcaagctgccggtgaagacgatgatctacccggagccggggttcgagcaccagcagcggcagggggacacgagctacgcgcagatgttcacggacgtgggggtgtactacacgccggcgtgcatcttccgcggggaggagttcgacggggcggagtcggtgaagcggctggagcagtggctgatcgagaaccacagctaccagccgcagtacgcggtgacggagctgaa

SEQ ID NO: 2497 - DNA, 311 bp, Zea mays
  Clone ID: PAT_MRT4577_68431C.1
ctagccgtcgccgccgccgctcgtttccctgagaggtgccggaaccgaggaactggccgtgtgcgaggtagagaatcggttgttcttgtctcagcccggggtctgctgcgtctggtggaggtgaaggggagaaactcgtgagatctgtcccggatcacgcgtgcttgctcgtgaatcaggggtcccacacatatcttcggctattagaatgtggtgtactaatggagtctaagggtggcaaaaagtctagcagtcgtcattctatgcttgttgaagctccacttggctacagattcgatgtctttcgacct

SEQ ID NO: 2498 - DNA, 806 bp, Zea mays
  Clone ID: PAT_MRT4577_68483C.1
cctcgaggccggccgggccggcaaggcaccaaagcatcagatttgtgcttgaaactcctcctcctcctcctcctccaccaccacctcgccttctcttctttttgtcttgcgtcgcagcatggtgaggaaccccctaaaagccaggccgacgctggtgctcatcagccttcttctaatggcggacctggcaaccgttggctatagccgaagagttgcagaactgggtgcgttagccgtgagcgacagcggcggcggtggcggtggctcgccgccgggcaaaggctgctgcttgcccaaccagtcatcttcttcagcgtcagggcgacacctcggtgacgattgttgcaagcaaatgcgtattgtgtccaagaggctggtgccccaggggccaaaccctctgcacaactgaccagctccgggctccaggtctgcacttgcatgcatcgagagataggcagaggctttttcctttttgtaacgcagccatgcagagtgattagtggagctgcaggtcttcctcttccatgaggtcatgtaaattataggcctacagcttagtttgccgctagctcatacgctctctctgtcacacacttttgtcacttttgattgagagccgctcttcatcggtgacggtgagagactgaaactttgtaataatggatggtcgagggcaaaactcttgcataggctggaattctattttcctttatctagaaactgccttttgatgatgagaattttactgggacctgtggttctgaaaaaaaaaaaaaaaaagcccctaggccctcgagctcagcttt

SEQ ID NO: 2499 - DNA, 261 bp, Zea mays
  UNSURE (1)..(261): unsure at all n locations
  Clone ID: PAT_MRT4577_6864C.1
  unsure (1)..(261): unsure at all n locations
ggggcgcgcaccaagaacagggacaagtgggtgtcccagatgccccgcttctactacctgctggtgttggcggccaactggttctcccggccctccctcttctacgagcgggggcgcctcatctggtgcaatttctgtagccggcagtacagtgtgcccgacctgactctttactacttccaacgccntcgcgtggcgcgtggcgctttgcgccatcaaccacctgggagcgcctggcgaaggcgcgttatcgtgcgcatg

SEQ ID NO: 2500 - DNA, 856 bp, Zea mays
  Clone ID: PAT_MRT4577_69309C.1
gacgaatgcaacacctcggcttctacgactaggagtcgaagtcgactgacgactcacgactggcgtagcgtaggaggcggcggttccaagcgaccatccaataatcgccaccctcacgcgagaaatccccggtttcttaaggaactagacttacaaaagagttgtgtgaaacatcaagaccatcagtggattaattgttttcccaagtcttcaacatcactagaatgcttgaatttttcctgcttgactggggaggtgaatgctgttgcactggaggaacttgttgcaaggagtccaaatcttaaaagtttaaggctgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtgatgagggcttgaaggctgtgtccttttcttgtcctgatcttcaggagttgagggtatatccaagtgttgttgcaccaagaggtactgtgacgggaggaagggttggtagccctatcttcgtgtcgaagttacagcatgtgctcttctcttgtgttcgaatgacaaacacggcgctgatgacaatagcaaggtactgcccacggc

SEQ ID NO: 2501 - DNA, 2848 bp, Zea mays
  UNSURE (1)..(2848): unsure at all n locations
  Clone ID: PAT_MRT4577_69310C.1
  unsure (1)..(2848): unsure at all n locations
tcgctcggcttctacggcgtaacgtaggaggcggcggttccaggcgaccatgcaataatcgccaccctcacgcgagaaatccccggagggattctttggctgaggttgccctcggattgttccaaaaacgaaaaagttagccctcttcctcaggtccaatttggcagcttttgctacacgatccattaactgctttccgatccgtagttctgagaagtttgccctcttcctcatggccaatttggcattttgtataaacacacacacctcgagccggcggagtagcacggcgcgcggcccgaccggtctcgctctcgcagtccctcgaccgctcgtcccggcagagcagtcgcagcacgatggtgaccaacgtggtggacctccggtcggacacggtcaccaagccgtccgacgccatgcgcgccgccatggccgcggccgacgtcgacgacgacgtcctgggcgctgaccccaccgcgcgccgcttcgaggcggagatggccgcgctcctgggcaaggaggcggcgctgttcgtgccctcgggcaccatggccaacctcgtctccgtcctcgcgcactgcgacgtcctcggcagtgaggtcctcggagacgcctcccacatccacgtctactagccattgatccggggaaagagagacgtaacgtaacaacctcggcttctacggcgtagcgtaggaggcggcggttccaggcgaccatccaataatcgccaccctcacgcgagaaatccccggcaacttttggggaactacacgtgtatggagttttattagtattccaggggcatcacaatggcatactttcctgatgaagtagtagggtatatccttggttatgtaacgtcgcatcaggaccgcaacgcggtgtccttggtctgccgggcatggtacgacattgagcgtcatggccgccattcggtgcttgtaagaaactgttatgcggtgtgcccagagcgtgtacatatgcggtttcccaacatgcgtgcactgagcttgaagggcaaaccgcactttgctgaattcaaccttgtcccggcgggttggggtgccactgcaaatccatgggtggatgcgtgcgcccgtgcatgcccaggtcttgaggagctccggctgaagtttatggttgtgactgatgaatgcctcaagttgctttctctatcctttaccaactttaaatcacttgtccttgtttgttgtgaggggttcagtactaccgggcttgctaatattgccaccaattgcaggtttcttaaggaactagacttacaaaagagttgtgtgaaacatcaagaccatcagtggattaattgttttcccaagtcttcaacatcactagaatgcttgaatttttcctgcttgactggggaggtgaatgctgttgcactggaggaacttgttgcaaggagtccaaatcttaaaagtttaaggctgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtgatgagggcttgaaggctgtgtccttttcttgtcctgatcttcaggagttgagggtatatccaagtgttgttgcaccaagaggtactgtgacggaggaagggttggtagccctatcttcgtgtcggaagttacagcgtgtgctcttctcttgtgttcgaatgacaaacacggcgctgatgacaatagcaaggtactgcccacggctaacgtccttcagactatgcattcgcaagcccaggtcagcagacgccgtcacaggacagccactggacgaaggctttggggcgatagtgcggtcctgcagaggcctgaggcgtcttgccatgtccggcctcctcacggacagcgtgttcctgtacatcggcatgtacgcggagaagctggagatgctctcggtaacgttcgcgggggacaccgacgacggcatggtctatgtgctcaatggctgcaggaacctcaagaagctggtaatcaaggagagccccttcggtgacgccgctctcctcgcgggcgcgcacaggtacgagtcaatgcgcagtctctggatgtcgtcctgccagatcaccctgggtggctgcaaggcccttgcggccaccatgccaaacatcaatgtcgaggtcatcggtggggcgagctttggtgcgatggatggtggtgtcagcggtgcgaggaaggtggacatgctctacctctaccgtactctggctggacctagatgcgatacgccaggattcgtctcgatattgtgagctgtatctatggctactgttggtggcgttcagggaaacccgatgttcttaaccgtgcctgctgtgggctgtggctgtgctactctgtctggtagtgtttcggaaacacgatgtttatttgcgtaaggtagtgtttggttctggaaccattttaagccttgttcagatattcctatacctcatggattggaagtgattagaaaaaaatatgaataattttgacttaaaaaaaaaaaaaagcccctcgagagctaaaaaaaaaaaaannaannnagggccgcccccggaatagtaactcgtcgacccaggaaaat

SEQ ID NO: 2502 - DNA, 2089 bp, Zea mays
  Clone ID: PAT_MRT4577_69311C.1
gtacgctacctcgaggccggccggagagagacgtaacgtaaaacctcggcttctacgactacccgtaggagtcgatgacgtcgactggcgtagcgtaggaggcggcggttccaggcgaccatccaataatcgccaccctcacgcgagaaatccccggcaacttttggggaactacacgtgtatggagttttattagtattccaggggcgtcacaatggcatactttcctgatgaagtagtagggtatatccttggttatgtaacgtcgcatcaggaccgcaacgcggtgtccttggtctgccgggcatggtacgacattgagcgtcatggccgccattcagtgcttgtaagaaactgttatgcggtgtgcccagagcgtgtacacatgcggtttcccaacatgcgtgcactgagcttgaagggcaaaccgcactttgctgaattcaaccttgtcccggcgggttggggtgccactgcaaatccatgggtggatgcgtgcgcccgtgcatgcccaggtcttgaggagctccggctgaagtttatggttgtgactgatgaatgcctcaagttgctttctctatcctttaccaactttaaatcacttgtccttgtttgttgtgaggggttcagtactaccgggcttgctaatattgccaccaattgcaggtttcttaaggaactagacttacaaaagagttgtgtgaaacatcaagaccatcagtggattaattgttttcccaagtcttcaacatcactagaatgcttgaatttttcctgcttgactggggaggtgaatgctgttgcactggaggaacttgttgcaaggagtccaaatcttaaaagtttaaggctgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtgatgagggcttgaaggctgtgtccttttcttgtcctgatcttcaggagttgagggtatatccaagtgttgttgcaccaagaggtactgtgacggaggaagggttggtagccctatcttcgtgtcggaagttacagcgtgtgctcttctcttgtgttcgaatgacaaacacggcgctgatgacaatagcaaggtactgcccacggctaacgtccttcagactatgcattcgcaagcccaggtcagcagacgccgtcacaggacagccactggacgaaggctttggggcgatagtgcggtcctgcagaggcctgaggcgtcttgccatgtccggcctcctcacggacagcgtgttcctgtacatcggcatgtacgcggagaagctggagatgctctcggtaacgttcgcgggggacaccgacgacggcatggtctatgtgctcaatggctgcaggaacctcaagaagctggtaatcaaggagagccccttcggtgacgccgctctcctcgcgggcgcgcacaggtacgagtcaatgcgcagtctctggatgtcgtcctgccagatcaccctgggtggctgcaaggcccttgcggccaccatgccaaacatcaatgtcgaggtcatcggtggggcgagctttggtgcgatggatggtggtgtcagcggtgcgaggaaggtggacatgctctacctctaccgtactctggctggacctagatgcgatacgccaggattcgtctcgatattgtgagctgtatctatggctactgttggtggcgttcagggaaacccgatgttcttaaccgtgcctgctgtgggctgtggctgtgctactctgtctggtagtgtttcggaaacacgatgtttatttgcgtaaggtagtgtttggttctggaaccatttt

SEQ ID NO: 2503 - DNA, 1423 bp, Zea mays
  Clone ID: PAT_MRT4577_69313C.1
tcctaatcccggtcgcgacgcgtcctaacggcgcaagccgaatccaccaacgccaaacgaccgcaccagccagtccacttcgccagtgatctgtctcagctcgtcgcgtctccggcgccgacagacacgggcgagtgggcaacgcggctccgagatcggcgggcaggatgatgatgctgatcgactgctcgaggtgccgtaccccgctgcagctgccgcacggggctccctgtatccgatgcgccatctgtggggctatcacgcacgtcgcccccgcccctcctgtcgagcccaaccgcggtgccgtacagccgccgccggggtggggtccaccgccgccgccggtgcacgggcgaaagcgagccgtggtgtgcgggatatcgtatcggcactcgcggtatgagctgaagggctgcatcaacgacgtcaagtgcatgcgccacctcctcatgacgcgcttcaacttccccgacgactccatcattatgctcaacgaagaacaaaccgacccctacaaaatcccaacaaagcataacatagggatggccatgtattggcttgtgcaaggttgtcaacctggagactcattggtgttccattattctgggcatggagcacagcaaagaaactacaatggagatgaggttgatgggtttgatgaaaccctctgcccattggattttgagacacaaggaatgattgtggatgatgacataaatacagcactagttcgaccacttcctcgtggagttaaacttcatgcattcattgatgcttgtcatagtggaactgcacttgatttgccttacctctgcagaatgaacaggagtgggcaatatgtatgggaagatcaccgaccaccatctggtgtctggaaaggcactagtggtggggaggctatttcatttagtggttgtgatgatgatcagacctctgcagatacctctgctttatcaaaggtcacttcgactggtgcaatgacatttggcttcatccaagctattgaacgtggacagggcaccacctacggtagtatcctgaactccatgcgttcgacaatacgcaacacagatgactcagcaggtgtaggtggcggtgctgttacatcactaattacaatgcttcttactggagggagcctatctgctggtggtctgagacaggagccacaactgacggcatgcgagccatttgatgtctatgcgaagcccttctccctatgacgcgttcatggtgctgctgctgcccacccatttcacgttatcaacttatcatcgtgtacatttcaccatcccgattgttaacagcgcgtggaattacaatccgtataaggaagctatgcatatatatcgtttgtttcacaggtacaatccgtatatgcatgaataattttttgtacaaaaaaaaaaaaaaaaaagcggcc

SEQ ID NO: 2504 - DNA, 289 bp, Zea mays
  Clone ID: PAT_MRT4577_69357C.1
tcgccccacgaactggagaccttgcccgcccaatacgaacacctcagatctcagtgaccatcgccgatgcttcctttgtgtagctgcgcgatgaggatatggcgtctagcgagggcgtgctcctggggatgggcctccccctcctcgacatctcctccgttgtccatgacgccttcctagcaacagtatgacatcatacctgaacaatgccattctcgctgatgacatccactcgcctatgtatgacgattcgaccagcatcagcaatgttgcttatatcgtcgctgga

SEQ ID NO: 2505 - DNA, 176 bp, Zea mays
  Clone ID: PAT_MRT4577_69475C.1
gatagaccttctcaatacaatggaccgtgcttcatccaacaatggaacggcttcacatggtgccgtgtccatcacaaaaaaggagcctatattcatgtactagaattattcagattcagttcacattgtgatgtgttatttttactttcgtcgtgctataaccgatagcgctcttc

SEQ ID NO: 2506 - DNA, 191 bp, Zea mays
  Clone ID: PAT_MRT4577_69499C.1
cccacgcgtccgatcgagatggcggcgtcggatagttgagtaccgctgcttcgagggcggcctcgcctgtgccacggactaccactccctccacatcgccttgagcacctacgagcgagggcgtaaagttcaagatcatggtacatggggagacgcaaaggtcccgcggattctgcttcgtcaccttctcc

SEQ ID NO: 2507 - DNA, 1098 bp, Zea mays
  Clone ID: PAT_MRT4577_69510C.1
acctggatctgagacaggcaggcagcaggccttcatcgcagagaggacagcagcacctgagattgacggcggggcagcgcgcgggcccttcccttcggagcactcagcgtgagagatggggaggcagccgtgctgcgacaaggttggcgtgaagaagggcccgtggacggcggaggaggaccagaagctcgtcggcttcctcctcacccacggtcactgctgctggcgcgtcgtccccaagctcgcagggttgctgaggtgcgggaagagctgcaggctgcggtggaccaactacctgaggccggacctcaagaggggcctgctctccgacgacgaggagaggctcgtcatcgacctgcacgcgcagctcgggaacaggtggtccaagatcgcggcgcagctaccgggcaggacggacaacgagatcaagaaccactggaacacacacatccgcaagaagctcgtccggatggggatcgaccccgtcacccacctgccgttgcaggaaccgccggctcctgctcctgctcccgccgagcagcaggagcagagccacaggcagcaagaagaactgcaactgcaagagctgcagaacggccgcgagcttatcatgcaggagggcgcgggggaagacgatatcacgccgatgatccagccgcacgagatcatgccgacggcggcagcggcaagcaactgcggctctgtttcctctgcccacgccggctccgcgtccgtggtctcgccgtcctgctcctcctcggcggtgtccggcgtggagtggccggagcccatgtacctgctcggcatggatggcatcatggacgccgactggggcagcctcttccccgacactggcgctggcggcggcggcggcggcttcgacttgggcgtcgatccgttcgaccagtacccgggcggtggcttcgaccaagaagacgaccacagaatatgacatcggcctagcaatgcacatagattcgccgcttctccttccatctcgctcagcacatcagcgccgtagcctccatgttttcttaatagctctccagggtccagtgctgataaacaagaactgacaaattcgggtgcggaaaaaaa

SEQ ID NO: 2508 - DNA, 410 bp, Zea mays
  Clone ID: PAT_MRT4577_69619C.1
acctaactaccaacatattgctcacaataatgtaccaacaatctcacgtagatattttgcctacttatgctcctctatctttctgcaattgctcctacagcaaccattttcccacaatactcacaagcttctatagctttccttcttcctacctacctctaaccaactgtgtcttctgtatgttaaaacccaattcttcaaccctacaccatccaacaatcaatcacagcttgcatcctacctttatcacccttgttcctccaacaatcatcatacctattacaacagttaccttttgtgcatttattggcacaaaacatcaaggcacaacaactacaacaacttttgctaaccaaccttgctacctactcttagcaacatcaatttctttcattcaaccaactaacttc

SEQ ID NO: 2509 - DNA, 617 bp, Zea mays
  Clone ID: PAT_MRT4577_69631C.1
gttcctctgttccggtctcccgtctcgctgtgcctcctcctgccctccgctcgcctagggttcgctcgctcgctcgtccccaggttcgctcgcgatggaccagggcgacgtcgccgtggccgtgccccccgccgccccctcctcctcctgcggcggcgccggctgcaagaagggcaagcgcttcgagatcaaaaagtggaacgccgtcgcgctctgggcctgggatattgtggtagacaactgcgccatctgccgtaaccacatcatggacctctgcatcgagtgccaggcgaaccaggccagcgccaccagcgaggagtgcaccgtcgcttggggagtttgcaaccatgcattccacttccactgcatcagccgttggctcaagacccgtcaagtgtgccctctagacaacagcgagtgggagttccagaagtatggtcactaagacagtcatggccaggggcgaagttacttaatggttgtttaactttagtgctattagtgataactcctggttaaggatagtggatggttggttgatgtttctggagcttggatttttattaaaccacatgtatccttgttgagtactgttcatcatgtctatggatctctct

SEQ ID NO: 2510 - DNA, 1121 bp, Zea mays
  Clone ID: PAT_MRT4577_69730C.1
ggtgtctcgatccgacttggtacttggcggctccactgctcacgtcacgtgccgcccgcgttctctctccgactcccatgcctctccggtgagctagtctggtatccatcggcgagctagttttgtctccaccggcgagcacgcgtctgtaacctcctccacccccatcgaactcctcctgctctccaatccgctagatctcggctccgtgcagctatgctgattgtgaggaatttggtagcacctctatcagggtttttaaactagagtgctgccgccccagcatacataatatggacgaagaaaatgttgttgagctgctgcaacgttatcgccgtgaccgtcaagtattactcaactacattctttctggcaacttgatcaagaaagttgcaatgccacctggtgcaatctctttggatgatgtagatatagatcaagttagtgttgattatgtcctcaactgtgctaagaaaggtgaacctcttgaccttggagacgccatccgcctttttcatgatagccttgactatccatatgtgaataacactggagctgtggatgagttctatttgcttacaaaaccagaatattcaggaccagctccaacacgagaaccaccacctatcccagccactgcaccatcatcagttgtggtaccaccaccggatgtggaaccagcaccaattattgtgtcatcgccagtcacagctaccaacttgccaaaatcacaaccatttgattctccgaccgagaaggagttaactatagatgacattgaagactttgaggatgatgaagatgaatttgatgggcgaagggcttctagaagacatcaaactgacgccagtgatctatcgttgctgttaccactatttgaaacaggtatcacagataatgatcttcgtgagacagcatatgagatccttgttgctgctgctggtgcttccgggggtcttatagttcctcagaaagaaaagaaaaaagagaagagacacagattgatgaggaaactcggtcgtagtaagagtgaaagtgtggatatcaacactcaacggcaacctggtttagttggtttgcttgaaaccatgcgagctcaacttgggattacagagtccatg

SEQ ID NO: 2511 - DNA, 1454 bp, Zea mays
  Clone ID: PAT_MRT4577_69830C.1
ggcagatgaatgaaggcgttgcctcgtatagacctatccaatgcaacgacggatatcaccgagtggcgaccgcctgacgcgcccgtgtcggcaagccgccgacgacttgacgtggggcgggggaaacaaaacaacgcgggcagcgccacggcaagcgcgtcccgggctccctgccacggcgcggacacagagagtggaaaccggaaggggggaagagagatggattcctccacctcggcggcggcggcaggggaggcggccgtgccgccggaggacgacgtctgctccgtctgccacgaccgcttccggatcccgtgccaggcgaactgctcccattggttctgtggagagtgcatcatccgcgtttggaattatggacctcctgtacaggcttgcaagtgtcccatttgtcgccgccttataaatctactggtgcctgctgcattatcagggcaggaggatggtccacaagctcaacgtattctaggagagattcagcactataactgtatatttggtggagcaccacgcagcctaactcagaggttgcaagacctacccttcttcatccgaagactgttcagagaactaatggacccccagcggaccctcccactcgtgttcagggcgcggatgctgatgatggtcgcactgagtgcaatttatgtgctgagccctgtcgacattcttcccgaaagcatgctgggcctctttggattcgtcgatgacctgctcatcctgctgatcgtgttcctccacctcgccgcggtgtaccggtcgttgctcctgtaccgccacgggggccagtagaagtcgctgtgcataaaccgtttgtttagctggtttccatgtggagttctctgagatcgcagcagcggatttggaagatcgccgactcgccgagtagatggcaacgtcacggacggcttagcctgtccctgctctgtaccattctactacgcctgtttttctgagactctgacacggtgaactgaactttggttggttgatgcaagtgaatttcccttcgttttactcgtcaggaaaagaaagggaaagagtttgcgttgcgtttgtctttgtttctgctctttggaagttggaattgaaactgcactgatgtttgcgtttcaggaactgcattgacgtggatcctgctcagttctcttagcatttacttatgggccaagtttgtagaagtttagtgggctgtagacccattggctgtcatgttgggccaccgcgacgaggaaagaagaggtaggggatcgccctggccgggtagttggctcttgcgggagggatgagatgggaatgggatggcgacgggcgggcgtgtgcggctgcaggcggctcggaaggggcacggtggagacgcagcggagccctcgcctcttctcctgctcctgctgcccggtactcgccgagggagacgctgctgacctgacgagctg

SEQ ID NO: 2512 - DNA, 1121 bp, Zea mays
  Clone ID: PAT_MRT4577_69852C.1
ggtccgcagaatccgagtccaatagctctcctccccagggctttcaacttctccaaaccccatctcgccgccgaggccgagcgagcagagcagaacaccacgtcggcggcttttccctgtctctccgctggatactacacccgccgccgcagcgccgatcctgtccgagtcaagcggagcgggggatcggattggttgcttccttccctccatctcatgttggtgcatcaacaaaatcttgaggagcaggagccattgtcttcaatttttgatggatcatctccagcctctgcaattgttgcagtagacacaaatctggatacttccacacctgacacatatcgagcgccgcctgcacccttgccttatgatgttattttggcagtcccaaataaccctggttttggaaactctgtaggtttggagaagccagacactaagagcaaaactgatgaccaacaagagtccataaatgatcaggagtctttagaggtggatgagtcatgtaagaaaagtgtcactgaagataaggctgatgaggaggatgtttgccctatctgccttgaagaatatgatgaagaaaatccccgttctataactaaatgcgagcatcatttccatctttgctgcattctcgaatggatggagcgaaaagatacttgcccagtttgtgaccagattactttggtggatgagatgttcgaataggtttggtaaccttggtggatcatcactcgaagctgttcgttactgagaaagtgcagcaactaatttacttttgatattgatccattccgggtggctcgcatggtaatgaattgagggggcaaaaattgaaaggatgaatgtcatgaaatgtatttacaacgcctcctttgtcatgcgttgtgtcatgctatatatatgccggcttgcgggttcattcagttcaaagtccaggactatccttttgcttttctgaattcagagtttcagacatctgctggttcttccaggttccggtcagctgtgtatatcatatattaggtggttgcaggtaaaaatggtctagagggtgggggttgctttgtacaatccacatggtatttaagcttcatgtatataatcttttctgtttctag

SEQ ID NO: 2513 - DNA, 1529 bp, Zea mays
  Clone ID: PAT_MRT4577_69855C.1
gggtacctcgacaccggccggggttccgcagaatccgagtccaatagctctcctccccagggctttcaacttctccaaaccccatctcgccgccgaggccgagcgagcagagcagaacaccacgtcggcggcttttccctgtctctccgctggatactacacccgccgccgcagcgccgatcctgtccgagtcaagcggagcgggggatcggattggttgcttccttccctccatctcatgttggtggactgagagatggagttttaatttcaaatagcatctagaggactgccactaagcttttaagttggtatataatgggtggctgttgttgctgttcgtcgagaacatctgaagcagttagagcacgagcaccagttgatatatatcatcaacaaaatcttgaggagcaggagccattgtcttcaatttttgatggatcatctccagcctctgcaattgttgcagtagacacaaatctggatacttccacacctgacacatatcgagcgccgcctgcacccttgccttatgatgttattttggcagtcccaaataaccctggttttggaaactctgtaggtttggagaagccagacactaagagcaaaactgatgaccaacaagagtccataaatgatcaggagtctttaaaggtggatgagtcatgtaagaaaagtgtcactgaagataaggctgatgaggaggatgtttgccctatctgccttgaagaatatgatgaagaaaatccccgttctataactaaatgcgagcatcatttccatctttgctgcattctcgaatggatggagcgaaaagatacttgcccagtttgtgaccagattactttggtggatgagatgttcgaataggtttggtaaccttggtggatcatcactcgaagctgttcgttactgagaaagtgcagcaactaatttacttttgatattgatccattccgggtggctcgcatggtaatgaattgagggggcaaaaattgaaaggatgaatgtcatgaaatgtatttacaacgcctcctttgtcatgcgttgtgtcatgctatatatatgccggcttgcgggttcattcagttcaaagtccaggactatgccatttcgcttttctgaattcagagtttcagacatctgctggttcttccaggtatccggtcagctttttacatggtatattaggtggttgcaggtaaaaatggtctagatggaggtgggggttgctttgtataatccacatggtatttaagcttcatgtatataatcttttctgtttctcttcgttttgttctgctgaatacttgcagatccttactgttctgataaaacttactgactcccaaatctgtgccagacaaaacgtgtttcaggaacataatacatctgatagcacttgttaaaacatcttcggggcctgctaaaatgttcacattatgttccggctatgaaaactcgcagttctctgcgatgctacgagtcgcagacattttctttttttatcagtgttgtaaagtagc

SEQ ID NO: 2514 - DNA, 384 bp, Zea mays
  UNSURE (1)..(384): unsure at all n locations
  Clone ID: PAT_MRT4577_6991C.1
  unsure (1)..(384): unsure at all n locations
tttcttatttctgggaagcccaaacatcggacaaaaaactttattattgaactatanctcataagaaatctaaaagaggacaccaccaatgatgggttgttggtngaacactgctgggtttgtcaaagcntgttggttgaatggcngcaattgttgcngttgtntgagggtgccagcgttnggcgcctcgtgctggttgaacggcttcttctgtggttgtgtcctgatggtcgcngggctcacaccagcttgctggctgantggtngtngttgttgctgctgtgctttgctggagagtctcttgctgctggttggttgattgtgtgaaattgctgggggttggctgctggttgctggctgactggtggttgttgttgttgcttg

SEQ ID NO: 2515 - DNA, 742 bp, Zea mays
  Clone ID: PAT_MRT4577_69980C.1
ccctcgaggctcgccgggaagaatacataccgagcgaaccgagaaaccaacacagcaacaagcaaagcagcgatccgacatccgagagatggacgcggtgatgttcgggctggagactcccctgatggcggcgctgcagcacctgctggacgtgcccgacggcgacaacaagacgggcggcggcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcatggagcggcggatgggcaagttcatgcgcaagttcgtgctgccggacaacgccgacgtcgacaaggtcgccgccgtgtgcagggacggcgtgctcacggtgaccgtcgagaagctgcccccgccggagcccaagaagcccaagaccatcgaggtcaaggtcgcctgagggagcaagcagtagcccgtgcttctgaaactgtgtgttttgtgtttgctttcctttgtgacgcaaagcagaatgccctgatgctttctccacagaataaatctctacatgtctcttgtaacctttctggtgaagatcgtgtcgcgatgaatctagaataaatatcgatccgacttacagttc

SEQ ID NO: 2516 - DNA, 788 bp, Zea mays
  Clone ID: PAT_MRT4577_69981C.1
cctcgagcgcacgggcaccatcacaaaaccattcacacagcgaaccgagaaaccaacacagcaacaagcaaagcagcgatccgacatccgagatatggatgcggtgatgttcgggctggagactcccctgatggcggcgctgcagcacctgctggacgtgcccgacggcgacgccggcgcgggcggcgacagcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcatggagcggcggatgggcaagttcatgcgcaagttcgtgctgccggacaacgccgacgtcgacaaggtcgccgccgtgtgcagggacggcgtgctcacggtgaccgtcgagaagctgcccccgccggagcccaagaagcccaagaccatcgaggtcaaggtggcctgagggagcaagcagtagcccgtgcttctgaaactttgtgtgttttgtgtttgcttcctttgtgacgcaaagcagaatgccctgatgctttctccatagaataaatctctgttcacctacatgtctcttgtaacattttctggtgaagatcgtgtcgcgatgaatctagaataatatcgatccgacttacaagttt

SEQ ID NO: 2517 - DNA, 701 bp, Zea mays
  Clone ID: PAT_MRT4577_69984C.1
cgaaccgataaaccaacacagcaacaagcaaagcagcgatccgacatccgagagatggacgcggtgatgttcgggctggagactcccctgatggcggcgctgcagcacctgctggacgtgcccgacggcgacgccggcgcgggcggcgacaacaagacgggcggcggcggcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcatggagcggcggatgggcaagttcatgcgcaagttcgtgctgccggacaacgccgacgtggacaaggtcgccgccgtttgcagggacggcgtgctcacggtgaccgtcgagaagctgcccccgccggagcccaagaagcccaagaccatcgaggtcaaggtcgcctgagggagcaagcagtagcccgtgcttctgaaactttgtgtgttttgtgtttgcttcctttgtgacgcaaagcagaatgccctgatgctttctccatagaataaatctctacatgtctcttgtaaccttttctggtgaacgtcgtgccgcgatgaatc

SEQ ID NO: 2518 - DNA, 823 bp, Zea mays
  UNSURE (1)..(823): unsure at all n locations
  Clone ID: PAT_MRT4577_69985C.1
  unsure (1)..(823): unsure at all n locations
agacccaagaatcacatcacaattcacacagcgaaccgagaaaccaacacagcaacaagcaaagcagcgatccgacatccgagatatggatgcggtgatgttcgggctggagactcccctgatggcggcgctgcagcacctgctggacgtgcccgacggcgacgccggcgcgggcggcgacagcgacaacaagacgggcggcggcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgccaagtacctgcgcatggagcggcggatgggcaagttcatgcgcaagttcgtgctgccgaccaacgccgacgtcgacagggtcgccgccgtttgcagggacggcgtgctcacggtgaccgtcgagaagctgcccccgccggagcccaagaagcccaggaccatcgaggtcaaggtcgcctgagggagcaagcagtagctgtgcttctgaaactttggtggtgtttgtgtttgcttcctttggtatcaccaatcatcctatnctgatatatcggactgggggtttnntcgctgnngtttgaagctnttgtgacgcanagctgaatggccctggatgctgtctccatagaataaatctctacatgtctcttgtaacttttctggtgagaaatcgtgtcgcgatcaatcattaagggattttttttccatt

SEQ ID NO: 2519 - DNA, 1039 bp, Zea mays
  Clone ID: PAT_MRT4577_69986C.1
cggcggcgtgcagaggcgccgttgctagcttggattctgacttagaggcgttcagtcataatccggcacacggtagcttcgcgccactggcttttcaaccaagcgcgatgaccaattgtgtgaatcaacggttcctctcgtactagccacgagtccgcccacgcgtccgatcacaattcacacagcgaaccgagaaaccaacacagcaacaagcaaagcagcgatccgacatccgagagatggacgcggtgatgttcgggctggagactcccctgatggcggcgctgcagcacctgctggacgtgcccgacggcgacgccggcgcgggcggcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcatggagcggcggatgggcaagttcatgcgcaagttcgtgctgccggacaacgccgacgtcgacaaggtcgccgccgtgtgcagggacggcgtgctcacggtgaccgttgagaagctgcccccgccggagcccaagaagcccaagaccatcgaggtcaaggtcgcctgagggagcaagcagtagctgtgcttctgaaactttgtgtgtttgtgtttgcttcctttggtatcaccaatcatcctatctgatatatcgactggggttttcgctgggtttgaagctttgtgacgcaaagctgaatgccctgatgctgtctccatagaataaatctctacatgtctcttgtaaccttttctagtgaagatcgtgtcgccatgaatctatggtaccgtttgtttccttttaaaaaaaaaaaatggaattagtaatagagtactattttttagcaaaaaaaaaaaaaaaaaaggccccta

SEQ ID NO: 2520 - DNA, 824 bp, Zea mays
  Clone ID: PAT_MRT4577_69987C.1
cctcgaggccggccgggacaccaagaatacatcacacagcgaaccgagaaaccaacacagcaacaagcaaagcagcgatccgacatccgagagatggacgcggtgatgttcgggctggagactcccctgatggcggcgctgcagcacctgctggacgtgcccgacggcgacgccggcgcgggcggcgacaacaagacgggcagcggcggcagcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcatggagcggcggatgggcaagttcatgcgcaagttcgtgctgccggacaacgccgacgtcgacaaggtcgccgccgtgtgcagggacggcgtgctcacggtgaccgtcgagaagctgcccccgccggagcccaagaagcccaagaccatcgaggtcaaggtcgcctgagggagcaagcagtagctgtgcttctgaaactttgtgtgtttgtgtttgcttccttctttggtatcaccaatcatcctatctgatatatcgactggggtttttgctgtctccatagaataaatctctacatgtctcttgtaaccttttctggtgaagatcgtgtcgcgatgaatctataagttaccgtttgttttcttttaaaaaacaaaacaaacgataggaggaggggggggggg

SEQ ID NO: 2521 - DNA, 917 bp, Zea mays
  Clone ID: PAT_MRT4577_69988C.1
acagagcccgaacgcgggacgcctacgcctcgccgcgcccggggccccgcacactccacagcctttcagaaccttccgtcgccttccagaagaacagaagcccacccgtcaccaccaatataaactgcccctccagatcggcactccgcacaccaagaatcacatcacacagcgaaccgagaaaccaacacaacaagcaaagcagcgatccgacatccgagagatggacgcggtgatgttcgggctggagactcccctgatggcggcgctgcagcacctgctggacgtgcccgacggcgacgccggcgcgggcggcgacagcgacaacaagacgggcggcggcgccacgcgcacctacgtccgcgacgcgcgcgccatggcggccaccccggccgacgtgaaggagctgcccggcgcgtacgcgttcgtggtggacatgccggggctgggcacgggcgacatccgggtgcaggtggaggacgagcgggtgctggtggtcagcggcgagcggcgccgggaggagcgcgaggacgacgccaagtacctgcgcatggagcggcggatgggcaagttcatgcgcaagttcgtgctgccggacaacgccgacgtcgacaaggtcgccgccgtgtgcagggacggcgtgctcacggtgaccgtcgagaagctgcccccgccggagcccaagaagcccaagaccatcgaggtcaaggtcgcctgagggagcaagcagtagctgtgcttctgaaactttgtgtgtttgtgtttgcttccttctttggtatcaccaatcatcctatctgatatatcgactggggtttttgctgtctccatagaataaatctctacatgtctcttgtaaccttttctggtgatgatcgtgtcgcgatgaatctataagttaccgtttgttttcttgc

SEQ ID NO: 2522 - DNA, 373 bp, Zea mays
  Clone ID: PAT_MRT4577_70077C.1
cccacgcgttcggaggtgggttggcttctcctccccctgcggttggggtacggtgtcgtgaggttttccggggttcgggttcgtgggtgagcggatcgagatcgcggcgtcagatgttgaggaccgctgattggtctgtggtctcgcctgggccacggacgaccactccctccacaacgccttcagcacctacggcgaggttctacagttcatgatcatccttggtcgggagacgcagaggttccgcggttttagcttcgccacctttttcacgggggaggcgatgcggaacgccatctagggcatgaacgggctggagcttgacagccgcaacatctccgtgaacgaggcccattcccgcggcggacgctga

SEQ ID NO: 2523 - DNA, 1250 bp, Zea mays
  Clone ID: PAT_MRT4577_70092C.1
tctctttggctatatgctgaatcgtcatgtgctgctcttgttgtggcctcgatctcgtcttttggaatcaaccatcaatttactccaatggtgtatccccttcttgtcagctctgttggtattatagcatgtctcataacaacgttgtttgcaactgatttcttcgagataaaggctgcgaatgaaatagagcctgctctcaagaaacaacttataatatccactgttgtgatgaccattggcattgcgctcatcagttggcttggtcttccatacaccttcaccatttataactttggagcccagaagacagtgcaaagctggcaattgttcttgtgtgtggcggttggtctctgggctggcttagtcattggttttattactgagtactacacaagcaatgcctacagccctgtacaagatgttgctgattcctgcagaactggagctgccactaatgtcatttttgggcttgctctgggttacaaatcagtcattatcccaatttttgctattgcgtttagtatcttccttagcttcagccttgctgccatgtatggtgttgctgtggctgctcttggaatgctgagtaccattgccacaggccttgctattgatgcctatggccctatcagtgataatgctggaggcatagctgaaatggctgggatgagccataggattcgtgagagaactgatgctctagatgctgcaggaaacaccactgctgcaattggaaagggttttgctattggctctgcagccttggtatcccttgcactcttcggtgcctttgtaagccgggctgctatctccactgttgacgttctgactcctaaagtattcattgggcttattgttggtgctatgctcccatactggttctcggcaatgacaatgaaaagtgtaggcagtgctgcactcaagatggtggaggaagtccgccggcagttcaacaccatccctgggctcatggagggcaccacaaagcctgactacgcaacctgtgtcaagatctcaacagatgcatccatcaaggagatgatccccccaggtgctcttgttatgccgacaccactgatcgttgggattttgtttggggttgagaccctcgctggggtccttgctggtgcccttgtctctggtgttcagattgccatttctgcatccaacactggtggtgcctgggacaacgccaagaagtacattgaggctggagcttcagagcatgccaggacccttggcccaaa

SEQ ID NO: 2524 - DNA, 3688 bp, Zea mays
  UNSURE (1)..(3688): unsure at all n locations
  Clone ID: PAT_MRT4577_70096C.1
  unsure (1)..(3688): unsure at all n locations
aatacaatcatgaaccatcttttattcatatgagaaaaaaatgtaacataagtgattcactgatatataaatgagggatgattctcctttatcaacttatagatgttaatgatgaatagacagagatatactccttggtaacttgtgagatttttgggagtagcttttacgactaggcataagtatctaactatttaagctagacaagtagatatttgttactctaatgcactggttaagattctcttcttaaattgataccaacatctccttaagcttacatacatgtgtttctaaccaatgcagggagtgttttgggaatggaaaactggatccgtatcactttcgccattgattcatcttctcttcttgatggtcttgagaggctgaaatctttctgccaaaggcataagaagaagaatttgcttaatggccattaactatattcgacttcaaagttgttacccacttccatcgttttccactgtatcatcaacaaaagtgtaacattgaaatccctcagaagtaataaagttaatgtttacattatgaggatatgcatgtcagtgtacatttttagtcaccttaatcctctgttttgaaatctttcgattttgcatttgtttcagttttccattacaatgttcttttcttttaatttgacatcacttataagtgtggtgatggtgacacctgttccaatgtactaaaggttacaattggggacaaattattatgtagtatgtcggttgtgaagtttgaagacagccgaaagttcaaaaaaaaaaaaaaaaaaaaaaaaaaaaaaaaaaaaaaaaaaaaaaaaaaaaaatcctcccttccctcccgtaccgtatcagtctcccggattctctccggttcgtgggagggccaaagcttcgagttaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttggattattcatgggcatctttgcaatccttatattcctcttccttgggtctgtcgagggattcagcacgaagagtcaaccttgccactatatcaaggaccagacttgcaagcctgcccttgctaatgccatcttcagtactatagcttttgtgcttggtgcagtcacctcactagtttccggctttcttggaatgaagatcgcaacttatgcgaatgcccggacaactttagaggccagaaagggtgtcggaaaggcatttattactgccttccgagctggtgcagtaatgggcttcctgcttgctgccagcggtcttttggttctttacattgctatcaatttgtttggaatttattacggtgatgactgggaaggtctttttgaagctattactggttatggccttggtggttcttctatggctcttttcggccgcgttggtggtggtatttataccaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttgttactgagtactacacaagcaatgcctacagccctgtacaagatgttgctgattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatcaaggagatgatccccccaggtgctcttgttatgctcacaccactgatcgttgggattctatttggggttgagaccctctctggagtccttgctggtgcccttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttttcttgcagcaatcaatatggactttgcttaaaatttcgttgtcttttcaaaacgatatgcaagcaaaatggaagtgatgttctttgaaactttgtttcaatgctatagcaaangtttgcattttacaaaaaaaaaaaaaaaaaa

SEQ ID NO: 2525 - DNA, 763 bp, Zea mays
  Clone ID: PAT_MRT4577_70099C.1
atcgccatattatttagacccactagcaacatataaagcacaatagtgtgccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattgttcaaccctacaggatccaacaggcaatcgcagctggcatcttacctttatcacccttgttcctgcaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttggcggtctaccagcacgctgcgcctaacgctggcaccctcttacaactggacaattggtggcattcacccaactggtgttgacaaacctagcaggtggtctaccaacaacccatctttggtgggtgcccctctttaga

SEQ ID NO: 2526 - DNA, 602 bp, Zea mays
  Clone ID: PAT_MRT4577_70100C.1
ctcggggatcacatgctaatatagctgcttgtctttcaccatacctatgaccagcgagcgtattcagaatgcgaaagcccaattcttcaatccctataggatccaacaggcagcctcaggtggcatcatacctttatcacccttgttcctccaacagtcatcagccctattacagcagttacctttggtgcatttattggcacaaaacatcagggcacaacaactacaacaacttgtgctagcaaaccttgctgcctactctcagcaacaacagtttcttccattcaaccaactagctgcatcgaactctgcttcttatttgcaacaacaacaactaccattcagccagctatctgctgcctacccccagcaatttcttccattcaaccaactgacagctttgaactctcctgcttatttacagcagcaacagctactaccattcagccagctagctggtgtgagccctgctaccttcttgacacaaccacaattgttgccgttctaccagcacgctgcgcctaacgctggcaccctcttacaactgcaacaattgctgccattcaaccaacttgctttgacaaaccccacagcattctacc

SEQ ID NO: 2527 - DNA, 692 bp, Zea mays
  UNSURE (1)..(692): unsure at all n locations
  Clone ID: PAT_MRT4577_70102C.1
  unsure (1)..(692): unsure at all n locations
ccatcataggccaatcactagccaacaatgagcacnaaaaatatttcggattcttgtgctccttgcccttcttgcatgtgctgctacggtggccattgtgccacaatgctcacaaggttctatagctacccttcttnccccgtacctctcaccaacggtgtcttcggtatgcgaaaacccaatttttcaaacctacaggaaccaacaggcaaacgcaggtgacattttacctttatcacccttgatgctccaacaatcatcagccctataacagcagttacctttggtgcatttattgacacaaaacatcagggcacaacaactacaacaacttgtgctagcaaaccttgctgcctactctcaacaacagcagtttcttccattcaaccaactagctgcattgaactctgcttcttatttgcaacaacaacaactaccattcagccagctatctgctgcctacccccagcaatttcttccattcaaccaactgacagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctggcattcaaccaacttgctttgacaaacccagcag

SEQ ID NO: 2528 - DNA, 718 bp, Zea mays
  Clone ID: PAT_MRT4577_70103C.1
cccatattcattgtgaccaacatagcaacatagatagcacaacagtgtaccaacaatgggagctaaaacattttgcctgcttatgctccttggtctttctgcaagtactgctacggcgtccattttgccacaatgctaacaagctcctatagctaccctcttttccccgtacctgtcaccaacggtgccttcggtatgtgaaaacccaattcttcaaccctacaggatccaacaggcaatcgcagctgccatcttacctttaacacccttgttcctccaacaatgatcagccctattacaatagttacctttggtgcatttattggcacaaaacatcaggccacaacaactacaacaacttgtgctagcaaaccttgctgcctactctcagcaacagcagtttcttccattcaaccaactagctgcattgaactctgctacttatttgcaacaacaacaactaccattcagccagctatctgctgtctacccccagcaatttcttccattcaaccaactgacagcattgaactctactgcttatttacagtaacaacaactactaccattcaaccagctagctggtgtgagccctgctaccttcttgacacaaccacaggtgcttgacgtactaccagcacgctgtacctaacgctggcaccctcttacaactgacacaattggtgccattcaaccaatttgatttgacaaacccagc

SEQ ID NO: 2529 - DNA, 676 bp, Zea mays
  Clone ID: PAT_MRT4577_70107C.1
cgggacatatattgagacacactagcaccatacaaagcacattagaagcaccaacaactggccagcctgaatagttctgcctccttatgctccttggtctttctgcacgtgctgctgcggcgaccatgctcccgaaatgctcacaggctcctatagcttcccttcttcccccgccctatcccagcggggccttcggtatgagaaaacccaattcttcaaccctacaggatccaacaggccatcgcagttggcactctacctttatcacccttgttcctccaacaatcatcaaccctattacagcagacaccttaggtgcatttattggcacagaacatcagggcacagcaactacaacaacttgcgctagcgaaccttgctggctactctccacaacagcagtgtcttccattcaaccaactagctgcattgaactctgcttattattggcaacaacaacaactaccattcagccagctacctgttgactacccccatcagttgcttccattcaaccaactggcagcattgaactctcctgcttattgacaggagcagcaactactaccattcaatcagctagctggagtgagccctgctaccttcttgacacaaccacagttgttgccgttctaccagcacgctgcgcctaacgctggcaccctcttacaactgc

SEQ ID NO: 2530 - DNA, 435 bp, Zea mays
  Clone ID: PAT_MRT4577_70109C.1
ctgactcgttttctgactctttgttctacactttttctgactcgttgtcagcggcgtcttcaatgttgtaaaacccaattgttcaaccctacatgatccaacatgcaatcgcaacatgcatcttaccattatcacccttgttcctccaacaaccgtcatccctattacatcatttacctttggtccatttgttggcacataacatcattgcacaacatcttcaacaacttgtgctagcaaaccttgctgcatactctcaacaacatcagtttcttccattcaaccaacctggcttcatagaactctgctgcttatttgcaacaacaattaccattcatccagctagttgcttcctacccccactaattctttcattcaaccaactaacaacattgaactctgctgcttatttacagcagcaacaacttctaccat

SEQ ID NO: 2531 - DNA, 530 bp, Zea mays
  Clone ID: PAT_MRT4577_70114C.1
ggccgcttttttttttttttttttggaaatgtactttcttatttctgggaagccacaaacatcagacaaaaaactttattattgaactataactcataagaaatctaaaagagggcaccaccaatgatgggttgttggtagaacgctgctgggcttgtcaaagcaagttggttgaatggcagcaattgttgcagatgtaagagggtgccagcgttaggcgcagcgtgctggtagaacggcaacaactgtggttgcatcaagaaggtagcagggctcacaccagctagctggctgaatggtagtaggtgctgctgctgcaaataagcaggagagttcaatgctgacagatggttgaatggaagatattgctgctggtaggcaaaacgtagctggctgaatggtaagacttgttgtagcgcataataagcagagttcaaggcatctagtaaagtgaatggaagagactgctgacgctgaaagtaatgaccaagcaccgttagaacaagctgtcgtacttgtggtgcaaggac

SEQ ID NO: 2532 - DNA, 552 bp, Zea mays
  Clone ID: PAT_MRT4577_70133C.1
actttcttatttctgggaagccacaaacatcagacaaaaaactttattattgaactataactcataacaaatctaaaagagggcaccaccaatgatgggctgttggtagaacgctgctgggtttgtcaaagcaagttggttgaatggcagcaattgttgcagatgtaagagggtgccagcggtaggcgcatcgtgctggtagaacggcaacaactgtggttgtatccagaaagtaacaaggctcacaccagctatctggctgactggtagtagctgatgctgctgtaaataagcatgagagttcaatgctgccagttggttgaatggaagaaattgctgggggtaggcatcaggtagctggctgaatggtagcatgacgctggtgcaaataacaagcatagttcaatgcagctcgttggttgaatggaagaaactgctgatgctgaaagtaggcagcaaggtttgctagcacaagttgttgtaagcctggtgtgcactgatgttatgtgccaataaatgcaccaaacgttactgatgtaatagggccgatga

SEQ ID NO: 2533 - DNA, 435 bp, Zea mays
  Clone ID: PAT_MRT4577_70137C.1
tctcttattaatgggaagccacaaacatgaaaaaaaaaactttattacttgaactataactcactaacaaatataaaaggagggcaccaccaatgaaggcttgttggtagaacactgatgagtttgacaaagcaagttgcctgaatggcatcaattgttgcagatgaaagagggtgccaacgttaggcgcaacgtgctggtagaacggcaacaactgtggttgtgtcaagaaggtagcagggctcacaccagctagctggctgaatggtagtagttgttgctgctgtaaataagcaggagagttcaatgctgctagttggttgaatggaagaaattgctgctggtaggcagcaggtagctggctgaatggtagttattgttgatgcaaataacaagcagacatcaatgaacctagctggttgaatggaagaaact

SEQ ID NO: 2534 - DNA, 754 bp, Zea mays
  UNSURE (1)..(754): unsure at all n locations
  Clone ID: PAT_MRT4577_70138C.1
  unsure (1)..(754): unsure at all n locations
ggtaccctccgggtcggccgggnatccacatattattaagaccaactagcaacatagaaagcacaatagtgtaccaacaatggcagccaaaatattttgcttccttatgctccttggtctttctgcaagtgctgctaccgcgaccattttcccgcaatgctcacaagctcctatagcttcccttcttcccccatacctctcatcagcggtgtcttcagtatgtgaaaacccaattcttcaaccctacaggatccaacaggcaatcgcagcaggcatattacctttatcacccttgctcctccaacaaccgtcattcctactacagcagccacctttgcagcatttggtgccacacaacatgacgccacaacaactacaacaactggtgctagaccaccttgccgactactatcaacagcagcagcttccatcataccaacaaccggcagtgaacaacgctgctgattagcaacaacaacaactaccattcagccagctatctgctgcctacccccagcaatttcttccattcaaccaactgacagcattgaactctgctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctggcattcaaccaacttgctttgacaaacccagcagcattctaccaacaa

SEQ ID NO: 2535 - DNA, 467 bp, Zea mays
  Clone ID: PAT_MRT4577_70140C.1
catctagcatcataaaaagcacaatattagttccagcaatggccgctaaaatatcatgcctccttatgctccttggtcttcctgcaagagctgctacggcgaccatcatcccacattgctcacaagctgatatagcttgccttcttccaacgtacctctcaccaacggtgtcttctgtatgtgaaaacacaatgcttcaaccctacaggatccaacatgcaataacagctggcatcttacctttatcaccattgttcctccaacaatacatcagccctattacaacaggtacctttggtgcatttattgacacaaaacatcagggcacaacaactactacaactatgtgctaacataccttgctgcctactctcagcaacagcagttacttccattcaaccaactagctgcattgaactctgcttcttatttgcaacaacaacaactaccattcatccagctatctg

SEQ ID NO: 2536 - DNA, 623 bp, Zea mays
  Clone ID: PAT_MRT4577_70141C.1
ttgagcggccgcccgtacaggtactttcttatttctgggaagccacaaacatcagacaaaaactttattattgaactgtaactcataagaaatctaaaagagggcaccaccaatgatgggttgttggtataacactgctgggtttgtacaaagcaagtcggactgaatggcaacaattgttgcatttgtaagagggtgccagcgttaggcgcagcgtgctggtataacggaaacaactgtggttgtgtcaagaaggcagcagggctcacaccagctacctggctaaatggtagtagatgttgctgctgtaaataagcaggagagttcaatgctgccagttggttgaatggaagaaactgctgcgggtatgcagcaactagctggatgaatggtaattgatgatgttgcaaataagaagcagagttcaatgcaactagttggttgaatggaagaaactgatgttgctgagagtacgcagcaaggtttgctatcacaagttgttgcacttgttgagccctgatgatatgtgccaataaatgcaccaaacgtaactgctgtaatatggctgatgactgttggacgaacataggtgataaatgtaagatgccagctgcgattgcctg

SEQ ID NO: 2537 - DNA, 622 bp, Zea mays
  UNSURE (1)..(622): unsure at all n locations
  Clone ID: PAT_MRT4577_70142C.1
  unsure (1)..(622): unsure at all n locations
gggtaccntccgngggctcggcccgggccgggnaaaaaaaaaaaaaaaaaaaaaaaaaaaaaaaaaaaaaaaaaaaaaaaaaaaaaaaaaaaaaaaaaaaaaaaaatcacacattttattaagaccaactagcaacatagaaggcacaatagggtcccaacaagggcagccaaaatatttggcttccttaggctcctgggtctttttgaaagggctgctaccgggaccattttcccgaaaggctaacaagctcctatagcttccttttttcccccatacctttaataaggggggttttaagtatgggaaaacccaatttttaaaccttacaggatccaacaggcaatcgcagcaggcatcttacctttatcacccttgttcctccaacaaccgtcatccctattacagaagttacctttggggcatttgtgggcacaaaacataagggcacaacaactacaacaacttgggctagcaaaccttgctgcctacttttagaaacagcagttttttccattcaaccaactggctgcattgacctctgctgcttatttgcaacaacaactaccattcagccagttagttgttgcctacccccagcaattacttccattcaaccaac

SEQ ID NO: 2538 - DNA, 386 bp, Zea mays
  Clone ID: PAT_MRT4577_70145C.1
gtcgcccgtacaggtactaacattggttttcaaaatattttgccttcttatgcggggtggtctttctgcaagtgctgctacggcaaccattatcccgcaatgctcacaagctcctatagcttcccttcttcccccatacctctcaccagtggtgtcttcggtatgttgaaaacccaattcttcaatcccacaagatccaacaaggcaatcgcagctggcatattacctttatcaccctagttcctccaacaatcataagtcctattacagcagatacctttggtgcatttattggcacataacattatggctcaacatcttcaacatcttgtgctagcaaaccttgctgcctactctcagaaacataagtatcttccattcaacca

SEQ ID NO: 2539 - DNA, 533 bp, Zea mays
  UNSURE (1)..(533): unsure at all n locations
  Clone ID: PAT_MRT4577_70162C.1
  unsure (1)..(533): unsure at all n locations
ccgcacagtagtgtaccaacaatggcagccaaaatattgtgcctccttatgctccttggtctttctgcaagngctgttacggcgaccattttcccgcaatgctcgcaagctcctatagctntctttttttctgcgtacctatcaccagccgtgtcttgggtgtgtgaaaacccaattcttcagccctacaggatccaacaggcaatnacagctggcatctgacctttatcacctttgttnctccatcaatcatgagccctattacatcagttacctttggtgcatttattggcncaaaacattagggcacaacaactacaacaacttgtgctagcaaaccttgctgnctactttcagcaacagnagtttnttctctncaaccaactagctgcnntgaactctgcttcttatttgcagcaacaacaactaccattaagccagntacctgctgcctacccccagnaatttcttccattataccaactgnnagcatgnaactcttctgcttatntacagcatcaacaactactacc

SEQ ID NO: 2540 - DNA, 418 bp, Zea mays
  Clone ID: PAT_MRT4577_70166C.1
ctaaaaatgtactttcttatttctgggaagccacaaacatcacacaaaaaactttattattgaactataactcataagatatttaaatgagggcaccacccatgatgggttgttggtagaatgctgctgggtttgtacaaaacaagttgggtgaatggcaccaattgttgcaattgaaagagggagccatcgctaggcgcaccgtgctggtagaacggcaacaattgtggctgtgtcaagaaggtaacacggctcacaccagctagctggctgaatggtagtacctgatgctgctgtaaataaccaagatagttcaaagctgacagctggttgaatggaagaaattgctggcggtaggcagcagatagctggctgaatggtacctgctgcttgatgaaataacaagcatagttcattg

SEQ ID NO: 2541 - DNA, 422 bp, Zea mays
  UNSURE (1)..(422): unsure at all n locations
  Clone ID: PAT_MRT4577_70175C.1
  unsure (1)..(422): unsure at all n locations
gcctgcggtgccggtaccgaatcgcagtttcggcccaggcctacgagaccaactgggagacatacaaagcacatgtagtgtaccaacaatggcagccaaaatatttcgcttccttatgctccttggtctttctgcaagcgatgctaccgcaaccattttcccacaatgctcacaagctcctatagctttcctttttcccccatacctctcaccagcggtgtnttcagtgtgtgaaaacccaattgttcaaccctacaggatccaacaggcaatcgcaacaggcatcttaccattatcacccttgttcctccaacaaccgtcagccctaatacaagagttaccttgggtccattggggggcccaaaacttaagggaccaacacctccaacaactggggctagcaaaccttgctgttactttaa

SEQ ID NO: 2542 - DNA, 424 bp, Zea mays
  Clone ID: PAT_MRT4577_70190C.1
cccacgcgtgggttaacacaactagcaacatatcaaagccacaatgatgcgtcaccacacaatggcagccaaaatatctttgcctccttatgctccttggtatttactgcaagtgctgctacggcgaccattttcccgcaatgctcacaagctcctatagcttcccttcttcccccgtacctctcaccagcggcgtcttcggtatgtgaaaaacccaattcttcaaccctacaggatccaacaggcaatcgcaactggcatgttacctttatcacccttgttactccaacaatcatgaaccctattacagcatttaccttgggtgcattgattggcacaaaacatcagggcacaacaactacaacaacttgtgctatctaaccgtgctgcctactgtcagcatcaaaagtgacttccatttaac

SEQ ID NO: 2543 - DNA, 773 bp, Zea mays
  Clone ID: PAT_MRT4577_70195C.1
agaaatgtactttcttatttctgggaagccacaaacatcatccaaaaaacttcattattgaactataactcataagcaatctaaaagagggcaccaccaatgatgggttgttggtagaacgctgttgggtttgtcaaagcaagttggtcgaatggcagcaattgttgcagttgtaagacggtgccagcgttaggcgcagcgtgcaggtagaatggcaacaactgttgctgtgtcaagaaggcagcagggctcacatcagctagctggctgaatggtggtagctgttgctgttgtaaataagcagcagagttcaatgctgccagttgattgaatggaagaaattgctgggggtaggcagcagctagctggctgaatggtagttgttgttgcaaataagcagcagagttcaatgcagccagttggttgaatggaagaaactgatgttgctgagagtatgcagcaaggtttcctagcacaagttgttgtagttgttgtgccctaatgttttgtgccaacaaatgcaccaaaggtaactgttgtaatagggctgacggttgttggaggaacaagggtgataaaggtaagatgcctgctgcgattgcctgttggatcctgtagggttgaagaattgggttttcacacactgaagacactgctggtgagaggtatgggggaagaagggaagttataggagcttgtgagcattgcgggaaaatggtcgcggtagcagcacttgcagaaagaccaaggagcataaggaagcaaaatatttt

SEQ ID NO: 2544 - DNA, 357 bp, Zea mays
  Clone ID: PAT_MRT4577_70196C.1
tcggcacaatagtgtaccaacaatggcagctaaaatattttgcctccttatgctccttggtctttctgcaagtgctgctaccgcgaccattttcccacaatgctcacaagctcctatagcttcccttctttccccgtacctttcaccaacggggtcttcggtatgggaaaacccaattcttcaacccttcaggatccaaccggcaatcgcagcttgcattttacctttattacccttggtccttcaacaatcattaggcctattacagcaggtacctttggggcatttattggcacaaaacattaagggacaacaacttccacaacctgggcttgcaaaccctggttgcctacttta

SEQ ID NO: 2545 - DNA, 638 bp, Zea mays
  Clone ID: PAT_MRT4577_70202C.1
gcacgcctgcatgtaccgggctcctcttacacggtcgacctagtcgttcgattgataccaactagcacatattaaacacaataatgttccaacagtggctatcccaaatatttagcctacttatgctccctgccctttctggcagtgctgctacaacacaccatttttccgcaatgctcgcaagctcctatagcttaccttcttcccccgtacctgtcaccaacggtgtgttccatctgtcaaaaccaacttcttcaaccgtacatgatccaacaaggaatcacagctgacatcttaccttttcacactgtgttcctccaacagttattagacatattacaacaattaccttctgtgcatttattgacacaaaacattaggtcacaacaactacaacaacttgtgctagcaaaccttgctgcctactctcaacaacaacagtttcttacattcaaccaactaggttcattgaactctgcttcttatgtgcaacaacaacaactaccattcagccagctacctgctgcctacccccaccaatgtcttccattcaaccaactagcaacattgaactctcctgcttatttacagcagcaacaactactaccattcatacagctagcatgcgtgagccctgc

SEQ ID NO: 2546 - DNA, 826 bp, Zea mays
  Clone ID: PAT_MRT4577_70203C.1
acaccattatccggacctctagcagcatacaaagctcaatagtgggccagcagtggccggcaaaatatgcctgcctgcttatgctccttggtgctttctgcaagcgctggtacggggaccacttttcccacaactgctcacaagctcctatagcttccctaatgcccccgtacctctcaccagaggagcatagggtatgcgaaaacccaatgcttcagaccctataggatccaacaggcaggtcgcagctggcatcttacctttatgaccctcgttcctccatcaatcatcagccctattacagcagctacctttggtgcatttattggctcagaacatcagggcacgacaactacaagcaactcgtgctagcagaccttgctgcctactgtcaggaacaacagattcttccattgaaccaactagctgcattgaactctgcttcttatttgcagcaacaacaactaccattcagccagctacctgctgcctacccccagcaagtttcttccattcaaccaactggcagcattgaactctgctgcttatttacagcagcaacaactactaccattcagccagctagctggtgtgagccctgctaccttcttgatacaaccacaggtgttgccggtctaccagcacgctgcgcctaacgctggcaccctcttacaactgcaacaattgctgccattcaaccaacttgctttgacaaacccagcagcgttctaccaacaacccatcattgggtggtgccctcttttagatttcttatgagttatagctcaatcataaagttttttgtctgatgtttgtggcttcccag

SEQ ID NO: 2547 - DNA, 358 bp, Zea mays
  Clone ID: PAT_MRT4577_70204C.1
tcgagaccaacttgcaacatagaaagcacaatagtgtaccaacaatggcagccaaaatattttgccttcttatgctccttggtctttctgcaagggctggtaccgcgaccatttttccgaaatgctcgcaagcttctatagctttccttctttccccgtacctttcaccagcggggtcttcggtatgtgaaaacccaattctttaaccctacaggatccaacaggcaatcacaggtggcatcttacctttatcacccttggtccttcaacaatcatcaggcctattacatcaggtacctttggtgcatttattggcacaaaacattaaggcacaacaactacaacaacttgtgctagc

SEQ ID NO: 2548 - DNA, 348 bp, Zea mays
  Clone ID: PAT_MRT4577_70229C.1
agcagctagggttccgtcctcgatccgatccgccgagtgcacaccacctttccgcactccgatcgaatcgatggccgctgagggcgagaagctgatgatcaccctcaaaagctccgatggcgaggagttcgatatggaagatgcggtggcgatggagtcgcagaccatccgccacatgatcgacgattactgcgtcgacaacggcatagcctcttcctaacgtgaactcgatgatcgtatccacggtactcgagtactgcaacaagcacgtacatggcgccgcagccgcagctgacgtctcgacagccggttccgatgacgtgggtgacgagtccggcaacagcaccg

SEQ ID NO: 2549 - DNA, 459 bp, Zea mays
  Clone ID: PAT_MRT4577_70230C.1
gaacgggccttacttatttgggaacccctcatacaagaagatttttttgactatcctcatataaacttaaagaggcaccaccaatgatgggttgttggtagaaacgctgctgggtttgtcaaagcacgttggttgaatggcagccattgttgcccttgtaagagggtgccagcgctaggcgcagcgtgctggtagaacggaaacaactgtgcgttgcatcaagaaggtagcagggctcacaccagctagctggctgaatggaactagttgttgctgctgaaaataagcaggagagttcaatgctgccagttggttgaatggaagaaattgctgggggtaggcagcaagtagctggctgaatggtacttgttgttgttgcaaattacaagtagtattcagtgcaactagctgcttgaatggaagaaactgctgttgctgagagtctgctacatggtttgt

SEQ ID NO: 2550 - DNA, 501 bp, Zea mays
  Clone ID: PAT_MRT4577_70234C.1
cggccgccgggtgctggaaacgcccttcagcggacgaccgaccaggttttgtgggcacaaaacatcaaggaacaacactacaggagcttttttagcaaaccttgctgcctactctcagcaacatcagtttcttccattcaaccaactagctgcattgaactctgcttcttatttgcaacaacaacaacttccattcaaccagctagctgctgcctacccccagcagtttcttccattcaaccaactggcagcattgaactctcctgcttattaacagcagcaacaacttctaccatttagccagctagctggtgtgagccctgctgccttcttgacacaaccacagtagatgccgttctaccagctcgctgagcctaacgctggcaccctcttacaactgcaacaattgttgccatacaaccaacttgcatagacaaacccagcatagatataccaacaacccatcattggtggtgcccctctttagatttcttatgagtt

SEQ ID NO: 2551 - DNA, 762 bp, Zea mays
  Clone ID: PAT_MRT4577_70239C.1
gaggtctcggcctgggatcgcacatacttagttgacgacacaactagtcgacatagaaaagcacaataagcgcaccaacaatggcagcgcaaaatattgggcctccttatgctccttggtctttcctgaagcgctgttacagcgaccacttttcccgcactgctcgcaagctgcctatagcttcccttcttcccccgtacactctacaccagcggggtgttcgggatgcgaaaacccaattcttcaaccctacaggatccaacaggcaatcgcagctggcatcttacctttatcacccttgttcctccaacaatgatcagccctattacaacagctacctttggagcatttattggtacaaaacatcagggcacaacaacaacaacttgtgctagcaaaccttgctgcctactctcagcaacagcagtttcttccattcaaccaactaggttcattgaactctgcttcttatttgcaacaacaacaactaccattcagccagctacctgctgcctacccacagcaatattgttccattcaaccaactagcagcattgaactctcctgcttatttacagcagcaacaactactaccattcagccagctagctggtgtgagccctgctaccttcttgacacaaccacagatgttgccgttctaccagcacgttgcgcctaacgctggcaccctgttacaactgcaacaattgctggcattcaaccaacttgctttgacaaacccagcagtgttgtaccaacaac

SEQ ID NO: 2552 - DNA, 430 bp, Zea mays
  Clone ID: PAT_MRT4577_70242C.1
attgagaccaactagcaacatagaaagcacattattgtaccaataatggcagccaaaggagtgtgcctcattatgctccttggtctttctgcaagtgctgctacggctagcattttcccgcaatgctcacaagctcctatagcttcccttcttcccccatacctctcaccagcgatgtcttcagtatgtgaaaatccaattcttctaccctacatgatccaacaggcaatcgcagcaggcatcttacctttatcacccttgttcctccaacaatcatcatccctattacagcaagtacctttgaggcatttatttggacaaatcatcatggcacaacatctacaacaactcgcgctatcaaaccttgcttcctactcttagcacagtcagtaccttttgtgcaattgttgcatcaaaacattatggctca

SEQ ID NO: 2553 - DNA, 430 bp, Zea mays
  Clone ID: PAT_MRT4577_70245C.1
aacatataaagcacaatcatataccttcaatttcaaccaaaatattttgcttccttgtctcgttaaactttatgcaagtgctgctaccgcaaccattttcccacaatgctcacaagctcctatagcttcctttcttcccccatacctctcaccagctgtgtcttcactatgtgaaaacccaattcttcaaccctacaagatccaacatgcaatcgcagcatgcatcttacctttatcacccttgttcctccaacaaccgtcagccctattacagcacttacctttcgtgcattttttggcacaaaacatcaatgcacaacaactacaacaactttttctatgaaaccttgctacctactctcatcaacagcactttcttccattcaaccaacttgcttcatttaactctactgcttattttcaacaacaa

SEQ ID NO: 2554 - DNA, 437 bp, Zea mays
  Clone ID: PAT_MRT4577_70261C.1
gctacatagaaagcacattagtgtaccaacaatggcggccaaaatattttgcctccttatgctccttggaattactgcaagtgctgctacggcgaccattctcccgcaatgctcacaagctgctatagattccctttttcccccgtacctttcaccagcggagtcttcggtttgcgaaaacccaattcttcaaccctacaggatccaacaggcaatcgcagctggcatcttacctttatcacccttgttcctgcaacaatcatcagccctattacaggagttacctatggtgcatttattggcacaaaacatcagggcacaacagctacatcaacttgcgctagcaaccttgctgtctactctcaggaacagcagttttttccatttaaccaactagccgcattgaactttgcttctatttgcaacaccaacaacta

SEQ ID NO: 2555 - DNA, 591 bp, Zea mays
  Clone ID: PAT_MRT4577_70267C.1
atttcaccaacggtgtcttcggtatgtgataaacacaattcttcatcccaacaggatacaacaggcaatagcagttggcatgttacctttatagcacttgttgcctgcaacaataatgatgcctattacagaagatacctttggagcatttattggcacaaaacatcagggcacaacgactacaacaacttgtgctagcaaaccttgctgcctactctcagcaacagcagtttcttccattcaaccaactagctgcattgaactctgcttcttatttgcaacaacaacaactaccattcagacagctatctgctgcctacccccagcaatttcttccattcaaccaactgacagcattgaactctcctgcttatttacagcagcaacaactactaccattcagccagctagcttggtgtgagccctgctacacttcttgacacaaccacagttgttgccgttctaccaacacgctgcgcctaacgctggcaccctcttacaactgcaacaattgctgccattcaaccaacttgctttgacaaacccagcagcattctaccaacaacccatcattgagtggtgacctctttt

SEQ ID NO: 2556 - DNA, 415 bp, Zea mays
  Clone ID: PAT_MRT4577_70268C.1
tttcttatttctgggaagccacaaacattaaacaaaaaactttattattgaactataactcataagaaatctaataagagggcaccaccaatgatgggttggtggtagaacgctgctgagtttggcaaatcaagcaggttgaatggcagtaatagttgcagctgtaagagggtgccagcgttaggcgcatcgtgctggtagaacggcaacaactgtggttgtatcaagaaggtagcagggctcacaccagctagctggctgaatggtagtagttgttgctgctgtaaataagcaggagagttcaatgctgccagttggttgaatggaagaaattgctgggggttagcagcaggtatctgtctgaatggcacaagtggctgttgcgaactataatgataatttacagcagctacat

SEQ ID NO: 2557 - DNA, 391 bp, Zea mays
  Clone ID: PAT_MRT4577_70270C.1
aagaatctagaaatgtactttcttatttctgggacgccacaaacatcatacaaaaaacttgattattgaactataactcataagcaatataaaagagggcaccaccaatgatgggttgatggtagaacactgttgggtttgtcaaagcaagaaggttgaatggcagcaattgttgcagatgtaagagggtgccagcgttaggcatagcgtgcacgtagaacagcaacaactgttgttgagtgaagaaggcatcacgcctcacatcagctagctggctgaatggtagtagttgttgctgctgaaataaacagcagagctcaatgctgctagtaggttagatggaacaaattgctggaggtaggcagcaactagctggctgaagggtaattgt

SEQ ID NO: 2558 - DNA, 510 bp, Zea mays
  UNSURE (1)..(510): unsure at all n locations
  Clone ID: PAT_MRT4577_70275C.1
  unsure (1)..(510): unsure at all n locations
nccacctcaccatttttttcttctgaatgtgaaaacccgggggggtatttctacaagatccaacacgcattcacagctgacatgttacctttatcacccttggtactacaacaatcatcacccctattacatccgtcacctttggtgcatttattggcacaaaacatcatggcacaacaactaccacaacttgtgctagcaaaccttgctgtctactctcagcaacagcagtttcttccattcaaccaactagctgcattgaactctgcttcttatttgcaacaacaacaactaccattcagccagctacctgctgcctacccccagcaatttctttcattcaaacaactggcagcattgaactctcctgcttatttacagcaacaacaactactaccattcaagcagctagctggtgtgagccctgctaccttcttgatacaaccacaatttgtgccgttctaacaacacgctgcgcctaacgcttgcccccttttacaactggaacaa

SEQ ID NO: 2559 - DNA, 447 bp, Zea mays
  Clone ID: PAT_MRT4577_70277C.1
atgtcgagaacgcaggccttagcttatttctgggcagcgccacacatcagacaaaaactttattattgagctatcactcatcagaacctaaaagaggcaccaccaatgatgggttggaggttgacactgctaggtttgtcaaagcaagttggttgaatggcagaaattgttgcacttgtaagagggtgccagcgttaggcgcagcgtgctggtagaacggcaacaactgtggttgtgtcaagaaggtagcagggctcacaccagctagctggctgaatggtagtagttgctgctgctgaaaataagcaggagaggtcaacgctgccagttgcatgaatggaagaaattgctgggggtacgcaacaagtagctggctgaatggtagttgctgttgttgcaaataacaagcagagtacaatgcaactagctgcttgaatggaagaaact

SEQ ID NO: 2560 - DNA, 1143 bp, Zea mays
  Clone ID: PAT_MRT4577_7027C.1
ccgggaaaaaaaaaaaaaaaaaaaaaaccgcatcatcctttccctcgcgccgccgccaacgcaagccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccatcaagctctggaataccctcggtgagtgcaagtacaccatcggaggtgacctcggcggcggcgagggccacaacgggtgggtctcctgcgtcaggttctccccaaacacatttcagcccaccattgtctccggttcctgggaccgcaccgtcaaggtctggaaccttacgaactgcaagctgcgctgcactctcgatggtcatggcggatatgttaacgccgtcgccgtgagccccgatggatcgctctgcgcctccggcgggaaggacggtgttactctgctgtgggatttggctgaggggaagaggctgtactcgctggatgcgggctccatcatccactccctctgcttctcgcccaaccagatcctgtactgcacaagcttgagctggagcgccgatggaagcaccctctacactggctacaccgatgggtctatcagggtctggaagatctctggatatggctacgcaggctagatgtcgaaatccagtcgagggtctaggaggtcttgttctgcgaaacattgcaatgcggaacatagttttttttatgtgagttacatcgtctgcttggtactttatggtcgcccaactatctaagcttagctttgttaatgaagtttatt

SEQ ID NO: 2561 - DNA, 776 bp, Zea mays
  UNSURE (1)..(776): unsure at all n locations
  Clone ID: PAT_MRT4577_7028C.1
  unsure (1)..(776): unsure at all n locations
atttcctctcccctccctcaccccctcgccgccgccgccgccacccccgccccccaatctccccgcggcagccatggcgaacatgcaggagtcgctcggcctggtgggcacgatgcgcggccacaacgacgtggtgacggcgatcgccgcgccgatcgacaactcgccctacatcgtgtccggctcccgcgacaagtcgctgctggtctgggacctcaccaacccggtccagtccctcggcgacggcaccgtcggcaccgactacgccgtgcccttccgccgcctcaccggccacggccacttcgtccaggacgtggtcatcagctccgacggccagttcgcgctctcgggctcctgggacggcgagctccgcctctgggacctctccaccggcctcaccacccgccgcttcgtcggccactccaaggacgtcatctcggtcgccttctccgtcgacaaccgccagatcgtctccgcttcccgcgacaacaccatcaagctctggaacaccctcggcgagtgcaagtacaccatcggcggcgacatgggcggcggcgagggccacaccggctgggtctcgtgcgtcaggttctcccccaacatccagcagcccaccatcgtctccggctcctgggacaagaccgtcaaggtctggaacctcaccaactgcaagctccgctccaccctcngccggcacggtggctatgtcaatgccgtcgccgtcagccccgatggctcgctctgcgcctccgggcggcaaggacggcgtcactctg

SEQ ID NO: 2562 - DNA, 410 bp, Zea mays
  Clone ID: PAT_MRT4577_70292C.1
cccacgcgtccgtagcaacatagaatgcactttaatgtaccaacaatggcagccaaaaggtcagggctccttatgctccttggtctgtctgcaagtgctgctaccgcgaccattttcccgcaatgctcgcaagctactatagcttccattcttaccccgtacctctaaccagcggtgtattcggtatgtgaaaacccaattcttcaaccgtacaggatccaactggcaatcacagatggcatcttacctttatcacccttgttcctccaacaatcatcagccctattacatcagttacctcaggtgcatttattggcacaaaacatcatggcacatcaactgcaacaacttgtgctaacataccttgctgcctactctcagcaacatcattatgttgcattcaaccaact

SEQ ID NO: 2563 - DNA, 411 bp, Zea mays
  Clone ID: PAT_MRT4577_70294C.1
ttatttctgggaagccacactcatcatacaaaaaattcattattgaactatcactcatatgcaatctaaaagaggcaccaccaatgatgggttgctggtagaacgctgcagggttggtcaaagcacgttggttgaatggcagcaattgttgcagttgtaagagggtgccagcgctaggcgcagcgggcaagtagaacggcaacaactggtgctgtgtacaagaaggcaatagggctcacatcagctagctggctgaatggtggtagttgttgctgttgtaaataagcagcatagttcaatgctgccagctggttgaatggaagaaattgctgtcggtaggcagcagctagctgactgaacgagtggtgttgttgaactatgctggttaagtacaacgcaaacagctaccac

SEQ ID NO: 2564 - DNA, 409 bp, Zea mays
  UNSURE (1)..(409): unsure at all n locations
  Clone ID: PAT_MRT4577_70296C.1
  unsure (1)..(409): unsure at all n locations
atgaaccaactagcacatataaagctcatattgtaccaataatggcagccaaaatatttgactcatagctccttgtctttctgcaagtgctgctcgggagcatttaccgcaatgctcacaagctgctatagcttcccttcttcccccgatacctctcccaacgagtcttcagtatgagaaaatccaattcttctaccctacaggatccaacaggcaatcgcagcaggcatcttacctttatcacccttgttcctacaacaatcatcagccctattacagcagttacctatggtgcattgattggcacaaaacatcagggcacaacaactacaacaactcgtgctagtgcaccttgctgcctactctcagcatcagcttttacctatggtgcatttggaagcacanaaca

SEQ ID NO: 2565 - DNA, 542 bp, Zea mays
  UNSURE (1)..(542): unsure at all n locations
  Clone ID: PAT_MRT4577_70299C.1
  unsure (1)..(542): unsure at all n locations
tctctatacttcagagaagcccaaacatcatccaaaaaacttcatctattgaactataactcattaagctatctaaaagaggacaccaccaatgatgggttgatggtagaacgctgctgagtattgtacaaaacaaagttggtctgaatggcagcaattgttgcagatgtaagagggtgccagcgttaggcgcagcgtgcgaatagaacgacaacaactgttgctgagtcaagaaggcagcagggctcacatcagctagctgactgaatggtggtagctgatgttgttgtaaataagcagcacagatcaatgctgccagttggatgaatggaagtaattgctggaggtaggcagcagctagctggctgaatggtagttcgatggtgcaaataagcagcacagttcaatgcagccagtctggatgaatggaagaaactgctgttgctgatagtacgcagcaaggcttgctagcacaagctgttgtaggttgttgcgccctgatgnttttgcgccaacaaatgcaccaaagggtaactgctgta

SEQ ID NO: 2566 - DNA, 448 bp, Zea mays
  UNSURE (1)..(448): unsure at all n locations
  Clone ID: PAT_MRT4577_70303C.1
  unsure (1)..(448): unsure at all n locations
cgggnacacatattattganaccaactangcaacatatgaaagcacaatagtgtaccaacaatggcagctaaaatattttgcctccttatgctccttggtctttctgcaagtgctgctacggcgaccattttcccacaatgctcacaagctcctatagcttcccttcttgccccgtacctctcaccaacggtgtcttcggtatgtgaaaacccgggtgttgaaccctacaggatccaacaggcaatcgcagctggcatcctacctttatcacccttgtttctacaacaatgatcaggcctattacagcagtgacctttgctgcatttattggcacaaaacatctgggcacatcaactacatcaacttgtgtctacaacccgctgctgactacttttatcaacagtagtttttttctttcaaccaactaactgcattgaaccctgtttc

SEQ ID NO: 2567 - DNA, 600 bp, Zea mays
  Clone ID: PAT_MRT4577_70306C.1
gtaccctcccagtctctgtccgggcatcgcacatattattgcggaccaactagcaacataggaagcacaatattgtaccaacaatggcagacaaaaaattctgcctacttatgctccttggctctttctgcatgtgctgctacggcgaccattttcccacaatgctcgcaagctgctatagcttcccttcttcccccgtacctctcaccagcgttgtcctctgtatgcgaaaacccaattcttcagccctacaggatccaacaggcaatcgcagctggcatcttacctttatcacccttgttcctgcaacaatcatcagccctattacaacagttacctttggcgcatttatatggcacaacaacatgcagggcacaacagctacaacaacttgtgctatcaatccttgctgcctactctcagcaacagcagtttcttccattcatgcaactaggatcatcgaactctgcttcttatttgcaacgacaacaactaccattcagccagctacctgctgcctacccccagcaatgtcttccattcaaccaactagcagtatggaactattgtgcttattttctgcatcaacaactactacca

SEQ ID NO: 2568 - DNA, 567 bp, Zea mays
  Clone ID: PAT_MRT4577_70307C.1
tacgacggccgggcgggcgggcatcacccttgatcctccaacagccgacagccctatgacagtaacacctttggggcatttgtaggaacaaaacatcaagggacaacagctacaacaacttgtgctaagaaaccttgctgtctactctcagcaacagcagtgtgttggatgcaaccaactggctgcatcgaactctgctgcttatttacaacaacaactaccattcagtcagctagctgctgcctacccccagcaatttcttccattcaaccaactggcagaaatgaactctgctgcttatttacaacagcaacaagtaccaccatttaggcagctagctgatgtgagccctattgccttattgacacagcaacagttgttgtcggactacctgcacgctgcgcctaacgctagcaccctgttacaactgcaacaattgctgccattcaaccaacttgttttgacaaacccaacagcgttctaccaacaacgcatcataggtggcgccctcttttagattgatgatgagttatagctcaataatgaagatatttgaatgatgtttga

SEQ ID NO: 2569 - DNA, 423 bp, Zea mays
  Clone ID: PAT_MRT4577_70308C.1
aactagcaacatacaaagcacaatactgtaccaacaatggcagccaaaatattgtgcgtacttatgctccttggtctttctgcatgtgttgctaccgcaactcattttcctacaatgctcacaagctcatatagcttcccttcttcccccatacctctcaccagcgccgtcttcaatgtctcaaaccccaattgttcaaccttacaagatccaacaggcaatcgcaacacgcatcttaccattatcacccttgttcctccaacaactcgcacccctattacagcagctacctctggtccatttgatggcacaaaacatcagggcacagcaactacaacaactcgtgctagcaaaccttgttgcatactctcatgaacatcagtgtcttccattcaaccaaatggctgcattgaactctgctgc

SEQ ID NO: 2570 - DNA, 1443 bp, Zea mays
  Clone ID: PAT_MRT4577_7030C.1
aaaaaaaaaacggaaaaaaaaaaaaaaaaaaaaaaatataaaaaaaaaaaaaaaaaaaaaaaaaaaaaaaaaaccgcataatcctttccctcgcgccgccgccaacgcaacccttgcagccccaatccctcacagcaaccatgggtggcgcgcaggagtccctctctctggggggcacgatgcgcggccacaacggcgaggggacggcaatcgcgaccccgatcgacaactcgccgttaatcgtctcctcctcccgcgacaagtccctgctggggggggacctgaccaacccgggccactccaccccggaatccggcgccaccgccgactacggggtccccttccgccgcctaaccggccactcccacttcgcccaggacgtcgtcctcagttccgacggccagttcgccctttccggctcctgggatggagagctccgcctttgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtctcctgcgtcaggttctccccaaacacatttcagcccaccattgtctccggttcctgggaccgcaccgtcaaggtctggaaccttacgaactgcaagctgcgctgcactctcgatggtcatggcggatatgttaacgccgtcgccgtgagccccgatggatcgctctgcgcctccggcgggaaggacggtgttactctgctgtgggatttggctgaggggaagaggctgtactcgctggatgcgggctccatcatccactccctctgcttctcgcccaaccgctactggctctgcgctgcgacccaggactctgttaagatctgggaccttgagtcgaagcacgtcgtgcaggacctcaagcctgacatccagatctccaagaaccagatcctgtactgcacaagcttgagctggagcgccgatggaagcaccctctacactggctacaccgatgggtctatcagggtctggaagatctctggatatggctacgcaggctagatgtcgaaatccactcgagggtctaggaggtctcgttcggcgaaacattgcaatgttccgcatagttttttttttatgtgagttacatcgtctgcttggtactttatggtcgcccaactatctaagcttagctttgttaatgaagtttattaaatttgcttgtttggttttaccttgtgaaagggggtgtttgtctgagtttataatctgtttaccttatagtgttttttttggcgaagttaactgcggaaatggttacttcctcagctggcaaaaaaaaaaaaaaaaaactcgagag

SEQ ID NO: 2571 - DNA, 502 bp, Zea mays
  Clone ID: PAT_MRT4577_70311C.1
acgcccttgacaatctcggggagggggggcttagcttatttctgggcaagccacaaacatcatccaaaaacttcattattgaactataactcataagcaatctaaaagaggcaccaccaatgatgggttgttggtagaacgctgtagggtttgtcaaagcaagttggttgggggggggcaattgttgcagttgtaagagggtgccagcgttaggcgcagcgggcaggtagaacggcaacaactgttgctgtgtcacagaaggcaatagggctcacatcagctagctggctgaatggtggtagttgttgctgttgtaaataagcagcagagttcaatgctgccagttggttgaatggaagaaattgctgtgggtaggcagtagctagctgactgaatggtaggtgttgttgaaaataagcggtaaagtacaatgcaaacagttagttgaatggaagaaactggttgaggtgagagttgtagcctggtttactagcacaagttg

SEQ ID NO: 2572 - DNA, 2309 bp, Zea mays
  Clone ID: PAT_MRT4577_7031C.1
cattgggtacctcgaggccggccgggctaactggtcagactacgacgtctacgacctcgaactcacggcggtcaacaacaacaccgacctgcggaagctattcatcgagaccaccgggaaatccatcatcgtcgtcgaggacatcgactgctccgtcgacctcaccggcaagcgcaaggacaagaaatccgaacgcgaggccgacgacaagcccaagctgccgatggagcctgaaaaggacgaaggcagcaagattacgctttcagggatgctcaacttcatcgacggcctgtggtcggcatgcggcggcgagcgcatcatcatcttcaccaccaaccataaggacaagctggaaccggcgctgatacggcgaggcaggatggacaggcacatcgagatgtcctactgccgcttcccggccttcaaggtgctcgccaagaactacctggacgtcgaggagcacgagctattcgaccagatagggcagctgctcgaggagaccgacatgtcgccggcagatgtggcagagaacctgatgtccatgtccaagaagaagaagagggacgccaacgcgtgcttggagagtcttgcgaaggctctgaagcaggccaaggaggaggaggccaaggcgaaggtggaagcagaggcaaagaagaaggtagaggcggcggccgaggcagcaaagtccaaagaggaagacgaggcaaaggaaggcagcggataagacgaagcaggcgacaaaacttcagaatcgatgagcaacgtacgaacacacatcaaaagagatgacgacaagtctaggctcgtgattctaataggagtcatcattaaaataaaggcttaaattgtagaatcgttgaaattagggaacaatgtacactgtctctggaaatttgttgcaactcttccacttgcctatagattggtaatggctataaaaaaaaaaaaaaaaaaccgcatcatcctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtctcctgcgtcaggttctccccaaacacatttcagcccaccattgtctccggttcctgggaccgcaccgtcaaggtctggaaccttacgaactgcaagctgcgctgcactctcgatggtcatggcggatatgttaacgccgtcgccgtgagccccgatggatcgctctgcgcctccggcgggaaggacggtgttactctgctgtgggatttggctgaggggaagaggctgtactcgctggatgcgggctccatcatccactccctctgcttctcgcccaaccgctactggctctgcgctgcgacccaggactctgttaagatctgggaccttgagtcgaagcacgtcgtgcaggacctcaagcctgacatccagatctccaagaaccagatcctgtactgcacaagcttgagctggagcgccgatggaagcaccctctacactggctacaccgatgggtctatcagggtctggaagatctctggatatggctacgcaggctagatgtcgaaatccagtcgagggtctaggaggtcttgttctgcgaaacattgcaatgcggaacatagttttttttatgtgagttacatcgtctgcttggtactttatggtcgcccaactatctaagcttagctttgttaatgaagtttattaaatttgcttgtttggttttaccttgtgaaagggggtgtttgtctgagtttataatctgtttacttatagtgttttttggcgaagttaactgcggaaatggttacttcctcagcgtgcaaaaaaaaaaaaaaaa

SEQ ID NO: 2573 - DNA, 733 bp, Zea mays
  UNSURE (1)..(733): unsure at all n locations
  Clone ID: PAT_MRT4577_70330C.1
  unsure (1)..(733): unsure at all n locations
gactttcttatttctgggaagccacaaacatcataccaaaaaacttcattatctgaactataactcataagcaatctaaaagagggcaccaccaatgatgggttgttggtagaacgctgttgggtttgtcaaagcaagttggttgaatggcatcaattgttgcagttgttttattcttctagcgttaggcgcagcgtgcaggtagaacggcaacaactgttgctgtgtcaagaaggcagtagggctcacatcagctagctggctgaatggtggtagttgttgctgttgtaaataagcagcagagttcaatgctgccagttggttgaatggaagaaattgctgggggtaggcagcagctagctgactgaatggtagttgttgttgcaaataagcagcacatttcaatgcagccagttggttgaatggaagaaactgctgttgctgagagtacgcagcaaggtttcctagcacaagttgctgtagctgaagcgccttgatgttttgcgccaacaaatgcaccaaacgttactgctgtaatatggctgacgagctgttggaggaacaagggcgataaaggtaagatgcctgctgcgattgcctgttggatcctgtatggttgaagaattgagttttcacatactgaagacaccgctggcgagaggtatggaaggaagaaaggaagctatacgagtctgtgagcattgtgnagatatggntgcggtagcagcacttg

SEQ ID NO: 2574 - DNA, 590 bp, Zea mays
  Clone ID: PAT_MRT4577_70334C.1
tgaaaacaccaatatctttaacacctacacgatccaacaggcaatagcagatggagtcttacctttatcatgcttgtgcctgcaacactcatcagccctattacaacagtgacctttggagcatttattgggacaaaacatgaagacacaacaactacaacaacttgtgctagcaaaccttgctgcctactctcagcaacagcagattcttccattcaaccaactaggttcattgaactctgcttcttatttgcaacaacaacaactaccattcaaccagctacctgctgcctacccccagcaattacttccattcaaccaactagcagcattgaactctactgcttatttacagcagcaacaactactaccattcatacagctagctggtgtgagacctgataaactgttgacacaaacacaagtgatgacgttttaccagcacaatgcgcctaacgctggcaccctgttacaactgcgacaattgctgacattcaaccaacttggtttgacaaacccagaatggttctaccaacaacccatcattggtggtgcgctcttttagatttcttatgagttatagttcaata

SEQ ID NO: 2575 - DNA, 514 bp, Zea mays
  Clone ID: PAT_MRT4577_70337C.1
gccggggattttgaccttcttatgctcgttggtctcttctgcagtgctggtacggcgaccacttttcccgcaatgctcgcaagctcctatagcttcccttcttcccccgtacctctcaccagcggcgtcttcggtatgctgaaaacccaattcttcaaccctacaggatccaacaggcaatcgcagctgacatcttacctttatcacccttgtgtcctgcaacaatcatcacgccctattacaacagttacctttggtgcattgattggcacaaaacatcagggcacaacaactacaacaacttgtgctagcaaaccttgctgcctactctcagcaacagcaggttcttccattcgaccaactggggtcattgaactctggtgcttatttggaacaacaacagctacgatgcagacagctgcctgctggctacccgcagcaatttctttcattgaaccaactagcaggattgcactctgctggttgtttacaggaggagcaactactaccatgc

SEQ ID NO: 2576 - DNA, 1416 bp, Zea mays
  Clone ID: PAT_MRT4577_7033C.1
ccggccgggttataaaaaaaaaaaaaaaaaaaaaaaaaaaaaaaaaaaaaaaaaaaaaaaaaaaaaaaaaaaaaaaaaaaaaaaggacgaaaaaggagaaatcctacgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctccaccggcctcaccacccgccgcttcgtcggccacgagaaggacgtcatctccgtcgccttctccgtcgacaaccgccagatcgtctccgcgtcccgcgacaagaccatcaagctctggaacactctcggcgagtgcaagtacaccatcggcggcgacctcggcggcggcgagggccacaacgggtgggtctcctgcgttaggttctccccaaacaccttccagcccaccattgtctccggatcctgggaccgcaccgtcaaggtctggaaccttaccaactgcaagctgcgctgcactctggatgggcacggtggctatgttaacgccgtcgctgtgagccccgacgggtcgctgtgcgcctccggcgggaaggacggtgttactctgctgtgggatttggctgaggggaagaggctgtactcgctggacgcgggctccatcatccactctctctgcttctcacccaaccgctactggctctgcgctgcgacgcaggactctgtcaagatctgggacctcgagtcgaagcacgttgtgcaggacctcaagcccgacatccaggtctccaagaaccagatcctgtactgtacaagcttgagctggagtgcggacggaagcaccctctacactggctacaccgatgggtctatcagggtttggaagatctccgggtacggctacgcaggctagatgttgaaatcagcttggaggtctaggcagtctttcgggggaaaacattgtaatgtttgtcaagtttttgatgtcgtgagctatattgtctcttcgctactttccggtcgcccaaccattttaatcttactatggaagaatcttgttttgcactatgattcggttttattacttgtactttatattatgttatgtgcttcggccatgcaaccaattgaacgactgcggcggaaagacgttctggtttggct

SEQ ID NO: 2577 - DNA, 746 bp, Zea mays
  UNSURE (1)..(746): unsure at all n locations
  Clone ID: PAT_MRT4577_70342C.1
  unsure (1)..(746): unsure at all n locations
cgggnatcgcaccatattattgagnaccaactagcaatcatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagtagcaacaactactaccattcagccagctagctgatgtgagccctgctgccttcttgacacacaacagttgttgccgttatacctgcacgctatgcctaacgctggaacccttttacaactgcaacaatttgctgccatatcacccaacttggcttttacaaaccttaacagtgtttctacccaacaac

SEQ ID NO: 2578 - DNA, 675 bp, Zea mays
  Clone ID: PAT_MRT4577_70343C.1
atgaaggagaggctcgttggcgtctccgaggaaaccaccaccggcgtcaagaggctctaccagatgcaggagtccggcaccctcctcttccccgccatcaacgtcaacgactccgtcaccaagagcaagtttgacaacctttacggttgccgccactcgctccctgatggtcttatgagggcgactgatgttatgatcgctggcaaggttgctgtggtctgcggttatggtgatgttggcaagggctgtgctgccgcactcaagcaggctggtgcccgtgtgattgtgacagagattgaccccatctgtgcccttcaggccctgatggagggcatccagatcctcaccttggaggacgttgtctctgatgctgacatctttgtgaccaccactggaaacaaggacatcatcatggttgaccacatgaggaagatgaagaacaatgccattgtctgcaacattggtcactttgacaacgagatcgacatgaacggcctggagacctaccctggtgtcaagcgcatcaccatcaagcctcagactgaccgttgggtcttccctgagaccaacactggcatcattgttcttgctgagggccgtctgatgaaccttggctgtgccactggccaccccagctttgtcatgtcttgctcattcactaaccaggttattgct

SEQ ID NO: 2579 - DNA, 407 bp, Zea mays
  Clone ID: PAT_MRT4577_70345C.1
tcgctaccttcggtgcatccattggcatcatacatcaagccacatcatctaccactacttgagctaccaaacacttgatgcctactctcaggaacagcaggttcttccattcatccaactatctgcattgaactctgcttgttatttgcaacaacaacaactaccattcagccagctacctgctgcctacccccatcaattacttccattcaaccaactggcagcattgaactctcctgcttatttacagcagcatcaactactaccattcagccagctagctggagtgagccctgctaccttcttgatacaaccacaggtgttggcgatctaccaggacgctgcgcctaacgctggcacccttttaccactggaaccaattggtggcattcaaccaacttggtttg

SEQ ID NO: 2580 - DNA, 660 bp, Zea mays
  UNSURE (1)..(660): unsure at all n locations
  Clone ID: PAT_MRT4577_7035C.1
  unsure (1)..(660): unsure at all n locations
aattcggcacgaggcaacatacatcgacatggcggttctcaacctcctcgccttgatcattgccacgctactgctacttttcagaagaacctccggcgccggcatttcgccggcggacacgctcaacagcgggggcaacgtcaccgatggcgagacgctggtctcggccggtggcacattcaccctgggcttcttctccccgtcgaccacggtgctgaccaagaggtacctcgggatctggttcacggcgtctggtacggacgccgtcttgtgggtggccaaccgcgaaaccccgctaaacaacacctccggcgtcctggtgatgagcagccgggtgggccttcgccttctcgacggctctggccggaccgcctggtcctcaaacacgaccggcgcccccacctcttcggtggcacagctgctcgggtccggcaaccntcgtcgtgcgcgagaagagcagcaacgccgtcttccagtggncagtcgttcgaccatccgcagaacaccttgctcgccggcatgaggttcggcaagaacctaaagaccggcatggnagtggtccctttgacgtcgtggcgggcgcaggacgaccccgcgacgggggactacccggtcgtgtcatggacacgaagggccttccggacatcgttacttggcacg

SEQ ID NO: 2581 - DNA, 706 bp, Zea mays
  Clone ID: PAT_MRT4577_70364C.1
gccggccgggccggggcacatattattgagaccaactagcaacatagaaagacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggaacaacaactacaacaacttgtgctagcaaaccttgctgcatactctcagaaacatcagattcttccattcaaccaactggatgaattgaactctgctgcttatttgcaacaacaattaccattcagccaggtagatgatgactacccccagcaatttcttccattcaaccaactagcagaattgaactctgctgcttatttacagcagcaacaactactaccattcaaacagctacatgatgtgagacctgatgacttcttgacaaaacaaacaaatgatgacgatatacctgaacaatatgcataacgatggaaccctcttacaaatgaaaaaattgatgaaattaaaca

SEQ ID NO: 2582 - DNA, 862 bp, Zea mays
  Clone ID: PAT_MRT4577_70368C.1
gctaatatatcgcacatattattgagaccaactagcaatatagaaagcacaatattgtaccaataatggcagccaaaatattttgcctcattatgctccttggtctttctgcaagtgctgctacggcgagcattttcccgcaatgctcacaagctcctatagcttcccttcttcccccatacctctcaccagcgatgtcttcagtatgtgaaaatccaattcttctaccctacaggatccaacaggcaatcgcagcaggcatcttacctttatcacccttgttcctccaacaatcatcagccctattacaacagttacctttggtgcatttgttggcacaaaacatcagggcacaacaactacaacaactcgtgctagcaaaccttgctgcctactctcagcaacaacagtttctgccattcaaccaactagctgcattgaactctgctgcttatttgcagcaacaacaactactaccattcagccagctagctgctgcctacccccggcaatttcttccattcaaccaactggcagcattgaactctcatgcttatgtacaacaacaacaactactaccattcagccagctagctgctgtgagccctgctgccttcttgacacagcaacagttgttgccgttctacctgcacactgcgcctaacgttggcaccctcttacaactgcaacaattgctgccattcgaccaacttgctttgacaaacccagcagcgttctaccaacaacccatcattggtggtgccctcttttagattgcttatgagttatagttcaataataaagtttttttgctgatatttgtggcttcccagaaataagaaagtacatttctagattctta

SEQ ID NO: 2583 - DNA, 763 bp, Zea mays
  Clone ID: PAT_MRT4577_70372C.1
accgcacatatcttgtgacctgctaccccatagaaagcacaatagtcgtccaacattggcagccaaaatatatcgcttccttatgctcctgggtctttatgcaggggatgctaccgcaatcattaggccacagatgctcacaggctcctatagcttcccttcttcccccatacctctcacgcagcggcgttttgaatgtgcgaaaacccaattgttcaaccctacaggatccaacaggcaatcgcaacaggcagtctaaccatgatcagccctaggtcctacaacatccgccagccctattacagcagtgacctttggaccatttggtggcacaaaacatcagggcacaacaactacagcaacttgtgctagcaaaccttgctgcatactctcagcaacatgaggttcttccattcaaccaactggctgcattgaactctgctgcttatttgcaacaacaattaccattcagccagctaggtgctgcctacccccagcaatttcttccattcaaccaactagcagcattgaactctgctgcttatttacagcagcaacaactactaccattcagccagctagctgatgagagccctgctgccttcttgacacaacaacagttgttgccgttctacctgcacgctatgcctaacgctggcaccctcttacaactgcaacaattgctgccattcaaccaacttgctctgacagactcatcagtggtctaccaacaacccatcattggtgggcgccctcttttaga

SEQ ID NO: 2584 - DNA, 543 bp, Zea mays
  Clone ID: PAT_MRT4577_70374C.1
ctagaaatgtactttcttatttctgggaagccacaaacatcagacaaaaaactttattattgaactataactcataagaaatctaaaagagggcaccaccaatgatgggttgttggtggaatgctgctgggtttgtcaaagcaggttggttgaatggcagcaattgttgcagttgtaagagggtgccagcgttaggcgcagcgtgctggtagaacggcaacaactgtggttgtgtcaagaaggtggcagggctcacaccagctagctggctgaatggtagtagttgttgctgctgtcaataagcaggagagttcaatgctgtcagttggttgaatggaagaaattgctgggggtatgcagcagatagctggctgaatggtagttgttgtcgttgccaattatatgctgagtccaatgcagcttcttggttgaatggaagaaactgctgttgctgagagttggccagcaggtttgctcgcccaagttggtgtagttggtgtgccctgctgttttgcgccccttccatgccccaaaggtaactgc

SEQ ID NO: 2585 - DNA, 435 bp, Zea mays
  Clone ID: PAT_MRT4577_70375C.1
ctaccattagacctttatcaccctttttgtttcaacactcatcagccctaatgcaggagttacctatggcggatttattgccacaaaacattatgacacatcaactacaacatcctatgctagcaaaccttgttgcctactctcagcaacatcagtttctgtcattcaaccaactagctgcattgaactctgcttcttatttgcaacaacaacaactaccattcagccagatacctgctgtctacccccaacaattccttccattcaaccaactgtcagcattgaactctcctgcttatttacagcagcaacaactactaccattcagccagctagctggtgtgagccctgctaccttcttgatacaaccacagtttttgtcgttctaccagcacgcttttgcctaacgctggcaccctcttacaactgcaacaa

SEQ ID NO: 2586 - DNA, 577 bp, Zea mays
  UNSURE (1)..(577): unsure at all n locations
  Clone ID: PAT_MRT4577_70376C.1
  unsure (1)..(577): unsure at all n locations
gggccgggatcgccatnttatttagacacactagcacatagaaagccaatagtgtaccaacaatggcagccaaaatattctgcctccttatgctccttggtatttctgcaagtgctgctacggcgaccattttcccgcaatgctcacaagctcctatagcttcccttcttcccccgcacctctcaccagcggtgtcttcggtatgtgaaaacccaattcttcaaccctacatgtatccaacaggcaatcgcaggtggcatcttacctttatcacccttgttcctccaacaatcatgagccctattacagcagttacctttggtgcatttattggcacaaaacatgagggcacaacaactacaacaacttgtgctagcaaaccttgctgcctactctaagcaacagcgggtgcttccattcaaccaactaagtgaattgaactctgcttgttatttggaacaacaacaactaccattcagccagctacctgttgcctacccccaggaattggttgcattgaaccaactggggagatggaactctgctgcttattgacagggaggacaactgctgcgat

SEQ ID NO: 2587 - DNA, 484 bp, Zea mays
  Clone ID: PAT_MRT4577_70378C.1
aacttgcaacatacaaagcacaatagtgctccaacaatggcagctaaaatattatgcctccttatgcgtccttggtctacatgcaagtgctgctacagacaccatttttccacaatgctaacaagctcctatagcatcccttcttcccccgtacctctcaccaacagtgtcttcggtatgtgaaaacccaatatcttcaaccctacaggatccaacaagcgatcgcagctggcatcttacctatatcacccttgttcctccaacaatcatcagccctattacagcagttacctctggtgcatttattggcacaaaacatcagggcacaacaactacaacaacttgtgctagcaaaccttgctgcctactctcagcaacagcattttcttacattcaaccaactagcctgcattgactctgcatcttatttgcaacaacaacaactaccattcagccagctatctgcttgccacccccaacaatt

SEQ ID NO: 2588 - DNA, 853 bp, Zea mays
  Clone ID: PAT_MRT4577_70465C.1
gggtacctcgaggccgacgcgtccggcctatgtttttctttgaaaggatgtcggaaagaatgtgcattttatctggtcagcttgcctgtgtcttatcgctatgaatacctgatggcggagaccatattttcacagctactattgttgccgaatccaccattcaagccaatttactatacactggttatcattgatctttgcaaggcattaccaggtgcattcccttcagttgtggtaggagcagtgcatgctctttttgacagaattagtaacatggatatggagtgccgcaccagacttatactatggttttcacaccacttgtcaaactttcaattcatttggccttggcaggagtggtcttatgtcaaggacctcccaaaatgggctccacaacgggtttttgtccaggaagtactggaaagggaagttcgcttgtcgtactttgaaaaaatcaagcagagtatcgaggatgctgctgagttagaagaactgctacccccaaaagctgggcctaatttcaaattccatagcgatgaaagcaacgaaagcactgatggcctgaagttatccaaggaacttattggcttgattagaggaaagaagtctacatatgatattattttatgggttgaggaacaaataattccaaaaaatggtactgaatttgcacttgatgttgttagccagacgcttcttgacatgggttcaaaaagtttcacccatcttgtcactattttggagagatataataagataatctctaagctatgtccaaatgaggaaatgcagctactgttaatgaatggagtcagtgcttattggaaggacaagtaccagatgactgctatag

SEQ ID NO: 2589 - DNA, 2472 bp, Zea mays
  Clone ID: PAT_MRT4577_70528C.1
agacgacgccaccgtcacgccccgcgaccgccaacctatcccccaccgcgtcacgcgcctccacctccccagatcggcggcgaaccggggggcccggacaggcggcggagagctcgaggcgtcatggcgaagtcgagcgcggacgacgccgagctgcggcgcgcgtgcgctgcggccgtggcggcgtcaggcgcgcgcggggaggaggtggccttctccatccgcgtcgccaagggccgcggcatcttcgagaagctcggcaggctcgccaagccccgtgtcctcgctctcaccgttaaacaatcatcaagaggcgaggcgaacaaagcttttcttcgagtattaaaatattcatctggggcagtgctcgagccagccaaactttacaagctgaaacatctaacaaaggttgaggttatttccaatgatcccagtggttgtacatttgttctgggatttgataaccttaggagtcagagtgttgccccaccacaatggacgatgcgtaacattgatgacagaaatcgtctacttttttgtattctgaatatgtgcaaggagatactcagttatcttccaaaagttgttggaattgatattgtggagctagctctttgggcaaaggaaaacacactgaccatagataatcaagtgagtacccaagatggtcaagaaacatcagttgctactcaaaccgagaggaaagtaacagtaactgttgcttatggaataattgcttgagcgtctgcggatccacaagccctttgttatttacagactgcatctccaagccattgttacgtgattcagtctgtaaataacaaagggcttatggaagagctagataaattgcttgagcgtctgcggattccacaggagtttgcagcatcattaactggaggctcatttgaagagtcacggatgctgaaaaatgttgaggcatgtgaatggttgacaggggccattcgcagtcttgaagttcctaatttggacccatgctatgtcaacatgcgcgctgttagagagaaaaacagatcgggagaaactgaaaacaacttttgttcgacgagcatcagagtttttgcggaactacttctccagtttggtagacttcatgatcagtgacaaaagctacttttcacagcgtggacaattgaagcggcctgatcatgcagaccttaggtataaatgcaggacatatgcccgacttctgcagcacttaaagagtctggacaagagctgcttaggtcccttaaggaaggcatactgtcattcccttaatttactactacgacgagaggcacgtgaatttgccaatgaacttcgtgcaagtacaaaagcaccgaagaatcctgctgtttggcttgaaggttctggcggctctggtcataatggaagcagttctgatacttcacaggtctcagatgcatactcaaagatgcttacaatatttatcccgcttcttgtggatgagagttccttttttgcacattttatgtgctttgaagtacctgcacttgttccagctggttctcctaatgctaataagagcaaatccggaggaaatgacccggatgatgatctgggtcttatggatccagatggcaacgatctgaaacctgatagtacctctgctgaactgggtacattgaatgaagctcttcaagaattactcgatggaatccaggaagacttctatgcggtcgtagattgggcttataaaattgaccccttgcgttgcatctcaatgcatgggattacagagcgttacctttctggacagaaagctgatgctgcaggatttgttcgcaaactacttgatgacttggaatcaagaatatcagtacagttcagccggtttattgatgaagcatgccatcaaattgagcgtaacgaaagaaatgtgcggcaaactggaattctagcctacattccaagatttgctgtccttgcatcacgtatggaacaatatatccaagggcagtccagggatttaattgataaagcatacacaaagctagttagcacaatgttcgcaactttggagaaaattgcacagagtgatcctaaaactgctgatattgtgttgattgagaattatgctgctttccagaacagtctttatgacttggctaatgttgtgccaacgcttgcaaagttctaccatcaagccagtgaatcatatgaactagcttgcactcgccatatcagctcactcatttatctgcaatttgagaggttatttcaattcaaccggaaagttgacgaattgacttacactattgctgctgaggagataccgtttcagctgggattatcaaaaactgacctaaggagggtactgaaatccagcttatctgggattgataagtcgattagcgccatgtacaggaggttgcagaagacacttacctccgatgagttgtttccttcgctgtgggacaagtgcaagaaggagtttttggacaaata

SEQ ID NO: 2590 - DNA, 374 bp, Zea mays
  Clone ID: PAT_MRT4577_70616C.1
acgttcatgcccattgggggagacccagctgaccacctaaagctggatacttacttattcaaactgacccagcatggggcaacatcggaaggtcaaatgcttacaaacaaaaaattttaaaaaaaaaagcctgggttgggtggttcacaaaataaccaaacgacaaccacgaaattgggacgatttaaaaaaaacaactcaaaagcaaatcgaccccaaaagcccgttttactaaaaaaacactcccgccttttcctccatgggatccgcttcctcctcccaaaaaaaaaaaataaccagcttggaatcctttttaaaaagaggaggagcactctccacgttctcgccgtaaaaacaggggaaaacaaatttgg

SEQ ID NO: 2591 - DNA, 2142 bp, Zea mays
  Clone ID: PAT_MRT4577_70810C.1
gtctctactcctcttcctcctctctctactctccaagttctcttctccgtcgaccgctctacacgtctcttgtcgacctggacaccgaggtggaagaaggaagcagtcagcagatggatccatggatcagcagccagccttctctgagccttgacctgcgcgtcggcctgccgccgctcagcctccaccaccaggcgccggtggccgtcgccttgcccaggcccaagctgctcgtcgaggagaacttcctcctgccgcctccaaagaaagaaccagaggtacgcatatatacactacactccgatcctatgtgcgacgcaagcatgcacccaccccacctggactggacggagacggcgggcgtgacgacgagcaaagactctaacggactgtccccttgatttgatcccaggtcgcggctctcgagacggagctgcagcggatgggcgaggagaaccggcgcctggcggaggcgctggccgaggtggcctccaagtacgaggcgctgcgggggcagtacacggagatggtggccgcggcggccacggcctgcgggaaccacccgtcgtccacgtcggagggcgggtccgtgtcgccgtcgcggaagcgcaagagcgagagcacggacaccgcgccgcccgcgcagcagctactgcaccagcactacccggcggtggcgccggaccagacggagtgcacctcgggcgagccgtgcaagcgcatccgggaggcggagtgcaagcccagggtgtcgaagctgcacgtgcacgccgacccggccgacctcagcctggtggtcaaggacgggtaccagtggcgcaagtacgggcagaaggttaccaaggacaacccctgcccgcgggcctacttccgctgctccttcgccccggcctgcccagtcaagaagaaggtgcagcgcagcgccgacgaccccaccatcctggtcgccacgtacgagggcgaccacaaccacggccagcccccgccacaggcgcaggcgccgcacgacggctccagccctggcgccagcaagaagccgccgtcgccgccgaggccggtcgccgccgctccggcgccgctccaccaccagcaggtccagcagcaccagcagcagcaggcggttggcgcggtgaaatgcgagccgcccgtggccgcggcggcgtcggagctcatccggcggaacctcgcggagcagatggccatgacgctgacgcgggaccccagcttcaaggcggcgttcgtcaccgcgctgtccggccggctcttcgagatgtcgccgaccaaggactgacggaacggatcggatggattgggagattggcatcgcaggagattctggatcagattgtcttcgagcgcacgccgcaatggtcaactgcgcagcgctggcttggctgtcagagcgaaacagcggtaacagagcaagacacgaggggtctgcactctgcagttgtgcaggaggaggaacagacacaaggggaggacggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaacttattttttccctagcactatgtttcatgagaatgagaccaggaatgaaccaacttgagtttgaaaatttccataggggagtaataataacagaggtatactatagcctaataatagacgaacacgacgattaattgatacagacatttttatttcaccctgctctgttggccagtgccattgaagctgtcaattattcaagctagctctagcacgtacgccattatcatccaagtttcaagctacatgatgatagatgcctggagatgatatgattaacggcgtgcatatatgtcgccggatgcctggattgctgaagagaacaaggttgaggatgaccgagtttgtaccgctccaggcggtgtgcgggtacgtagaacatcgatattatcatcgcatgcgcatatatgtatgctagatgtaacagtaagctagcgacaaattaaacaagttcgtgc

SEQ ID NO: 2592 - DNA, 1644 bp, Zea mays
  Clone ID: PAT_MRT4577_70811C.1
cgtctctactcctcttcctcctctctctactctccaagttctcttctccgtcgaccgctctacacgtctcttgtcgatctggacaccgaggtggaagaaggaagcagtcagcagatggatccatggatcagcagccagccttctctgagccttgacctgcgcgtcggcctgccgccgcttagcctccaccaccaggcgccggtggccgtcgccttgcccaggtccaagctgctcgtcgaggagaacttcctcctgccgcctccaaagaaagaaccagaggtcgcggctctcgagacggagctgcagcggatgggcgaggagaaccggcgcctggcggaggcgctggccgaggtggcctccaagtacgaggcgctgcgggggcagtacacggagatggtggccgcggcggccacggcctgcgggaaccacccgtcgtccacgtcggagggcgggtccgtgtcgccgtcgcggaagcgcaagagcgagagcacggacaccgcgccgcccgcgcagcagctactgcaccagcactacccggcggtggcgccggaccagacggagtgcacctcgggcgagccgtgcaagcgcatccgggaggcggagtgcaagcccagggtgtcgaagctgcacgtgcacgccgacccggccgacctcagcctggtggtcaaggacgggtaccagtggcgcaagtacgggcagaaggtcaccaaggacaacccctgcccgcgggcctacttccgctgctccttcgccccggcctgcccagtcaagaagaaggtgcagcgcagcgccgacgaccccaccatcctggtcgccacgtacgagggcgaccacaaccacggccagcccccgccacaggcgcaggcgccgcacgacggctccagccctggcgccagcaagaagccgccgtcgccgccgaggccggtcgccgccgctccggcgccgctccaccaccagcaggtccagcagcaccagcagcagcaggcggttggcgcggtgaaatgcgagccgcccgtggccgcggcggcgtcggagctcatccggcggaacctcgcggagcagatggccatgacgctgacgcgggaccccagcttcaaggcggcgttcgtcaccgcgctgtccggccggctcttcgagatgtcgccgaccaaggactgacggaacggatcggatggattgggcgattggcatcgcaggagattctggatcagattgtcttcgagcgcacgccgcaatggtcaactgcgcagcgctggcttggctgctgcctccgttcactcttcgctgtcagagcgaaacagcggtaacagagcaagacacgaggggtctgcactctgcagttgtgcaggaggaggaacagacacagggagaggagggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaaattatttttccctagcactatgtttcatgagaatgagaccaggaatgaaccaacttgagtttgaaattttc

SEQ ID NO: 2593 - DNA, 668 bp, Zea mays
  Clone ID: PAT_MRT4577_70834C.1
gtcggtcggtccggaatccttattatcctattccgcatctctctccatctcgctgctcctctcgcctccttgttgatgcagcaagccagggatcgccatgtcggactcgaaggagcaccacttccaatcgaaggtcgacgccggagcgtccaagatctacccgcaacaggctggcaccgtccggaagaacggtttcatcgacatctagaaccgcccctgcgaggttgccgcaggtttctacctcgaagactggtatgtatgaccatgccaaatgccactttgttgccatagacatattcaacgagatagaagctcgaagatattgttccttcgacaacacaactgcgtatattccgcatgtgaaccgtactgagtaccacttgattgatatatcagaggatggatttgtgagccttcttacttcagatggcaacactaaggatgatcttacactcccaaatgatgatactcgtgaggcccagatcaaagaaagctttgaaagcgacaaggatcttgctgtgactgtacaatctgctatgtcgaatgagtaaatctgcacgctgaaggatggtgtgcccaagcaacttccctgtcttggaatactgcatctcacaatctaaatcgataaaagaagtgtatcacggattgctacagagacatctatctgg

SEQ ID NO: 2594 - DNA, 842 bp, Zea mays
  Clone ID: PAT_MRT4577_70875C.1
gaggcttgtgacggacaccagaatacacaacagcagctcaaaaaacccaacacacctcaacaagcagagcaaagatcccgggattcgccggcgcggtagcgagagcgagagatggacgggaggatgttcggtctcgagacccccctgatggtggcgctgcagcactttctggacgtgcccgacggcgacgccggcgcgggcggcgacaaggcgggcggcggcgggccgacgcgcacctacgtccgcgacgcgcgcgccatggcggccaccccggccgacgtcaaggagctcccgggcgcgtacgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaagcccaagaccatcgaggtcaaggtcgcctgaggtgggactaggtcgaccgatcgtggctctgaagatgtgggagcagtgccagcgagttgtgaggacctctacctgtgtgggatgtggcgaggaataatcgtagtctgtagtgggggtgcttctggtgtgcgtgtttgcttccttcggtcgcggtgtctgtctaccaattcctatctgatgtatgggcttcggtttcgtatgaaccatgccggatgctttcagtatgttcatctaaaaaaaaaaaa

SEQ ID NO: 2595 - DNA, 1089 bp, Zea mays
  Clone ID: PAT_MRT4577_70877C.1
ccggccgggaaagggaggcggcgcctaagaatcgaggcaaaagccagcccgagcacactccaccacctttcagaaccttcgacagccttccagaagcccatccctcaccacgcatgcaaagcgccccctccggccacgtcccgccccacaccaagaaagaatcacacaacagcagctcaaaaacctaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaaacccaagaccatcgaggtcaaggtcgcctgaggtgggactaggtcgaccgatcgtggctctgaagatgtgggagcagtgccagcgagttgtgaggacctctacctgtgtggaatgtggcgaggaataatcgtagtctgtagtgggggtgcttctggtgtgcgtgtttgcgttccttcggtctcggtgtctgtctaccaattcctatctgatgtatcggcttcggtttcgtatgaaccatgccggatgctttcagtatgttcatctaccaaaatattttgtctaaataatccgtagtcttcattgacagaaagactacacacgttatcctgacaagacacgaaatcccaataaagtttaaattcaggctactacc

SEQ ID NO: 2596 - DNA, 1093 bp, Zea mays
  Clone ID: PAT_MRT4577_70979C.1
gtgcggcgtcaggcggcgggtccgacctccgtcattccaactcccccctccggacgcaccttccccgctatataaggcacgcgccccgagcacaggcgaagagcgtgcagagcgagacgcgtcgcctcctcccttcccccaccccgccgccgccctcgcgtccgtccgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactccctcatcgaggaggaggaggggctcaacgaccacaacgtcgtcgtcaagtgcgccgagatccagaacgccatctccgaagggacaggagcaacatcgtttcttttcaccgagtaccaatatgttggtatcttcatggctatcttcgctgttgtgatcttcctcttccttggttcggttgagggattcagcacgaagagccagccctgcacatatagcaaggacaagtactgcaagcctgcgctgttcactgcactctttagcactgtgtccttcttgcttggagccatcacctctctggtctctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcacaattaatgtatttaagttgtattacggtgatgactgggagggtctttttgagtccatcactggctatggtcttggtgggtcgtccatggctctcttcggaagaagttggtggaggtatctacacaaaggctgctgatgttggtgccgatcttgttggaaaggtcgagaggaacattcctgaggatgatcctaggaacccagctgtgattgctgataatgtcggtgacaatgttggtgacattgctgggatgggatctgatctctttgggtcata

SEQ ID NO: 2597 - DNA, 259 bp, Zea mays
  Clone ID: PAT_MRT4577_71035C.1
gcgagcggccggcccttttttttttttttaaagtaaatcagagttgcataaattttttcggtccccgtaccacgatcatacacaagcacatgcatacacacacgtatacatacgatagattacgtagccacgcttattcgtgcatcacacgagcgcatacatacgtacgcgcgcaaaacacggtaggcgctcaatatcactctcaaacgcacgcgtagaccacggggagggacgacgatacgggaggatcaatcacccg

SEQ ID NO: 2598 - DNA, 1786 bp, Zea mays
  Clone ID: PAT_MRT4577_71053C.1
gacgaggccagccacgcgcaaaccgaatccaccaacgtcaaacgaccgcaccaaccaatccacttcgccggcgatccgtctcatctcgtcgcgtctccggcgccggcagacacgggtaacgcggctccgagatcggcgggcaggatgatgatgctgatcgattgctcggggtgccgtaccccgttgcagctgccgcacggggcgccctgcatccgatgcgccatctgtggggccgtcacgcacatcgcccccgcccctcccgccgagcccaaccgcggcgccgtacaaccggcgccggggtgggcgccgccgccgccgccggtgcacggacggaagcgcgccgtggtgtgcgggatttcgtatcggtactcgcggcatgagctgaagggctgcatcaacgacgccaagtgcatgcgccacctgctcatgacgcgcttcaacttccccgacgactccatcatcatgctcaacgaagaacaaacggacccctacaaaatcccaacaaagcataacataaggatggccatgtattggcttgtgcaaggttgtcaacctggagattcattggtgttccattattctgggcatggatcacaacaaagaaattacagtggagatgaggttgatgggttcgatgaaaccctctgcccgttggattttgagacacaagggatgattttggatgatgagataaatacagcattagttcgaccacttcctcatggagttaaacttcatgcactcattgatgcttgtcatagtgggactgcacttgatttgccttatctctgcagaatgaacaggagtgggcaatatgtatgggaagatcaccgaccgcgatctggtgtctggaaaggcactagtggtggggaagctatttcctttagtggttgtgatgatgatcagacctctgcagatacctctgctttatcaaagatcacttcgactggtgcaatgacattctgcttcatccaagctattgaacgtggacagggcaccacctacggtagtatcctgaactctatgcgttccacaatacgcaacacaggtgactcagcgggtgtaggtggcggtgctgttacatcactaattacaatgcttcttactggagggagcctttctgctggtggtctgagacaggagccacaactgacggcgtgcgagccatttgatgtctatgcgaagcccttctccctatgacgtgttcatagtattgcccaatgtactatggggttgtttgtttcggcttctggcagcttctggccaccaaaagctgctgcggactgccaaactctcagcttttcagccagcttctataaaattcgttagggcaaaaaccatccaaaatcaacataaacacataatctgttgagtcgttgtaatagtaggaatctgtcactttctagatcgtaagccctatgaacaactttatcttcctccacatgtaatcataataatactcagattctccccacagccagattctcagaaaagctggttagaaaaaagctgaaccaaacagcccctatatatctcctcccatttcacgttatcattatgtacatttcggtattaaaccttgttcgtttgtgtcggattgcacctggaatcgttccagctaatcaaaatttatataaattagagaagcaatccggtacaaacgaacaagaccttagaagtcctccatccatccagattgttaacaacgcgtggaattgccctttatttccatgccctcacaatgttcagtgcacagttgttaaaggagagtacaatttgatgcctc

SEQ ID NO: 2599 - DNA, 550 bp, Zea mays
  Clone ID: PAT_MRT4577_7151C.1
tgggtacctcgagggcgggcggggacgtttcctccctgagtctagagtcatgttccgcatcctcccatatccaattcgcgtagttctccctcgtctgccgccatggcgctctctgtggagaagacctcggctgaacgggggtacaaggtcaaggatctctcgcaggcggacttcggccgcctcgagattgagctggccgaggtcgagatgcccggtctcatggcgtgccgcgccgagttcggcccgccaaaccccttcgctggtgctaggatctcgaggtctctccacatgaccatccagaccgccgtcctcattgagagcctcaccgcgctcggcggcgagggccgctgaggatcctgtttattttttctccacgcaggaccacgccgagcggcgccatcgcgcgcgactcagccgccatgttcgactggaatgatcataccctctagcagtactgggggcgcaccgagcgctacctggactgaaacgagaggggcgagcccgacctcgtcgtctaggacgtcggcgacaccacgctgctcgaacacga

SEQ ID NO: 2600 - DNA, 821 bp, Zea mays
  Clone ID: PAT_MRT4577_71648C.1
actcctatgggcgattgggaccctcgaggccggccgggccaaaatcatcccctttaaattggttgtccttctgttttgatactgcttcctttcttcctcgacattcgatttccatctcatcacataaaaccggaataatgtctactgctggcaagactattacctgtaaggccgccgtcgcctgggaggccggcaagcctctgtccattgaggatatcgaggttgctcctccaaaggccaacgaggtccgaatccagatctactacactggtgtttgccacacagatgcctacacactctctggcaaggaccccgagggtgctttccccattgtccttggacacgagggtgccggtattgtcgagtccattggtgagggcgtcaccaacgtcaaggttggtgaccacgtcgtcgctctctacacccccgaatgcaaggagtgcaagttctgcaagtccggaaagaccaacctttgcggtaagatccgagccacccagggcaagggtctgatgcccgacggcacctctcgattcaagtgcaagggcaaggatctgcttcacttcatgggcacttccaccttctcccagtacaccgtcgtcgccgatatctccgtcgttgccattgagcacgacgctcccatggaccgaacctgtctgctcggctgcggtatcaccaccggttacggtgctgccaccatcaccgccaacgtccaggctggcgacaacgttgccatcttcggtgccggctgtgtcggtctctcagttgtccagggtgctgccgctcgcaaggctggcaagatcatcgttgtgacgtcacccttc

SEQ ID NO: 2601 - DNA, 375 bp, Zea mays
  Clone ID: PAT_MRT4577_7168C.1
tacaaaactctatagtgagtcgtattaccttgcagtcatcccatcagtcacggcaacacatccggccatgtcaaggaaaatgtctcgcgccatagttgaggtcctcttcgacatcgtcgtcatcgctgccctcagagcggcagaggcaccggcagaatgaacgcatgcaagcagtcctgccaaggcaccggacgaatgaactcatgcaggtagtgctgcagctcctgccactgcagccaagtctgctgccacgagaactgcacctgctaaggcatctaaagccgccgttaccgccgccgtagccgctgcgtcatcgacgtcgtcgtctacgaagtctggtccaactgccgcgccgaccacagcctcctctacaac

SEQ ID NO: 2602 - DNA, 272 bp, Zea mays
  Clone ID: PAT_MRT4577_71725C.1
gccgtccgccttgcccttcacgaaggcttggtcctcctccttgtatctccactccccccttcacagatccgttcctccagctagggttagcgttcctctgcagcgatggcgatcaagcggaccaaggcggcgaagaagatcgcttacgataagatgctatgcagcctgctccgatgagtacaccaatgtgctcatcgcccttcccgacaacgtcggttgcacgcagctccaggacatccgccggggcctcaagggcgactcggtggtgctca

SEQ ID NO: 2603 - DNA, 1449 bp, Zea mays
  Clone ID: PAT_MRT4577_71847C.1
aaggcaggcaggcaggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgctggcgcggccggcgcacgtgccgccggcgttccagcgcgcccggggcaagaagcgcgccgtcctggtcggcatcacgtacgccggcgcgcgccggggctgcggcgacctgaggggccccgtcaacgacgtcaagtgcatgaggaacctcctctgccagcgcttcggcttccccggcgagtgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgacggcgacgaggcggacgggtacgacgaggccatctgcccgctggacgcgttccagagcgggcccatcctggacgacgagatcaacgaggtcatcgtgcgcccgctggtgcacggcgccaggctgcacgccgtggtggacgcctgctacagcgccacggtcctggacctcccctaccagtgccgcatgtccaggaacgggttctggcagtgggaggacgagagcccgccgtcgggcgcctggaagggcaccagcggaggccacgccgtgctcatcagcggatacagcgagggcaaaggcaacttcgccatgatgcccgacgcccacgcgtcggtcgtcggggccatgacgcacagcttcgtccggacgctggagtgccagccgcgcggggtcacctacggccacctgctcagctccatgagggccatcatgaagaaccgcggcgggggctgcgatctgcagggggccatcggcgcacccatccgcaccgtcgccaacttcagcggcgtgcaggagcctaacctgtcctcttcggagacgtttgacatttaccgcaagcagttcgtcctgtagacaccaccacaccagggtttgcccctgccggccggccgcttgtaatgaattgccgtcgtatcagaataagaaattatctatcgaccatgatatgatatgatatatcaggaaagaaggaactattacccctcaatgtaataactaagcatgttcaatgtcctctttttattagagagagagacagagagaaaacgcggaatttgagacgtgtgcatgcagtttacgtgatcaataaagttacatagaaattattttatccctctttttattaagagagacagggagaaaaccctgttaatgtggagactgcgcaat

SEQ ID NO: 2604 - DNA, 1661 bp, Zea mays
  Clone ID: PAT_MRT4577_71852C.1
cgcccgggtcgacgcaagactctaaactggcaggcagaggcaagaggcccctcaccctcaggtgatcaggtcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacccgcatccggcgggccgaccgcatcccgctggcgcggccggcgcacgtgccgccggcgttccagcgcgcccggggcaagaagcgcgccgtcctggtcggcatcacgtacgccggcgcgcgccggggctgcggcgacctgagaggccccgtcaacgacgtcaagtgcatgaggaacctcctctgccagcgcttcggcttccccggcgagtgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgacggcgacgaggcggacgggtacgacgaggccatctgcccgctggacgcgttccagagcgggcccatcctggacgacgagatcaacgagaccatcgtgcgcccgctggtgcacggcgccaggctgcacgccgtggtggacgcctgctacagcgccacggtcctggacctcccctaccagtgccgcatgtccaggaacgggttctggcagtgggaggacgagagcccgccgtcgggcgcctggaagggcaccagcggaggccacgccgtgctcatcagcggatacagcgagggcaaaggcaacttcgccatggtcagggacatgatacatacatacatactgctgatcgagctctgctgccttgcatctatctatatacctaacatgcatatgctgctgcttggacgacgcgcggcgtgcagatgcccgacgcccacgcgtcggtcgtcggggccatgacgcacagcttcgtccggacgctggagtgccagccgcgcggggtcacctacggccacctgctcagctccatgagggccatcatgaagaaccgcggcgggggctgcgatctgcagggggccatcggcgcacccatccgcaccgtcgccaacttcagcggcgtgcaggtatccatgtcgaatctctctgtctctgtcaacaacaacatccttggctagctgctgtgctcctctcaccaattaaactctcacttgtttgctttggtttgatctttttgcaggagcctaacctgtcctcttcggagacgtttgacatttaccgcaagcagttcgtcctgtagacaccaccacaccagggtttgcccctgccggccggccgcttgtaatgaattgccgtcgtatcagaataagaaattatctatcgaccatgatatgatatgatatatcaggaaagaaggagctattacccctcaatgtaataactaagcatgttcaatgtcctctttttattagagagagagacagagagaaaacgcggaatttgagacgtgtgcatgcagtttacgtgatcaataaagttacatagaaattattttatccacgtgcgatgcaagtggagcttctact

SEQ ID NO: 2605 - DNA, 2335 bp, Zea mays
  Clone ID: PAT_MRT4577_71853C.1
accgcgtatcgactcctatgggcgattggtaccctcgaggccggccgggaaggcaggcaggcagccaagaggcaagaggcaagaggtccctcagtcgctaggcgctagctcccggcttaactagtaggcagccatgaatttcggtgggaatggcaacgcgacgatccggtgcaagtactgcagggcgagcctgagcgtgatccccggcgagcgcgccatccagtgcgcgcaatgcaactgcgtgacgcgcatccggcgggccgaccgcatcccgctggcgcggccggcgcacgtgccgccggcgttccagcgcgcccggggcaagaagcgcgccgtcctggtcggcatcacgtacgccggcatgcgccaaggctgtggcgacctgaggggccccgtcaacgacgtcaagtgcatgaggaacctcctctgccagcgcttcggcttccccggcgaatgcatcatcatgctcactgacgaccagagggacccgttcaggctgcccacgaaggagaacatccggatggcgatgcactggctggtgcagggctgcagctacggcgactccctggtgttccacttctcgggcatcggcgcgcaggtggcggacgacgacggcgacgaggcggacgggtacgacgaggccatctgcccgctggacgcgttccagagcgggcccatcctggacgacgagatcaacgaggtcatcgtgcgcccgctggtgcacggcgccaggctgcacgccgtggtggacgcctgctacagcgccacggtcctggacctcccctacctgtgccgcatgtccaggaacgggttctggcagtgggaggacgagtgcccgccgtcgggcgcctggaagggcaccagcggaggccacgccgtgctcatcagcggatacagcgagggcaaaggcaacttcgccatgatgcccgacgcccacgcgtcggtcgtcggggccatgacgcacagcttcgtccggacgctggagtgccagccgcgcggggtcacctacggccacctgctcagctccatgagggccatcatgaagaaccgcggcgggggctgcgatctgcagggggccatcggcgcacccatccgcaccgtcgccaacttcagcggcgtgcaggagcctaacctgtcctcttcggagacgtttgacatttaccgcaagcagttcgtcctgtagacaccacgccacaccagtgtttgccccgccggccgcttgtaatgaattgccgtcgtagtatcagaataatcaattatctatcggccatgatatgatatgatatatcaagaaagaaggaactaatacctagagtacttcgttcatctgtattagcagtgaacctctcaatgaaataactaagcatgttcaaaaaaaaaaaagcagcagagacctagggtacctcgaggccggccgggagtattgtaagagattgaagggtaattttcttcatcttgaatgctcttatatggggggagaagtcgtctggtgctgttcctttcaccacaatgtttgccttggtcctcctttggtttggcatctcagtaccccttgtcttcgttgggagttaccttgggttcaagaaacctgccatggaacctccagtcaagacaaacaagattccacggcagatccctgagcaggcttggtacatgaatccacttcaccattctgattggcggtgtccttccatttggagcagttttcattgaactcttcttcatcctcacctccatctggctgcaccagttctactacatctttggcttcctcttccttgtgtttgtgatcctgatcatcacctgcgccgagatcacaatcgtgctctgctatttccagctctgcagtgaggactatatgtggtggtggaggtcttaccttacctcaggatcctccgccctgtatctcttcctgtacgctggtttctacttcttcacgaaactgcagatcactaagctggtgtctggcatcttgtacttcggctacatgcttctcgcctcatatgccttcttcgtgctgactggcacaattggtttctgcgcctgcttctggttcactaggttgatttactcttcagtgaagatcgattaggtgccaagatgacagaacaacacatgtttcaatgatggagtcaagataattgtatgattaatgtggattggggaattacccccctcctttttttgaaggttttcaggaaaaatttactgtttaggatttagtttacggatggtttatgttttgttattgtcaggttatacactttagtgatctggaactgaaaaaatataagggtaaacatattagacgaaaaaaaaaaaaaaaaaagcggcc

SEQ ID NO: 2606 - DNA, 2567 bp, Zea mays
  Clone ID: PAT_MRT4577_71970C.1
ccggccgggaaaaaaaaactacccgctccctgtccagcgtccgcgtgcaccaacacctcccacgagtccgcgacgcgtcagcgtcaccgtccgtcgtcgcaaacgagcccagtggcgattcgctttcgaaccgcactcgccctcctctgttctcttctctccctcctatagttggcttctcgccaccctctgctttcgatcagctttctccgctccccgtttccctctccaactccaatccatggcctccacggatcgctccacgccggcggaggacgagcaacagcagaagcgcccgtctctcttctcgccgtaccagatgccccgcttccgcctcgcccaccgggtggtgctggcgccgatgaccaggtgcagggcgcccgacgcggtcccaggccccgcgctcgcggagtactacgcgcagcggtccacggagggcggcttgctcatctccgagggcaccatcatctcgccgtccggccctgggttccctcgtgtccctgggatatacaatcaagaacagactgatgcatggagaaaggtggttgatgctgttcatgccaagggagctatctttttctgccaactatggcatgtaggccgagcttctcaccaagtatatcagccgggtgctgctgctccgatatcctcaactgataagccaatatcatcaagatggaggatactgatgcccgatggatcctatggcaagtatccaactccgaggcgcctagccacatccgagataccagaaattgttgagcaataccgtcaagcagccataaacgccatcaaagcaggtttcgatggcatcgagatccatggcgcccatggctacctcatcgatcagttcctcaagggcggtatcaacgaccggactgacgagtacggtggctcactctccaaccgttgccggttcctcctggaggtgacccgagccgtggtctctgcgataggggcagaccgcgtcgcggtccgagtgtccccggccatcgaccatctcgacgcctacgactccaaccccctgcagctcggcctggccgtggtggagcgtctcaacgctctccagcaggaggccgggcggctggcctacctccacgtgacgcagccacggtacacggcgtacgggcagacagagtctggccagcacgggagtgccgaggaggagagccggctgatgcgtgccgtgcgaggtgcctaccgtggcacgttcatgtgcagcggtgggtacacgcgggagctcggggtcgaggccatcgagtccggggacgctgacctggtgtcctacgggcggctgttcatcgctaatcccgacctggtggagcggtttcggcgcgacgccccgctgaacaaatacgtgcgcaagacgttctacacgccggaccccgtcgtcggttacacggactacacattcctcggccagcctaaggcgcgcatgtgattattagtaggttgccgtaattataagaggcggagtgttgtttgtgtgttgtgacttgagaaaacaagcaaacatctgggtaatgccgcgattgttacgtgttcctactgtatacgtgttaccaatattcgggcctacagattgtatcttgataatcagtggcagatctagaattttactatgtgtaaaaaaaaaaaaaaaaaaaaaaaaaaaaacttgccgccagccagcccattaaccctcgttcctgtcgcgcagccacgacctccacttccgcatcttccccggcggcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctcgaggctgccaagaagttcgagccgaaataccgcctcatcaggaatggtcttgctactaaggttgagaagtcccgcaagcaaatgaaggagcggaagaacagggccaagaagatccgtggtgtcaagaagaccaaagctggtgacgccaagaagaagtaaacgttcgtttacatttgtattactgttctgggctctgggtggtctagctgcaatgtcataattatggtcgtgttaggttttgttccacctttggcactgaagtgattttttttgtaattcctcggcactgaagtgaagttttgtcagaatattgcctcgtaacataattgcccggtccctgttctagttgtggcgcagtctggtttgttttgacatttgttttcaaggttcatccttatttgcattgcatttgtttatggcttgacgttaacatttggaacaagtatttgtcaccgctcatgtcgatggtgtaaaacatgatagttatgttgtcttctgtgggctgtgtaaaataggggatttgcaatatgacattatttcagagtaaaaaaaaaaaaaaaa

SEQ ID NO: 2607 - DNA, 372 bp, Zea mays
  Clone ID: PAT_MRT4577_72073C.1
tctccatcttgtttccatttcgcgtaacttttcgcggaattttacatcaactttaaaccaacccactttctatcatcatgactggacgcggcaagggcggcaagggcctcggcaagggcggtgccaagcgtcaccgtaagattcttcgtgacaacatccagggtattaccaagcccgctatccgacgtctcgctcgtcgcggtggtgtcaagcgtatttctgccatgatctacgaggagacccgtggtgttctcaagtccttcctcgagggtgtcatccgtgatgccgtcacatacactgagcacgccaagcgaaagaccgtcacattactagacgttgtctatgccctgaaacgacagggccgcaccctgt

SEQ ID NO: 2608 - DNA, 1308 bp, Zea mays
  Clone ID: PAT_MRT4577_72153C.1
gtgccgccgaacaccctcacaagagtcggcctcttcggcacgcagtccagcctcagcagtccccttccctccctccatcaggtgttgcctcccgcagatccaaatcggaattcggtccttcgtccccaaaccaccaatccgggaagtgaagtgatgggggagtgcgaggacggcaaggagtacaggtgctgggaggagctgctgccggacgcgctgggcctcatcttccgcaacctgccgctgcaggaggtgctcaccgtcctgccgcgggtgtgcaagtcctgggggcgggtggtggccggcccctactgctggcaggagatcgacatcgaggagtggagccagcagcagggcaagccggagcagatcgcccgcatggtcgagctactcgtgggccgcagcgccggctcgtgccgccggatcagcgtctccggcctgccctgcgatccgcgcttctccttcatcggagacaacgcacgagctctccggaccttggagatccccaggagcgagatcagcgactccatggtggaatccgtggcgccgcggctgccgaacgtcactttcctcgacatcagcagctgcacgaagatgggggcccgcggcctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagctcctgccgcgcgaccgccacccggggctgcgcgtcctgggaccccgcgtcgacgactgctacgagaacagctactgggaggagtgctccgacgactactcggacgactcctccatctactcgtgggagctcatggacgacgtcgacgacgactacgactacgccgccggcagcgacgacgacgacgacgaggccgtctgggacgacgacggccagggcctggagaacctggaggtcaggttctacggcggtggcttcggcgagaccttcgccggcttcgactggccgccgtcgccgtgacatgacacctgctgcctgcgcttgcgttgcttgcgtgggtgggtgagcctttgtgtgttgtccccaagctttggaagcttgctgtgctgctgtagtactgtgcctgcgacatcactcgatcttcctctacctcgcagatatgccatatgtgaagcg

SEQ ID NO: 2609 - DNA, 1678 bp, Zea mays
  Clone ID: PAT_MRT4577_72159C.1
gccactagctctccgcagtccgctctcgcctctcggccttctccttgtgccgccgaacaccctcacaagagtcggcctctcgatttctcagtccagcctcagcagtccccttccctccctccatcaggtgttgcctcccgcacatccaaatcggaattcggtccttcgtccccaaaccaccaatccggttgcattctttgggtttgctcacagcgcacacaaagccattttactgctgggaatggtggctggcactattagcgtctccggctcttgagtgatctccaagtcctttggaatgctacagggaagtgaagtgatgggggagtgcgaggacggcaaggagtacaggtgctgggaggagctgctgccggacgcgctggggctcatcttccgcaacctgccgctgcaggaggtgctcaccgtcctgccgcgggtgtgcaagtcctgggggcgggtggtcgccggcccctactgctggcaggagatcgacatcgaggagtggagccagcagcagggcaagccggagcagatcgcccgcatggtcgagctactcgtgggccgcagcgccggctcgtgccgccggatcagcgtctccggcctgccctgcgatccgcgcttctccttcatcggagacaacgcacgagctctccggaccttggagatccccaggagcgagatcagcgactccatggtggaatccgtggcgccgcggctgccgaacgtcactttcctcgacatcagcagctgcacgaagatgggggcccgcgggctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagctcctgccgcgcgaccgccacccggggctgcgcgtcctgggaccccgcgtcgacgactgctacgagaacagctactgggaggagtgctccgacgactactcggacgactcctccatctactcgtgggagctcatggacgacgtcgacgacgactacgactacgccgccggcagcgacgacgacgacgacgaggccgtctgggacgacgacggccagggcctggagaacctggaggtcaggttctacggcggtggcttcggcgagaccttcgccggcttcgactggccgccgtcgccgtgacatgacacctgctgcctgcgcttgcgttgcttgcgtgggtgggtgagcctttgtgtgttgtccccaagctttggaagcttgctgtgctgctgtagtactgtgcctgcgacatcactcgatcttcctctacctcgcagatatgccatatgtgaagcgaactgctagtggtgcaatctaaaatgtagacgctggtgtttacatgaagcaatccccatcagcatgcaccggtgagattccaccggtgccaatccccaaacatcctacctactactagtcatagagagcggggcagggtacccctgtctcctgatggcttctttaatgtcatgcgagcaaacatggcagtgcaagggtctcctg

SEQ ID NO: 2610 - DNA, 320 bp, Zea mays
  Clone ID: PAT_MRT4577_72196C.1
gttcgtgggtgagcggatcgagatggcggcgtaggatgttgagtaccgctgcttcgtcggcggtctcacctgggccacggacgaccactctctgcacaacgcctttagtacctacggcgaggatctcgagtacaagatcatgctcgatcgggagactcagaggtcccgagggttacgctatgtccccttctccacggaggaggcgatgcggaacgccattaagggcatgaacggtaaggagctgtacggctcgaacatgaccgtgaacgatgcccagtcctgaggcggacgtggatgcggaagcggcgggtacggtggtg

SEQ ID NO: 2611 - DNA, 1293 bp, Zea mays
  Clone ID: PAT_MRT4577_72198C.1
gaacctcgccggcggccgcagccgcatagaccggaagagaaaggaagcagagatcggaggcaggcgaagatggggcgcggcaaggtgcagctgaagcggatagagaacaagataaaccggcaggtgaccttctccaagcgccggaacgggctgctgaagaaggcgcacgagatctccgtcctctgcgacgccgaggtcgccgtcatcgtcttctcccccaagggcaagctctacgagtacgcctccgactcccgcatggacaaaattctagaacgttatgagcgatattcctatgctgaaaaggctcttatttcagctgaatctgaaagtgagggaaattggtgccacgaatacaggaaactgaaggccaaaattgagaccatacaaagatgccacaagcacctgatgggagaggatctggagtctttgaatccaaaagagctccaacaactagagcagcagctggagagctcactgaagcacatcagatcaagaaagagccaccttatggccgagtcaatttctgagctacagaagaaggagaggtcactgcaggaggagaacaaggctctacagaaggaactttcagagaggcagaaggcggtcgctagccggcagcagcagcagcagcaggtgcagtgggaccagcagacacaggtccaggtccagacaagctcatcgtcttcttccttcatgatgaggcaggatcaacagggactgccacctccacaaaacatctgcttcccgccgttgagcatcggagagagaggcgaagaggtggctgcggcggcgcagcagcagctgcctcctccggggcaggcgcaaccacagctccgcatcgcaggtctgccgccatggatgctgagccacctcaacgcataaggagggcgagcaaatggcgtgcgaagtgattgattgctcaccgttgattgaacgatagcctaagttcatggcggcagcaaactaagctaaaactattgttatgtttgcaaggaagggtagggtaacccgctgtgtaatctttgtccagctagcatgtaccaactgagatgcatgcatgcttattattgtccaattacccgtgaatctagcggtgcttttggtgagaggccggccgggcgggtgcagtttacttcaaatatggtttgtgattttgtgtaaatagtattaactaggagtcctatggtaagtaaattaattaatgggaggatgcatgaataaaacctctcttgtgctgcaaaaaaaaaaaaaaaaatactagaagaaaacggaaacagccatactaaagaatac

SEQ ID NO: 2612 - DNA, 486 bp, Zea mays
  UNSURE (1)..(486): unsure at all n locations
  Clone ID: PAT_MRT4577_72272C.1
  unsure (1)..(486): unsure at all n locations
cggacgcgtgggcggacgcgtggggcgccaccgcatggtgctccgggataacatccagggggtcaccaagccggcgatccggcgtctcgctcggcgcggcggcgtgaagaggatcagcggcctcatctacgaggagacccgcggggtgctcaagatctttcttgagaacgtcatccgtgatgctgtgacctacaccgagcatgcccgccggaagacggtgacggcgatggatgttgtgtatgcactcaagcgccaggggcgaactctgtacggctttggcggctgaagggccgagcgtttggtccaggactaggcgtttctgctttggcttagtagttcgtgggctgtcttcggagtatggagggctttgngggaacgtagacttgtanggatnggcagatatcttatctgatatggtaatggaggaaagtttgagttaatgttttcttgcgttatctgatatgtgattaaatgtatattctgaaa

SEQ ID NO: 2613 - DNA, 248 bp, Zea mays
  Clone ID: PAT_MRT4577_72299C.1
gtctaccaccacccgcctcctctcgagttcgatctgtttgctcccccaaacatgttcggccgcggcaagggaagcaagggcctgggtaagggcggcgccaaacgccaccgcaaggtgctccgcgacaaccttccagtgcatcaccaaaccggccatcccgaagcttgcgcccaagggcggcgtgaagcgcatctccgggctcatctacgaggagacccgcggcgtgctcaagatctttctcgagaacg

SEQ ID NO: 2614 - DNA, 316 bp, Zea mays
  Clone ID: PAT_MRT4577_72350C.1
gaccaccggtgtcttcagtatgtgaaaacccaatttttaaaccctacaggatccaacaggcattggcagcatgctttttaccttaatcacccttggtcctccaacacccgtcatgccctattacagcagttacctttgcagcatttgttggcccaaaacttcaaggcccaacatctacatcaactcgggctaggaaaccttgctgcctactttagacaccagaagtttcttccattcaaccaactggctgattagaactctggtgcttattggcaacagaacttaccattaagtcagttagctgctgcctaccccc

SEQ ID NO: 2615 - DNA, 372 bp, Zea mays
  Clone ID: PAT_MRT4577_72434C.1
ctgccgcgtggggctcaggcacaagcaccgccgttgttgctgacggttccagaaggggggtttcgtgaagactcataaaaccaatgcgttatttcaaacgttatccaagtgcaaattcaagagaaggcgggctgggcagacacactacatggccaggataaggctggttaaccaagacaaaaacaagtccaacacacccaaatacagatttgttgtgcgatttaccaacaaggacatcattggcccaatcatatatggtagtatagcgggcgatatggttcttgcttctgcctactaggatgaggtgccacgacatggtcttgaagatggtctgaccaactattcagatgcctactgcactggccttttgtt

SEQ ID NO: 2616 - DNA, 388 bp, Zea mays
  Clone ID: PAT_MRT4577_72545C.1
attcggctcgaggggttggctgctacactccctgcggctcgggtacgggttcgagagggtctccggagtccggtttcgtgggtgagcggaccgagacagcggcgtcggactgcgagtaccgctgcttcgccggcggactcggctgggccacggacgaccactgcctccacaacgcctacagcacctactgagaggtcctctggtccaagatcatcctcgatcgggagacgcacaggtcccgcggctacggcttcgtcaccttctccacggatgaggcgatgcagaacgccatcgagggcatgaacggcaaggagctggacggactcaacatcaccgtcaacgaggcccacacccgcagcagacgtcgaagcggcagcagcagctgcta

SEQ ID NO: 2617 - DNA, 643 bp, Zea mays
  Clone ID: PAT_MRT4577_72561C.1
cctcgaggccggccggggtcgtctcttccctcactctcggtccttttccccatctcccagatctaattcgagagctctccctcctctgtcgctatggggctctctgtggacaacacctcgtctggacggcagcactaggtcaaggagctctcgcacgaggacttcgtccgcctcgagattgagctgctcgcaagccgaaatgcccggcctcatggcgtgccgagccgagttcggcccgtcgaaccccttcgctggagctaggatgtcggtcgctctccacatgaccatccagaccgccgtcctcatcaagaccctcaccgcggtcggcgccgaggtccgctggtgctcctgcaagatattttccacgcaggaccacggcgtcgccgtcatcgcgcgcgactcgggcgccgagttcgcctggaaggcggagaccctcgacgaggactgcggtggcaaccatcgctgcctcgactgaggcaaggagggaggcccctatctcatcatagacgacggcggcaagtccacgctgctcatccacaaagatgacaaggccaaagacgattacgagaataccggacagagaccccatccggagaacatcgacaacgctgagttcaagaccgcggtcaccatcatacgggac

SEQ ID NO: 2618 - DNA, 695 bp, Zea mays
  Clone ID: PAT_MRT4577_7259C.1
actttctgctgctgatgcttccacggtatatgctatcacggtcgagggctatcgagagacgtcttgggatcacatgtctctgaggcacctgtctttatggaccctcatgggagcggtatgcgtgccctctccaggtcccttattgtactctgttctggatcttggacggtgcacaattgtgtccagacctctccaacatggatttcgagtcatatgtcctttctgagtcaagctcgcttatttatcctctggagatcgtcgtcacggacctgtggcactacgaagctgctgttcacgattccaagaatccttgagcttgctcaatagttgtttataccagtcgctgatatgaagtactcccgtgtgaccgtgatctttcctaccgaacagtcatccccccagatgagcttatctgacgaagttgctgcacttaaccgctactttggcgaactcaaatctgatggtgatgcttatgtgataagggatccacctacagctggacagaagtggcacgtcttctacgcctctgagtacccagagatagcaatgtggaaccttgaaatgcgcatgactgtgctggacgagatgacagcttctgtccttttcaagactaatgctgatgggaactcaatatgtgtcaaagatatgacaaagatctctggaatctctgaaatgatcctcgggatggagatctg

SEQ ID NO: 2619 - DNA, 375 bp, Zea mays
  Clone ID: PAT_MRT4577_72622C.1
actttcttatttgtggaaagcacacacacatcataacaaaaaactttattattgaactataactcataataaatctaaaagaaggcaccaccaatgatgggctgttggtagaacgctgctgggtttgtaaaagcaagttggttgaatggctagcaattgttgcagttggatgagggtgccaaacgataggcgcatcgtgctgttatgaacggaaacaactgatggctgtatcaaaaacgtagtgttgactcacaccatctaactggctgaatggcagtacctgttgtttatgtaaataaacaagagagatcaatgctgccgaggtgcttgaatggaataaattgcgttctggtcagcagcacgtatctacatgaa

SEQ ID NO: 2620 - DNA, 633 bp, Zea mays
  Clone ID: PAT_MRT4577_7264C.1
gggtacacggcgcccctcctcgagtttttttttttttttttttttttttttttttttttttttttttttttttttttttttttttttttttttttttggaaacaaaaaccttgtttattttttttttgtttcgtttaatagggggagcaaacaaagggaacaacaggggtcccaacccctaatccaaagggaaaacggaccttaacccggggacaaaagcgaacggtaaccccattttttagatagataaaataactcggccgaagccaggatgggcccacaaattattcctttcaaccgccgccgccgccgccgtaaccgccaccaccacctttgggccgaccggcgtaaccgccaccgtttttgtagccggcgccaccacctttgggccgaccggggtaaccgccaccgccgccataaccgccgtcacggggcccgccaccataaccgccgccgccggaaccgccgccgtaaccaccggcgccaccggcaccggaaagggactgggcctggttaacggggatgttacggccggcgagctccttgccgtttattttttcaatagcgtcaaacatggagttttcggaggaaaaggtaacgaaacccaacccgggagacctccccgtttcccgg

SEQ ID NO: 2621 - DNA, 260 bp, Zea mays
  Clone ID: PAT_MRT4577_72741C.1
aggtatcttaagattgagggagaataaagcctggcggggggatcagtatccatagatccgtaatccatgctttttaattcatgatttctgttgaatcttatgatgaacacagcactaacaactgacacaaatctaccttgcaatcaataacacaaattgtcagcatacaaacacgacacgaacgaagataaaccctttggactagggtaaacatcacgtgtagcgaacaggataacttggccgcgcgggccccacagctc

SEQ ID NO: 2622 - DNA, 826 bp, Zea mays
  UNSURE (1)..(826): unsure at all n locations
  Clone ID: PAT_MRT4577_72742C.1
  unsure (1)..(826): unsure at all n locations
aaatctcatggtccaaagagagatgatggccctgttatcttggttgtgaatgcttgtgccagccgggaccttcatgatgatgttgttggggtgtgctttgtagcccaagatatgactgtccataagttggtgatggacaagtttactcgggttgagggagactacatggcgatcattcacaacccaaacccactcattcctcctatatttggtgctgatgaatttggatggtgttgtgagtggaatgctgcaatgaccaagctgactgggtggcacagagaggaagtgctcgataagatgcttctcggtgaagtgtttgacagtagaaatgcctcctgccttttgaagaacaaagatgcatttgtaagcctttgtgttgttatcaacagcgcgttagccggcgaagaaacggaaaaggctccatttggcttcttcgaccgaagcgggaagtacactgagtgtcttctgtcagtgaacagaaggcaaaatgagggtggtctcatcactggggtattctgttttattcatattcctagtcatgagctgcaacaagcactgcaggtgcagcaagcctcggagcagaagtcactaaaaaggctgaaagctttctcctacatgagacatgcaatcaacaaccctctctcaggcatgctttactccagaaaagcactaaagaacacagatttgaatgaagaacagatgaggcagatccatgttgcagataattgtcatcaccagctaaacaagatacttgccgacttggatcacataacatcatggaaaaatctagntgcttggatttggagatggctgaaattgtgttgca

SEQ ID NO: 2623 - DNA, 750 bp, Zea mays
  Clone ID: PAT_MRT4577_72813C.1
aagtcgcattcacctccgaattcggtcgcccatggcaccgcggctgctctgatcctacccacctaccccctccccctcccctcccctcccctcccagctgctctcccttcccctctcgtttgaaaatggcaatgctggtggatcctccgaatggcatgggaaaccaagggaagcactattactcaatgtggcaaaccttgtttgagattgacaccaagtatgtgcctatcaaacccataggccgaggagcttctggaatagtttgctcatccataaaccgtgagacaaacgagaaagtagcgataaagaagatacataatgtattcgacaaccgtgtggatgcactaaggaccttgcgggagctgaaactcctccggcatctccgccatgagaatgttatttctttgaaggatataatgatgcctgtacaaaggaggagctttaaggatgtgtacttggtttatgagctcatggatactgacctgcatcagataatcaaatcgcctcaggggctttccaacgaccactgccaatattttctttttcagttgcttcgaggactgaaatacctccattcagcagagatactccacagagacctaaaacctgggaacctactggtgaatgcaaactgtgatctgaagatatgcgattttggtcttgcacgcacaaacagtagtaaaggccagtttatgactgaatatgtcgtcacacgctggtatagggctcctgagttgctgcttttgctgc

SEQ ID NO: 2624 - DNA, 197 bp, Zea mays
  Clone ID: PAT_MRT4577_72949C.1
gggcttattcaaaaatggttcccgaacaaaaggtggtaaaaaaggccccggcggggcttcccggcggggccggccccaaaaaaaacccggtctctcgctccttgaaggccggcctcaatttccccttaggccttatcggccgcaacctcaaccaggttcgctagtccaaccttgtcggaaccggggcccccttcaac

SEQ ID NO: 2625 - DNA, 352 bp, Zea mays
  Clone ID: PAT_MRT4577_72974C.1
ggtggcttctcctccccctccggtcgggttcggttcgcgaggttctccgggttcggtttcggggtgagcgatcgagatggcggcgtggatgttgagtaccgctgttcggggcggctccctgggccacggactaccactccctcacaacgccttagcacctacgggaggtcctcgagtccaagatcatccttatcggagagacgcataggcccgcggcttggcttctcaccttatgacggaggatgcgatgcggaacgccatcagggcatgaacggaaggagctggacggccgcatcatcacctgcaacgggcgaatcccgggctgccgggaggcggtgcagggaggtacggg

SEQ ID NO: 2626 - DNA, 560 bp, Zea mays
  Clone ID: PAT_MRT4577_73333C.1
cactacgctcacagcgactcccatctcccctgttagactgcttccatctcatctccggcgatgtctgggcgtggcaagggcggcaaggggctcggcaagggcggcgccaagcgccaccggaaggtgctccgcgacaacatccagggcatcaccaagccggcgatccggaggctggccaggaggggcggtgtgaagcgcatctcggggctcatctacgaggagacccgcggcgtcctcaagatcttcctcgagaacgtcatccgcgacgccgtcacctacaccgagcacgcccgtcgcaagaccgtcaccgccatggacgtcgtgtacgccctcaagcgccagggccgcaccctctacggctttggcggctgagcgccatcagcgcgctgccgctggctgacactgctgtttcctgcgttgctctgtagtcgtatcccccctgtcgtgaatctagtgcgctggctatgcttgtttctgtagtttgtctagtgaaatccaacttctagttgtaactcctatcgtttcctttcgttgcaatgacaagttaattccaatctcag

SEQ ID NO: 2627 - DNA, 517 bp, Zea mays
  Clone ID: PAT_MRT4577_73338C.1
acgcgcgagatcgcacaaatcctcttgctcgagttctcctcaaccaaattcaagtcacagtggtgaaactctcggcgatgtatggcgcgtggcaagggcgtataagggtctgggcaagggcggagccaagcgccaccgcaaggtgctgcgtgacaacatccagggcatcaccaatccggcgatccgcaggttggcgaggaggggcggcgacaagcgcatctccgggctcatctacgaggagacccgcggtgtgctcaagatcttcctcgagaacgtcatgcgcgacgccgtcacctacaccgagcacgcccgccggaagactgtcaccgtcatggacgctgtctacgcgcccaagcgccagggccgcaccctctacggtttcggcggctaggtcggtccatctcccggcggcgaattacctggcggctgtggactgtggaggtcgagttgtgtgtttcgtctagtgtagtctgagatgtctactattggtgctgatttctgtggcggctgaacacta

SEQ ID NO: 2628 - DNA, 333 bp, Zea mays
  Clone ID: PAT_MRT4577_73341C.1
aattatttggccttcgtcagagaggggagaaagacccgttcgaggcggcagcaatgggggggcgcattaagggcggcaagggtctacgcaaggctggagccaatcgccaccggaaggtgctccgcgacaacatacagggcatcaccaagccggcgatccggaggctggatcggaggggcggcgtgaagcgcatctcggtgctcatctacgacgagacccgcagcgtgctcaagatcttccttgagaacgtaatacgcgacgccgatacctacaccgagcacgcgcgccgtaagaccgtcaccgccatggatgtcagttacgcactcaagcgcc

SEQ ID NO: 2629 - DNA, 354 bp, Zea mays
  UNSURE (1)..(354): unsure at all n locations
  Clone ID: PAT_MRT4577_73343C.1
  unsure (1)..(354): unsure at all n locations
gagccggccgggccgggaatgtaccatcatctctccaaatccaccagcaatcccncaatcctccgagttcgagcgaccatgtcggggcgtggcaagggcgggaagggtctgggcaaaggcggcgccaagcgtcaccgcaaggttctccgcgacaacatccagggcatcacgaagccagcgatccggaggctggcgaggaggggcggcgtgaagcgcatctcggggctcatctacgaggagacccgcggcgtgctcaagatcttcctcgagaacgtcctccgtgacgccgttgcctacacgaatcatgatcgccgtaagagcgatgcagccatgcatgtagtttttttttttttc

SEQ ID NO: 2630 - DNA, 650 bp, Zea mays
  Clone ID: PAT_MRT4577_73345C.1
tcgaggccggccgggatctcttcctaatcccaccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtaacctacacggagcacgcccgccgcaagaccgtcaccgccatggacgtcgtctacgccctcaagcgccagggtcgcaccctctacggattcggcggctgaggggtcaggggtgtcccccagctgctgctggtcgttgcagaagtcttgggtcgcggtcacgaaatggagtgaggcgagagtattcttgcccatgtgcttagtttcgtaggcttatcactctagactctagtgccttggtccagtagtagcatacgacttgtactgcatttccttgttctgaacctctaaatatgatgagatgtggattcacttgatctcacaaacaaccagttaattcggatcaaatttgtactgaaaaaaaaaaaaaaa

SEQ ID NO: 2631 - DNA, 1958 bp, Zea mays
  UNSURE (1)..(1958): unsure at all n locations
  Clone ID: PAT_MRT4577_73424C.1
  unsure (1)..(1958): unsure at all n locations
actcctatgggcgattgggaccctcgaggccggccgggattaataattacatccgtctccaaaaggtctcctccctcggtctccctcgggctaggctagctagctaggttaccactctggtacaacatggctggtgatggcatggaggtatctgccagcgggggtggcggcggcaacaagcagccgcagatcagccttttggggctgttcctcgcatgcatggtcgccggcggcgtgcagtacggatgggcgctgcagctctcccttctcaccccctacgtccagacactggggattcctcatgctcttacatcagtcatgtggctctgtggacctattgctggcttacttgtacaaccctgcgtcggcctctatagtgacaaatgcacttctaagcttgggagacggaggccattcatctttacaggatgcatcatcatctgtatatctgtgatagtcatcggtttctcctcagacatcggttacgctctcggtgacacgacggaagactgcaatgtttacacggggaagcggctgcacgcggccttgttcttcgtgatgggattctggctgctggacttttccaacaacacggtgcagggccccgcacgcgcgctgatggcggacctcgcaggcagccacggacccagcacggcgaacgccatcttcgtgtcgtggatggcgatcgggaacatcctgggctactcgtcggggtccaccgacaagtggcacacctggttcccgttcctgcagacgagggcatgctgcgaggcgtgcgccaacctcaaggccgccttcctggtgtcggtggtgttcctgggcctgtccacggtggtgaccatgatcttcgcccgcgaggtgccgctggacccggcggcggcggcgaagcaggacgaggccggggagtcgtcgggcccgttcgccgttttcaagggcatgaagaacatgccccccggcatgccgcaggtgctcatcgtcacgggcctcacctggctctcctggttccccttcatcctcttcgacaccgactggatgggccgcgagatgtaccacggcaggcccgacggcagccccgaggaggtggccaggttccaggagggcgtccggcagggcgccttcggcctgctcctcaactccgtcgtcctcggagccagctccttcctcatcgagcccatgtgccgcaagctcaccgccaaggtcgtgtgggtcatgagcagcttcctcgtctgcgtcgccatggccttggtcaccgtcctcagctcctggtcgctcggcgacatcgggggcaacgtgcaggacgccgccgccgtggataagggcctcaagaccaccgcgctcgccatcttcgtcttcctcggcttcccattcgcggtcctatgcagcgttccgttcgccgtgacggcacagctggcggcggccaagggcggcgggcaggggctgtgcacgggggtcctcaacatctccatcgtggtgccacagatggtcatcgccattggctctgggccgtgggacgagctgttcggcaagggcaacatcccggcgttcggccttgccgccgtcttcgccttcaccgctgccgtcgcagggatcatcatgctgccaaagcagcccaagaccagcttccggtccgtctccatgggaggaggccattgatgatcacaactctaggatgcatggtccactgtggttcacgattcttttacctttgggagttggacggccaggtgtttgttctcaaggccgcttccgaggcctaaaccggtgggtttatttctaggccggatcatgacgaacaatctgtttcgctgggttgtaaaggaaaagttttacacgaacacacaacgtgtcggctatttaacttttggaaaaaaaagtgtagtacctagcaatactacattaaaaaaaattggacggaaaaaaaaaaaaaaaaaaggggcggccnnnnnnnnnnnnnnccg

SEQ ID NO: 2632 - DNA, 390 bp, Zea mays
  Clone ID: PAT_MRT4577_73505C.1
tgtcacttgctctccctccaacaagctaattaaggacggtcatccctcttctagctcgtgtgattatccatggcggaggagaagcaccaccaccaccacctgttgcacctctatttggacgaggagcaggatgagcaggtcgccggcggcgggtacggcgagtccgccgagtacacggagggcacggagactgaggtactgtccacgggcgagaacgagtaccacgagcacaagaaggaggataagcaggacaagcacaagcagcacctctgagatggcggcgacatcggcgccggcggctgtcgcactgttcgagtagcacgaggcaatcatggacccggagctctcgcaccggcacaagatctacgtcgaggtcgcaggggcggcggc

SEQ ID NO: 2633 - DNA, 1024 bp, Zea mays
  UNSURE (1)..(1024): unsure at all n locations
  Clone ID: PAT_MRT4577_73523C.1
  unsure (1)..(1024): unsure at all n locations
cattgggtacctcgaggccggacggggcctccttgttccgggtcctactcccgccgccttcgcctaaagaggcctcgccctcccccctccggcgaaaaccgattcccttccccgattccctccggcgtttcctgaaagatgattaatcttttcaaaataaagggtcaaaagaaagaagaggcagcaagtgctgctggaaaggcccctgttaagaaacagtctgctggggagctccgtcttcataaagatattagtgagctcaacctgccgaagaccacatcaatttcttttcccaatggcaaggatgatctgatgaattttgagaccaccatccgacctgatgaaggatattacatgggcggcactttcgttttcacctttcaagtgtccccatcttatcctcatgatcctccgaaggtcaaatgcaagaccaaggtgtaccatccaaatattgatctggaaggcaatgtctgtctgaacattctgcgcgaagattggaagcctgttctcaacatcaacactgttatttatggcctgaatcttctttttacgcaaccaaacgacgaggatcctctgaaccacgaagctgcagttgtccttcgcgacaatccaaagatgtttgaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcggaaagtgcttctggaagcaaaatccaaaccgttcatggtgtgacatctgtttgcccgcctttgtgatgtgtggtatagtggtggtgcataatgacagggaaatgcttctctaactgtatcattcattccataaatcctaaacgaggaatgggaagtggattgttaagcaaaaaaaaaaaaaaaaaagcggcctcgtattcggcgtgtattcattgtcgcatcttccagntcgacgttgacatgcacgtctagct

SEQ ID NO: 2634 - DNA, 1361 bp, Zea mays
  Clone ID: PAT_MRT4577_73526C.1
cctcgaggccggccgggctcctttctccgggtcctactcccgccgccttcgcctaaagaggcctcgccctcccccctccggcggacaccgattcccttccccgattccctccggcgtttcctggtgagtttacgccagcgccgacttctccgatcaggtcccatcggttttgggtgcgcgcacctcgtttggcttcgcgtcgttcttcggtgcgcgcacgcgattcgtggatccggcggtcggatcccgcgccgtccgcagcgatggctgctccccaacccttgcttctttgcgcgcaccccttccccacggccttttagtttttacatgggagaggggcgaccctcgctagccgcagggtccctctccatcctcaccgctttcttcctctgcaggtcccttagtgcaagcaaggacaccgctcctctagcgagctctgttctgaagcggcaagaaagatgattaatcttttcaaaataaagggtcaaaagaaagaagaggcagcaagtgctgctggaaaggcccctgttaccaaacagtctgctggggagctccgtcttcataaagatattagtgagctcaacctgccgaagaccacatcaatttcttttcccaatggcaaggatgatctgatgaattttgagaccaccatccgacctgatgaaggatattacatgggcggcactttcgttttcacctttcaagtgtccccatcttatcctcatgatcctccgaaggtcaaatgcaagaccaaggtgtaccatccaaatattgatctggaaggcaatgtctgtctgaacattctgcgcgaagattggaagcctgttctcaacatcaacactgttatttatggcctgaatcttctttttacgcaaccaaacgacgaggatcctctgaaccacgaagctgcagttgtccttcgtgacaatccaaagatgtttgaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcggaaagtacttctggaagcaaaatccaaaccgttcatggtgtgatactgtgatgcatctgtttgcccgcctttgtgatgtgtggtatagtggtggtgcataatgacatggaaatgcttctctaactgtatcattcattccataaatcctaaacgaggaatgggaagtggattgttaagcagattccttctgcagatgttgatgtcgtattcggcgtgtattcattgtcgcatcttccaggtcgagaaaaaaaaaaaaaaaaaaggggcggcc

SEQ ID NO: 2635 - DNA, 323 bp, Zea mays
  Clone ID: PAT_MRT4577_73530C.1
gctaggcttctcctccccctgttaccaagtgctcttcgggatatggttacttacggttttgtggaggggcgatggcggcagctgatgtggagtaccgttgcttgaaaagctaggcttgcctgtgccaccagcaacgagtcggtggagaatgccttcgacttctacggagagatcctggactccaaggtcatcaccgaccgggagacggggaggcttcgcgggttcggattaataaccttctcctgcgagaactccatgctcgacgctatcgagaacatgaacaggaaggagatctatggccgttacatcaccgttaaccaggc

SEQ ID NO: 2636 - DNA, 277 bp, Zea mays
  Clone ID: PAT_MRT4577_73591C.1
attggacttgagaatggaaattacacggtcacacttcaatttgcagaggttgactttccagacatgcagtcttggagaagccgagggaggagggttttcgatatctatgtccagggagagcgcaaggagcagaactttgacattagaaaggcagctggagggaaatctttcactgctgttaagaagcagtatgttgttccagtaaccaaaaacttccttgagattcatctcttctgggctggcaagggcacttgttgcattccttataagggatact

SEQ ID NO: 2637 - DNA, 535 bp, Zea mays
  Clone ID: PAT_MRT4577_73654C.1
acgggaatgcccgcttaccggcgcgagaatcctttatagcggccgcgcggatgtactaccgcgtaaatattgggaattctggtctctcgttactggatagcgggcgcaggcaaagggaacagccgggggtccaacacctaattcaaaggtcgaacggacactaacccggtgacagaagccaacggctacacggtgctatagatagataagataactcggccgaagccaggatgggcccacacatcaattcctccagccgccgtcgccgccgacggaggcgtcaccaccacccttgtgccgaccgtcgtatccgccaccggctccggagccgtcgtcaccaccctcgtgccgaccgccgtaggcgacaccgtcgacaaaaccggcgtcacggtgcccgccaccatatgcgtcgccgccgagaccgtcggcgtagtcaccgtcggcaccgccaccgtcacgggactgggcctggttaacggtgatgttaccgccgtcgagctccttgccgttcatgttctcaatagcgtacagcatg

SEQ ID NO: 2638 - DNA, 1513 bp, Zea mays
  Clone ID: PAT_MRT4577_73837C.1
cattgggtacctcgaggccggggccgccctgtttcctttcctttttgcattcccacccacccatcccctcaaaattcgcagcgtgtctcttcctccatcgcagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataaacaggggggagcggggggaggggctgggctggaccggaagcggatcaacgacgcgctggataagcatctcgagaaggcggtcgcgtcgccgtccacgtcgagggggtcggcgggcggcgggcgcgaccaccaccgcctcgtcgtgccgtcctccgtgtcgtccatccccaagggccgctgctccgaaggggagtctgattctgatagtgaagcatcggatgttagcggctctgatggagaagacacctcatggatttcatggtattgcaacttaagagggaatgagttcttctgtgaagtcgacgatgattatattcaagacgacttcaacctttgtggtctcagcagccaagttccttattatgattatgctctcgatctcattttagatatcgagtcatctcatggtgatatgttcactgaggaacaaaatgagctcgtagaatcagctgcagagatgctttatggtctgatacatgcacgatacattctgaccagtaaaggactggctgcaatgctggagaagtataagaactatgactttgggcggtgcccgcgtgtttactgctgtggtcaaccatgcctgccagttggacaatcagacatccatcgatctagtaccgtgaagatatactgccccaagtgtgaagacatctactacccacggtccaagtaccaaggcaacatcgacggcgcatactttgggacaacgttccctcatctgttcctgatgacatacgagcacctcaagccacagaagctctcgcagcgctatgttcctcgtgtctttggcttcaagctccacaagccatgaacctcatgtatttgtcttttaaactcctcaagacgtggcactgggggcatgcgggagttttgcaatccttgaagacttgcatataagagcgccattggcaggtcagtggattggtaaaattctatcatgctgcagcgtgcttgtaccttagctggctggcacctatccaacatttgaatgtagctctaaggatatcaatgttgtaacctaactgctattgttctttgattagtaaaccaggagccccccctacaatgtagaatatggcaattatttatggctttgcagaaaataacaacccttcatctgcttggttctcgtaatattttagatcaattacctacttggttatcgtaaaatgggaaatgagatttgcaaaggtgcgtcatctcaaaaaaaccaaaaaaaataataaaa

SEQ ID NO: 2639 - DNA, 212 bp, Zea mays
  Clone ID: PAT_MRT4577_73990C.1
tttcgagtccgcccgcatctgcgacggcatcctggcgctggtcgactcccacctcgtcccatccgccggcggcgccgagtccaaggtcttctacctcaagatgaagggtgactaccacaggttccttgctgagttcaagtcaggtgcagagaggaaggatgctgtggatagctccatgaatgtcttcaaagctgatcaggttattgttcttg

SEQ ID NO: 2640 - DNA, 516 bp, Zea mays
  UNSURE (1)..(516): unsure at all n locations
  Clone ID: PAT_MRT4577_74051C.1
  unsure (1)..(516): unsure at all n locations
ggcggacccaaaaacaccatttttttctttaaatataaactaaaataaaacctggcggggggaacaagattcattggtccccaatccatgctgtttgaagcctggggctgctgaaaccgcgggtggacacaggacttacaactggcacaaagggacctttcaattaaaaacacagatggggggcaacaaacacgacacgaacgaagataaaccctctgggctagggggaacatcacgggggcgaacaagataaattgggcgcgcgggccccaccgctcagttcctccagttcccgtcggagttgccgtagccgccgccacggttgccaccgccgtagccgccgccaccaccaccgtagacgccgccgccaccgtagccgtcgccaccgccgtagccgccaccgccatcacggtgcccgccaccgccgtagccgncgcctccacggtcaccaccgtacccaccgccgccgccttcacggtcgtcgggggactggccctcgtgacggggatgttgggg

SEQ ID NO: 2641 - DNA, 523 bp, Zea mays
  Clone ID: PAT_MRT4577_74152C.1
ccctcgcacacggagcggagaagccttactagggcaggattggttaggccggcttggaccccaacatgcctaagagggctaccaacgctttcttcgagttcatggaggaatgtcgcttggagttcaatgataagaaccctaacaacaaggctgccgctgcggtgtcgaaagctgctggcgacaggtgtaaatccctgagcgagtcagtcaaggctccctatgtagccaacgctaacaagctcaagctcgagtacaacaaggccatctctgcctacatcaagggcgagagcactgcagctaacaaggctgctgccaaggaggatgaggaggacgatgacgaggactccgacacgtcctagtcggacgtcaacgacgaggatgatgaagagggtatcgaggacgatgcagatgttgacaagtgatgcagctcatcatgacaatgtaccgtgcttcattcaacattggatcggctacacaaagccacgccgtgatcacaataacggagcctatattcctgtactag

SEQ ID NO: 2642 - DNA, 240 bp, Zea mays
  Clone ID: PAT_MRT4577_7455C.1
cgcgcacgcacgcaacgcacacactcaacttcaacagctaatcctctcccacaagacaggacatggctggggaggaggccaagaaggtggaggtggaggtcaccaaggagcccgaggcggcggctaaggaggacgtagccgatgacaaggccgtcatcccctctaccgacccgcctccgtcgccgccgtcggccgacgactccaaggccctggccattgtctagaaagttgcatatgatc

SEQ ID NO: 2643 - DNA, 211 bp, Zea mays
  Clone ID: PAT_MRT4577_74610C.1
attgagaccaacttgcgacatagaaagcacaatattgtacccataatggcagccaaaatattttgcctcaatatgctccctgggctttctgcaaatgctgctacagcgagcatttttccgcaatgctcacaaactcctatagctttccttttttccccatacctctcaccagcgatgtgtttagtatgtgaaaatacaattcttttaccct

SEQ ID NO: 2644 - DNA, 3381 bp, Zea mays
  Clone ID: PAT_MRT4577_7471C.1
caccgagcacaactaccttattcgcctcgtttcctctctctcctctccactttcttctccccctcacggagtgcaagtgcgagtgggagagtgagcggcggcggcagcggcagcgcagcggcagtacagtagccacggcccctgtcgccgcgtggtgtgccgtgcccgtgccccctctcagcctctctctcccccttccctaccaggctacccacccaaaaccacagagaaaagcaggcctgggcaccaccaccgctgcctcgccccgagccaagaggaagccccaccccaaatgccttcctcttccccctgctaccgccacagcttcctcttcctggcccttctctcggcgtgcttctcgacaccgggggcagcggacggcaccgggggagccggcgacggcggggatgccgcggcaatgcaggcgctgcggcgggacctggcgccgccaggctggggcccgggtgcggaccactgcgcgtggcgcggcgtcacctgcgcagcgcgcaacgagatatccgggcagatcccgatcgagatgagagggatgcttcgcttgatcgaggtcaatctgtcgaacaaccggctcgcgctggcgcgcctcgacctctccgccaactcgctcagcggcggcctctcgccggcgttcggcgcgctcacccgcctcgagtacctcgacctctcaatgaacgcgctcaccggcgccgtgccggccgcgctcgctggcgcgtccgcgctccggttcctgaacctctccaacaacgcgctctccggcgccatccccgacgatctcaggggcctcaagaagctccaggagctgcagatttcgggcaacaacctcaccggctccctccccggctggctcgcgcggctcccgggcttgcgcgtgctgtccgcctacgagaacgcgctctccggcccgatcccgccggggctcgggctctcgtcggagctccaggttctcaacctccactccaacgccctcgaggggagcatccccagcagcctcttcgagctcggcaacctgcaagttctcatcctcaccatgaaccggctcaacggcaccatccccgacaccatcggccggtgccgcggcctctccaacgtccgcatcggcgacaacctcctctccggcgccatcccggcgtcgatcggggacgccaccggcctcacgtacttcgaggccaacacaaacgacctgtccggcgggatccccacgcagttcgcgcggtgcgccaacctgactctgctcaatctggcgtacaaccgccttgccggcgaggtgccggatgttctcggagagctcaggagcctgcaggagctcatcgtgtctggcaacggcctctgcggcgagttcccgaaatccatcctgcggtgcaggaacctgagcaagctggacttgagctacaatgcgttccgcggtggcctgccggagagcatctgcaacggctcacggatgcagttccttttgctcgaccacaatgagttctctggaggcattccagcaggaatcgggggctgtacccggctgctcgagctgcatctcggtagcaacaacctcagtggtgaaattccagctgagataggcaaggtgaaaagcctgcagattgtgctgaaccttagcttcaatcactttactgggccgctgccccacgagcttgggcggcttgataagctggtcatgctggaccgtgtcgttcgcgtggcgccgggcagatgctggccgtgctcagggtcgccatgctgtgcacggagcgcgcccccgcgaagcggccccggatgaagaaggtggtggaaatgctgcaggaggccagggacagctgagtggtctggttcctctgctcaatgatgtgtggttggctgccttggaacttggaacgttggaagtcgaggcgagaaactctgaactgatcatcgttggagttcgagtatggagtccatccggtagcgtttgatttgcgtgctcatcttctcactggtgtcgttgctggtggcgttgttcatgtggcgcgagaggcaggagaaggaggaggaggaggcgaagaagaaggcggcggaggtggcggtggcggcagcagccccacaggtggtggcctcggccgtgttcgtcgagagcctgcagcaggccatcgatttccagagctgcgtgaaggcgacgttcaaagacgagaacgaggtgggcaacggaacattcagcaccacctacaaagctgtcatgccctctggcatggtggtgtgtgtcaagaaactgaagtctgtcgaccgtgcggtcatccaccagcagacgaagatgatccgagagctcgagcgtcttgcccacatcaaccacaagaacctggtccggcccgttgggtatgtcatctatgacgacgtcgcgctgctgctgcaccaacatatgctgaatggaaccctgcttcagttgctgcacagcagcggcggcgatactgacggcaagaagcagaaacctgactggccgaggctgctctcgattgccattgatgtcgccgaagggctcgcattcctccatcaggttgccaccattcaccttgacatctgttcagggaacgtcttccttgactcgcactacaatgcgcttctcggcgaagtcgaaatctccaagctactggacccttcaaagggcacagccagcatcagcacggttgctggctcatttggttacattcctccagagtatgcctacacgatgcaggtgacggtgcccggcaatgtgtacagctacggcgtggtcctgctggagatcctgacatccaagctacccgtggacgacgtgttcggcgagggcgtggacctcgtcaagtgggtgcacaccgcaccagcaaggggtgagacgccagagcagatcatggacccccggctgagcaccgtgtcgttcgcgtggcgcaggcagatgctcgccgtgctcaaggtcgcgatgctgtgcacggagcgcgccccggccaagcgacccaggatgaggaaggtggtggagatgctgcaagaggccaagaacagctgagttgatgtgtttctctgctgaatcctgaatgctgcggttgcctgcttggaagtcgagccgagcctctagaaaaaaatctggtcattggttcggttcgagtatgaaatccatccagtagtgtttaattctctgtatatattcggtaattagtaccccgattatgcgccatttatggatattggatcttgaagcatcaaactagaaatcttgcttgcagtgctgctacctgcaacttgcaagtgaagaaatgtctcatccataggagtaaatctggatcgtttttagcaaaaccaaaaaaaaaaagggcgccccccgagtagaaagcgcgtggacaccgggatatattctggggcggggcccgcacg

SEQ ID NO: 2645 - DNA, 1358 bp, Zea mays
  Clone ID: PAT_MRT4577_74755C.1
aggcccagccaaatttccgttcacctggcttcacccacccgcgtgccctcgccgacaactgagccaccgccgccgccgccctacccccaggtgcccaggtcgtttcggtccctttgccaggtcttcgccggcgacgagcaccagccaccagccagggaatataactttgacctgtaaaatgaggccagttttttgcgggaaccttgactatgatgttcgcatctctgaggtcgagcgccttttcgggaagtatggaagggtggaacgagtggatctgaagacagggtttgcattcatctacatggaagacgaacgtgacgctgaagatgctatcagtagacttgatggaattgattttggcagaaaaggaaggagaatcaaagttgagtggaccaaggaggatcgcactgctgatcgaagaggcaactcaaggaggtctccaaccaatgcaaaaccgaccaaaaccttgttcgtgatcaactttgacccgatcaacacgagaattcgagatctggagaggcactttgataaatatggcagggtcgcgaatgtaaggatcaaaaagaacttcgcctttatacagtttgaggcgcaggaggatgctactagagcattggagggtgctaatgggagccatttcatggacagggtcatctcagttgagtatgcgctccgtgacgacgatgaaaaaggtgaaagggcgacgaacggatacagcccagacaggagaggccgcgaaagatccccaggtgcaagacggtctcctagtccttacggcagaggtcgggagagaggtagcccagactatgggagaggcaaggagaggggcagcccagactacggcaggggaggccgcagccctgataatggcaggggaggccgcccagccggcggtggcggcggcggcagaggtgatcacgccaggggaggaggacgacgacgcagccctgactattatgaccgcgagcgccgagaagctagtcctggctatgacaggccccccagctgctcacctggaactgggagggacgcgagagactagaaaagcgccccatgcctgtgttgtagaattcaagcatcaaagcctcccgcgtcagatgaagttagagttggtgatgttagccagcaggaaactcgtttacttatgtgcgttagctcgtgctgactttgcaagttagcttaccatttcccatttgcgactccagaatgtaactcgtatggtctggaatggtagctttcaggactcgtttgaacctttcttggagttttttttttttttccggctcccttgattgccctgtgcatgcgctgatgaatctacagattgtttcgtcaaaaaaaaaaaaaaaaaagccagt

SEQ ID NO: 2646 - DNA, 617 bp, Zea mays
  Clone ID: PAT_MRT4577_74826C.1
gtcttttatctcatccatcacagctagctagagtaatgacgaataatctcttcttcacctcactagctaacaccagctagcaggtcgatcgctctgacctggaataatggccgctcgctcctcctcccagcagctggtcgcggcgtcggacctggcatcgtggctgctgctgctggcggcgggagccggtacggcgtcggcagctgcgagctgcggacaggtgacgtcgtccctggcctcgtgcctcggatacgcaatgggcagcgcgccgtcgccctccgctgcgtgctgcagcgctgtgtgctcgctcaacagccgcgcgtcgtcgacggcgaaccgacatgccacctgcaactgactcaaaagcatgacggtccggctcggctgaggattcacaatggccaacgcctccaacatccccgggaagtgcggcgtctccggcggagtgcccatcaggcccaccgtagactgaaccaatatcaactgatcgatggaaccatagaggacgtatctcgctcgttggatgacagcgtacttggccatcagcagcatgcagtcgacgacatatgacatatgtactagctactcgtgtgtcatgcatcagactggtacataat

(The sequence listing continues in the following parts.)

What is claimed is:

1. A transformed plant having a nucleic acid molecule which comprises:
   (a) an exogenous promoter region which functions in a plant cell to cause the production of an mRNA molecule, which is operably linked to
   (b) a structural nucleic acid molecule, wherein said structural nucleic acid molecule comprises a nucleic acid sequence, wherein said nucleic acid sequence encodes a polypeptide that has at least 95% sequence identity with the amino acid sequence of SEQ ID NO: 5111 and has deoxyhypusine synthase activity, which is operably linked to
   (c) a 3' non-translated sequence that functions in said plant cell to cause the termination of transcription and the addition of polyadenylated ribonucleotides to said 3' end of said mRNA molecule.

2. The transformed plant according to claim 1, wherein said plant is selected from the group consisting of soybean, maize, cotton and wheat.

3. A transformed seed comprising a transformed plant cell comprising a nucleic acid molecule which comprises:
   (a) an exogenous promoter region which functions in said plant cell to cause the production of an mRNA molecule, which is operably linked to
   (b) a structural nucleic acid molecule, wherein said structural nucleic acid molecule comprises a nucleic acid sequence, wherein said nucleic acid sequence encodes a polypeptide that has at least 95% sequence identity with the amino acid sequence of SEQ ID NO: 5111 and has deoxyhypusine synthase activity, which is operably linked to
   (c) a 3' non-translated sequence that functions in said plant cell to cause the termination of transcription and the addition of polyadenylated ribonucleotides to said 3' end of said mRNA molecule.

4. The transformed seed according to claim 3, wherein said seed is selected from the group consisting of soybean, maize, cotton and wheat seed.

5. The transformed seed according to claim 3, wherein said exogenous promoter region functions in a seed cell.

6. The transformed seed according to claim 3, wherein said exogenous promoter region functions in a leaf cell.

7. The transformed plant according to claim 1, wherein said nucleic acid sequence is SEQ ID NO: 1562.

8. The transformed seed according to claim 3, wherein said nucleic acid sequence is SEQ ID NO: 1562.

* * * * *